United States Patent 11,242,544 (MICROBIOMES AND METHODS FOR PRODUCING MEDIUM-CHAIN FATTY ACIDS FROM ORGANIC SUBSTRATES) - sequence listing, part 11

SEQ ID NO: 697 - DNA, 574687 bp, Unknown
  Metagenome-assembled genome
tagttgggggatcgctccctgcgaggatagggcattgccatgcattacggaggattagctcagttgggagagcatctgccttacaagcagagggtcacaggttcgagccctgtatcctccattgagcattatgctcatgagccgttagctcagtcggtagagcatctgacttttaatcagagggtcgacggttcgaacccgtcacggctcattgccatagagaggctttgagatgcggaataccgtaatttttacgccgacttagctcagttggcagagcacctgtcttgtaaacagggggtcggaggttcgagccctctagtcggcatcttgaatattatgcggaagtagttcagtggtagaacatcaccttgccatggtgggggtcgcgggttcgaatcccgtcttccgctttgtcaattccataatgccggggtggcggaattggcagacgcacaggacttaaaatcctgcggttagtgataaccgtaccggttcgatcccggtcctcggcatcttttgcacccatagcgcaattggatagagtgtctgactacgaatcagaaggttgaaggttcgactccttctgggtgcacttttcgggaaatagctcagcttggtagagcacctggtttgggaccagggggtcgcaggttcgaatcctgttttcccgattaacaatgaaaattgttatcgcggtgtagctcagctggctagagcgtccggttcatacccgggaggtcgagggttcgatcccccctgccgcgataaatgggtctatagctcagttggttagagcgcacgcctgataagcgtgaggtcggtggttcgagtccacttagacccataacttgcaaaagttgcttttatgatcatgacccattagtcaagcggttaagacaccagcctttcacgctggtatcgtgggttcgaatcccgcatgggtcacttaatttattatcgcggggtagagcagcctggtagctcgtcgggctcataacccggaggtcgttggttcaaatccagcccccgcaattttggtccgttggtctagttttggttaggacgcatccctgtcacggatgagatcacgagttcgagtctcgtacggaccgtttatatggctcggtagctcagttggtagagcaacggattgaagctccgtgtgtcggcggttcgattccgtcccgcgccattaagataattaagcttctgcttaatgcgggtatagtttagtggtaaaaccacagccttccaagctgttgtcgcgagttcgattctcgttacccgctttaataatatatgggtctatagctcagctggttagagcgcacgcctgataagcgtgaggtcggtggttcgagtccacttagacccattggagaattactcaagtggctgaagaggcgcccctgctaagggtgtaggtcgcgaaagcggcgcgagagttcgaatctctcattctccgttatgacccgttagtcaagtggttaagacaccagcctttcacgctggtatcgtgggttcgaatcccgcacgggtcacttgtcatgacccattagtcaagcggttaagacaccagcctttcacgctggtatcgtgggttcgaatcccgcatgggtcacttaatttattatcgcggggtagagcagcctggtagctcgtcgggctcataacccggaggtcgttggttcaaatccagcccccgcaattttggtccgttggtctagttttggttaggacgcatccctgtcacggatgagatcacgagttcgagtctcgtacggaccgtatgattgaacatgttgctgtttcggcaacatgtttttttgttggcaaagctcgtgagaaaacttggtactttaagtctttgtcaaatcgtattggtgaagatcaattccctgcttcaaaaatgaagtggggaatttttttaggcatggatacagtcaatgcgccgcaatagattttcaaaattgcggaagccacaacagctgcgttttaagtttttgatttttcgattgatgcctttcagtagcccgttggaatagtcgtatttggcactgttggcgatataatgggcggagtgaaggtttgatccatcgcggttttggtgttctcataggcaaaaatggcactgttaaactcgtcaacattgcgccgactgaagcccctgataggtttcgtaaacccgcgtaaagtcaggatatttgggtgattgcaattattgcaaattcagatttctaggtaaaacaaaagtgcaatgcattgaactgcattgcactttttctattcagctggacgataatcctcatagtagtaaacgctgcgcggactgtgatccatgtatccggcgagcggtgcaaagtcggtactgctggtccagtcatcaatggcaactgcatttgtccaagtcgttatcaaaatagttgcattggtttgatcaggacgtgagaacatatagccagtcgtcattttagaatggtcagcactatcaagagcaatttttgcctgtttgcgcagcaggttcttatcttcagtgccgagctcaaatgattcaaaatgaagaattcctttgaacttgtcattaccaacactgtataaagtctctaaggtaattggactgttaaagatggttggcttacctgataggtcaaatagagccagcttgctgttgtcaccagttgcctgcagcagccggaagtcacgatctgggtgctttttaatgatttcaagcagaactggcattgagccaaaagtaaaactaatttgtgatagcatgattgtctcctccttatcttaattgtctcaattataccgctcattaacattaattgggaataacgagttggaaagcgcaactaattaatcaatgatgcccattatatcaataaatgtatcgttcgcgatggtagtttaataattgttgatgagcaaaccagacgttatttttaatttcacttacaaaaagtcaagaaaattactgacagtggttcaaaatcattctaaaataagttataattatttatggagtgatcaaggttaaacatgtttttgatttaaaggaggcccaacaaatggttacactatatacgtctccaagttgcacatcttgccgtaaggcgcgggcctggttgaaggggcatggcattcctttcaccgagcgcaacattttttctgaacctctgagtatggacgaggtaaaaaacattttacgaatgactgaaaacggtactgaagacatcatttcaaaacgttcgaaagcttatcaaagtttaaacattaatctagatgagatgtcaatgaccgagctttatgatttgattcgtaaaaatccaggcctgttaagacgaccaatcattatggatgataaaagattgcagattggatataacgaagatgagattcgtcggttcctgccacgtgaagttcgggcattggagctggctgaagcacgtcgaaaagcaaacttgaactaaaggggtggcgatttttcgtcgcctttatttttttatcgaactgttatcggaaaaagaatgctataatgaaaactagacgtttaatatcgttcggctttttaagcttgaatcaaagccggagcgaccgtatgaaaaattagcgaatcaaagggggcgcgatgcatatggaaatgaaacgcattaacgaaaatacgattcgcgtgctgctcaataatgaagatctaaatgagcgcggtattaccgtacttgatttgctgaatcataatcaacagattgaagactttttttacagtattttagaagaagtcgatgctgatcatcaatttcaggataatgatctggttacgttccaagttcgtccccaacaagatggtttagagctttatattaccaaaacggatcctgccagcctaaaaaaaggtacgcccgctggtcagccgccattggatcaagaccagattaccaacttgataaaaaaagagctggttggcagagatcgtcaggaatcgcatccagatcataatcaagaaaataatgtgtccgcaggtgatgagccagaagctgccatcgataatccagacattgaaaaaaacgtttgtgtcttaaggattgatgattttgaggatctggtagccctggccaaatcagcacgtgacaacatcaatgcggtatccgatctttatcgttatcagaacaatgactacctgctcttgacgtttattgatgatggctcactgtcagcgagtcagttgaaggatcagctggctttggcatatgagtatggtcaaaaaaccaatctgacgcccgatgtcattttagaacacggtaagccattaatgaaacaggctgccctagaactggtgcgaacgtattttgaatagttaaattgaaaagctgagtcattggacatttcaatgactcagcttttttaataacaattacagttttttggcatatagcaaagtggaggtgtaattatgcagaccgctttgtggaatggtcaactggtctgggcccaaactgaagctaaaaaagcgcagcgaacgtattggtgcccggactgtggtcaaaaagttcatttatgtcagggaaccgatcatcgtccctattttgcgcattatgcccaaagcagatgtgatgccaatgaaaccgctattcatcagttgggtaagcagcagattggcaggtggctgaatcagcaaggctggccgagctattctgaggtttatttaccgacaatcaagcagcgcccagacatattgaccaagattaatgatcagtgggcagccattgagtttcagtgcagtccgcttggcttgacgcggctgattgaacgcaatcaaggatacgagcggctgggaattgcctatcgctggtttttggggccaacctatgcgcatcggctgcagccgggaaaagcagctcagtttttacaatggcatcatcagcagctggtcttaccattttggaatttaaaacgacagcagcctgactatcaaaaaagacggctttttggccccaaatcgggaaaaagtcgtcaagatgtctggcagattttaatttggcagactcagcagctgcagcggcagattcgcttggcaacgccgcggctttgtgaattagccaatcaaacctatctaatgggccacggagcaatcagtacctgtcccttggttgctcatgatacgcattttcaatggagcttgatgaatgagaccccattagaatggcgcatatccgttattttaaggcttgagcagtgtcccgcgcatcaatgttggaattggccagcctggtatgactttttaaatcaaagtgccaattggcttcctttgccatgtctgagtgatcttcaagtcgagcaggttcgtcatcgaagcctggcctgctatacccaagagctgaatctggctggcgtgatccgctaccaacagcaggtcgttgaattgattcagccgccgcgatggttcagcagctatgaacgcaagctggcctacttggaaaaactggcagccagctaaagaatccgcagtgttgattgatgatgcttatcattaaaactttgcgcaaattcttcgggagtctgctgcaggcaaaactgatgattacggtatgattcaatcagcgattcatagtcaaagttgttgatcatatatccatagacaggctgttcggaatcaaaaacgactgcagtggcagtttgggtaacgcccatttcatcagccatgtattgatcctttttgaatgctttgattgccagttctgatttacgatcttcccaaaacatgtccaaatcaagctgcgcctgttgagcaatcttttgggcaagggcttctgaataatcagctccttcattgatcagcgcagattgcagccgcagcagataatgtcggccacgcttgcgtccttgaaacagtgctgctttataatccaagataatctggtaaagcgtagccgaagtctgctgccgaacattgagatcatgatcgttgagatgataaagcttcatagtctgctgaatcgtgtccatattaaacagcggaataaattgatagttgactttagtgcgcaattgctggtcaatgcgcaaaacatcctgttcgcagcgaaaacagcgcatgcctaatggattaacaaaaagatgaatttcgagcacagccgctcctcctgttcgttgcagaattatcggttattgaacaatgctatttttacaaagaatgagcacgatgtaaagcgatctgttttggatgaatttacataaaataatttgaagcaatcatttagctaatcagttacgatatctgtgaaaatactagacttgtttttcagttgaaccaggcagtctttagttaagtcattacgaaactatgataaaataaacagagattgtcaaggaagtgggattgcaatgattgaagattggcagcattttttattaccttatcaacaagcagtcaatgaattaaaggtcaagctgcgggggatgcgtaaacaattccaagatcaagatcagcattcaccgattgaattcgttactggccgtgttaagccggttgacagtattaaagaaaaaatggtgcggcggcatgtcttagaagaacgcctggagcaagacatgcaagatattgctggcttgcgaatcatgtgtcagtttgtcgaagatatctatcaagtcgttgacctgctgcgtcagcgcaatgacatgacgattctagaagagcgtgattacgtaaccaacgttaagccaagcggttatcgatcttatcatatcgtgatcgagtatcccgttcagctggttactggtgaaaaaaaggttttggctgagatccaggtacgaacgctggcgatgaatttttgggcgacgattgagcattcattaaactacaaatatcaaggcgcgtttcctaaagaactttctgatcgtctgcagcgggcggcagaggctgcttttaagctggatgaggagatgtctgagattagagaagaaattcaagaggcacagacgttgtttggccgcaagcaagcacctgatgaactgctgaactcatcgctggaagataaaaaaggagcggattaaccaatgcgggtagccatttttaactatgaatcgccggagtcattgcgcgtacgcaaactgttgctgaatcgtctggaagaggaaacggcaattacctatgatgagcagcagccagatgtcgttatcacgattggcggtgatggcacgctgatttcggcatttcatcactatgaggatcgcttgtcgacgattcgttttgttggtattcatactggacacctgggtttttataccgattggcgtaattttgaggtcgaggatctggtcgaaagtctgcaaaacgacagtggtcaatccgtcagctatccattgctggaaatgagtgctacttatgatgatggtgagattgaacgacgtgtggcgctgaatgaatcaacgctgcgcaatatcgtcaagaccatggtttgcgacgtatacatcaataatcagctgtttgagcgttttcgcggtgatggactggtcatttcaacaccgactggatcaacggcctataataaatcagttggcggcgcaattttggatccgcgcattatcggtttccagctgggggagatggcttcgttaaacaaccgggtttttcgaacgctgggctcgccggtcgtttttggctcagataccaaactgacgctgcggctgcctgatgattccgggacggtgctaagctgtgatcgcgatcagattatgatggattcgcagtcgcatcggttggtcgacgtatcctatcgcgtatccgacaaagtgattcgttttgccaagtaccggcataccaacttctgggaccgcgttaaggattcgtttattggaggcatccaataatggagttttcctgggtctataccggagaaaagccgatcaagctgcgttcggcactcaaacagcagggcgttaccagttcattgatcaaagcagccatctttcatggtggtcagatgacgatcaatcatgaggtgaaatgggccgtcgatctggttgagccgggggactgttttgccattgagctgccgccagaagtacctaatgatcatgttccgatctgttccaaaccatttgatatcgtttatgaagatcgggattttttggtgatcaacaaagctgccggcgtggcaacagtaccggctcataacgttgccgaacaagacagcttggtcaatcgcgttaaatactattatcaaaaacaaggctatgaaaatcaggtaactcatgtcgccacgcgtctggataaagacaccagcggcctggtgatctttcctaagcatcgttttgctcatgccgtcttggataatcagctcaagcggcatttagtaaaaaaggaatacgttgctttagtcagtgggcaggtggcaaccaggcatggctatatcgatgcaccgatccagcgtgatccagaatcgtttgttcagcgtcaagtcggttcggatggtaaaacggccgttaccgagtattggctgaaatatccgggcttgaatgcctcgatcgtcaagattcggttgcataccgggcgtactcaccagattcgcgttcacttcagctatcttggtcatccgctgttgggcgatgccatgtatggcggaccagacgtaatggctcggcaggcactgcactgtcagtggctgagcttctatagcccatttttaaaccggcagattgagctaaaagcaccaattccaagcgacatgactgccgtaattgaaaaaatgacgcaataaaaaacgggacgctgattaagcaccccgtttatttattgaattgtcagcagttatttaggccagcgcttgacacagactggttctggacaagccacgtctttttgcagcagcgtcagcaggccagattgagcatcccgtttgtaaagcgtcaggttatcgctgttttgatttgaacctaccaggtaggcgtcgtcatggctcaattcaaagtcgcgtggaaaatcgccttctgtactgatggattgaacgtgggcaaccgtaaagtctggctggacggcaaaaactgcaatggtattttcaccacggttggaagtgtagacaaatcgaccatcagcagaaatgtgaatggctgcggctccgttatgagcggtccagtcagccggaatagtcttgatggtctgcaggtgagtcaaggaagcgtcagcagcgttgtagcgcattacggccagcttgctgcttaattcacccagcacatagacgatcttgccatttggatggaagaccaggtgacgcgtaccaaagcccggttcgaactggtagcgggatgcagccgtgagcttgccttcaccggatacgtcatagacaacgaccagatccattcccaggtcgcagacgataagacgattgtccggcgttaaatcgatatagtgaacgtgtggcgcatcctgttctggttgggggccggttgctccttgatgaacgacggaatcagtttgggtcagcttgccatcagcggcaatcttaaagaccttgagttcgccggtatggtaattggcagagaacaacaagtgacgctggtcatcaacgccaatgtaggcaggggtaggtcctttttctaatttggcatcgatcagttcagccttgtcgccggacagatcgtatgacgctacgccgccacgctcaccatcctgttttaaggcatacaggcgtttttgttcaccgtactgcaggtaggctggcttgccggaagcagccaccaggcgaacgttggtcaattcttctttttccgtgtctaaggttacgccgtaaatgccacggctggatttactgatgtaggttccaattaaaaagtcttcagtcaaaacgaagccctcctttaaaaatgtacacctatataatagcagaaactgttcgcttagaattgagaaattatgagcaaattgaaaggatcatcaatgaaaaaaatcgtaattaagaaacaatgggtcaatgagcatcgacggctgtttcgctgctcagtctgccagtcaccaatcaagggcgtttttgaaaacagtctggtctgtaagcaggggcatgctattgattttaacaagcatgggtatctttattttttgaataatggcaatggtaccgactatgatcgggcgatgtttgaagccagacaccgcatgctgagcgcgggacttttcctgccaatgcttaagcagatcaatgccgtgatgccagaccagccgcagacgattctagacgttggcacgggtgagggaacgccgctttttcaattagagactttgcgggatcaaaaagatgctgccattggttttgacatttcaaaggccggtgtgcaattagccactcagctgccaggtaagttgtttttttgcgtagctgatctgcgccggctgccgtttgcggacgagtcgtttgatcaggtgatggagcttttttcaccatctgattatcaagaattcgatcggatcctcaagccaggtggtcagcttttaaaaatcattcccaacgccaactacctgatcgagttgcgtcaccttttatacgatcaaaacgatcagcatgctgcctacgacaatacaccagtagtcgagcgttttatgcagtattaccagcaggccaggatcgtaccgcttcaatatcagtttgagattccgctggggctggctgaggatttggtagagatgtcgccgctgcattggggtcgcaatgcgaaacagcttgatgaaagcgatttatcatcattaaaacaagttaccgttgacgtcagcttgttaatcggtaaaaaaatttgattaattaattgttttttttaagtgatggtagtatattatcttatagagatcgtttgactgaggacatcgatttaatcgttggcattggtcaaagagtacttcattaaagcagcgtttcgccgtgcccacaccgagaccctgctttttttattgccttttttaggagagagaagactgactatgactaatcatattgtgctgtttgaacccttgtttccagctaataccggcaatattgccagaacctgcgccggaaccgacactgttttgcatttgatcaagccccttggtttttcaacggatgacaagcatatgaagcgtgccggtctggattactgggacaaggttaaggttgtctatcatgaggatctgcttgattttatggcaacggtgcctaaccttgaccagctgtatctggtttcgaagtttgccgaacgcgactatactgaagttgactaccgtttgcctggcgaccactattttttgtttggcaaggaaacgaccggcttgccggaaccgtttatgcgacgctatccgcaaaactgtattcggattccgcaagacgacaacaacattcgtgcgcttaacctttccaacagcgcggcgattgttatttatgaagcgcttcgtcaacaaggatttcctaaattagcccgtgtgcatcgctattcggacgataagctgaaataatcggtaaggtaaaaggaggaattgcatggcccgcaaaaacaatacgacccgccgccgttccaataaaacggctgccaagcggcgatcaagaaaaccagcgcgtgacgagcgagctattcgcagcttaagcggtctgaccatcattcttttaacgctgaccggtctgtttaaactgggaattttaggtgctggcgtgcaggatatttttaaggttttggttggtcaaagctatccattgttaatggtaatcgtaatcctgtacagtctgggactgacgatctatgctcaatggccgcgctttagaaaacgctgggtctggggaatgctgattttttatctgggactcttattgatgctgcatgcgcggatgtttgatcaattaggccgccacagcgatttttggaatcagacctggagcagcgtaactgcggcagtcttaaatgatgattccagtatgccgattggcggcggtatgttgggggcagcgttatattctggcagcgggtatctgcttggcagtactggaaccaaggcagcggctgttttgctgatgattatcggcgttgtggtcttttttgatctgccggtgcaaaagctgcgtttggcgattgcccaaatgctaaagcagcttaaagaacgcttccatcaattaaatgctgatcggcaggctcggcaagcagagcgtcggcaacgtcagccaaaagagccaatggcagtgccgagcgatgaaaaggatctgccaacgccgcatgctgaacggaaacgtgagcaacaatcacgagaactgccagaatttgaaattggtcaatcagcgtctgataaaaccgctgcacctgatcagcaaagccgcgcgccccgcattaccgtagccagcgaaaatgagcggccagcatcattgaatgctaaggatcagaccgatgttgaactgtccttgaatcgggttgaagccaaagaggatcaggactatcaattcccgccgctggatcttttaaccaaagtgaagccaacggatcaaagcgctgatcttgattcgattaagtccaatacgcaaaaactgcaggatacgttaaaatcgtttggtgtcgatgccacggttgaaaacgtgaacctgggaccttccgtaactaaatatgagctgcgtccagccgtaggagttaaggtcagtcggattacgaatctggctgatgacctggccttggcgctggctgccaaggatattcggattgaagcaccgattcctggcaagtcattgatcgggattgaggtgcctaatcaacagattgccacggtaggttttcgtgatatgatcgaagctgctccccatgatgatcgaccgcttgacgtgccgcttggtcgcacggttactggtcaggtaatgacggctgatctgactaagatgccgcacttgctgattgccggagcaaccgggagcggcaagtcggttgccattaacgtgatcatcaccagcatcctgttaaaggctaagcccagtcaggtcaagatgctgatgattgatcctaagaaagtagagctaagcgtgtataacgggattccgcatctgctcagtccagtggtttccgaaccgaaaaaagcggctcgggcattaggcaaggtagttggtgaaatggaacggcgctatgagttgtttgctgctttaggcgtccgcaatctggatggctataatcgaatggttgaaaaagaaaatcaaaatcataccgatccgaatgaacagcagccgacaatgccattgattctggtaatcgttgatgaattggctgatttgatgatgactgtttctaaagacgttgaggatgccatcgtgcgaattgcgcaaatggggcgggccgccggcattcacatgattttggcaacccagcggcccagcgttgatgtcattaccggtttgatcaaggccaacgttccttcacgaattgcatttgcggtctccagtggggtcgattcgcgaacgattattgacaccaatggagctgaaaagctgcttggccggggcgacatgctgtttgagccaatcgatcaaaacaagccgattcgaattcaaggcgcctttatttctgatcatgacgttgaggcagttgttaatttcatcaaaaatgagcggccagcagagtatgatgatcagatgatggttagcgatgctgagatgcagcaagaagaacaaaaagaagatgaagatgagctgttcggcgaagcgctgcagtttgttgcccaagagcaaaaagcctcaacctcactgattcagcgtcgtttccgcattggctataatcgagcagcgcggatcattgatgatatggagcagcgtggctatatcggtccagctaatggctctaaaccgcgtgaagtctataagaaaccagacttgccggcgcaatagggctaagctgcttaaaatttaatctagtaaaaaagaggttttagctgtttggccaaaacctctttatatttataccgatcagctagaagccgagtgaagcaacggcccctaaaatcaaggagcccagcattgcgatcagcatcagccaaacggccaccatagtaattttttggaatcgggtctttttcttgcgttgcatcggtaactaatcccgcctttcaatttatccttatcagtttacacatcttagcacccaaattcaaatctgttgttgatctgtgatagaatgagacttgactaaattttgcggaggcagtttgaatgataagacaactgatcatggagttcattatcttgattggctatggcatgctggaacggttaacgattaagctgtttaaactgcccaagcaacgtagtacctggctttgggccacgctgctgatggtcttgagcttttggaatctggggttttattggtactgctacgtattgattgtttggatgctgctgagtatcggcctgatctttttacagctggcggccgcgcatcagttcatctatcgacagtattggccggctttttggcgcgtaacgctggtcgtgtcagttgcagctttcttggtttctttagccggatcatatctgccggtcgtttagaaagaagatatgtttaggatttcaaagccgttgtctcgcttcaagggacagcggcttttttaggctgtacaaaattattaaaatccatggtgagaagtgggggattgtggtagactgtatctgtaacattggtccaaaaggggggattagtatgttcatgggtgaatatgaacatacgattgacgataagggtcgtctgatcatccccgccaaatttcgttcgcaactgggagacggattcgtcgttactcgtggcttggatggctgtttgactggttatccgctgagtgtctggcatgaattggaaacaaaattaaagtcgttatcaatgacaaaacgcaatgcacgagctttcgtgcgttttttgtatgctgccgcgaccgaatgccagttcgataagcaaggacggatcaatttgccaatagcactgcgacagcatgctgctttaaataaacagtgcacgatcgttggagtatcagagcatttggaaatctgggatacagaacgctggcagcggtatatggacagtacggctgcagattttgatcagattgccgaggatcttgacttcgatctgtagcttgtcagaaaggaggtatattaatgactgaattcaaccacgttacggtgctgcttaacgaagcagtggctggtttaaacattaagccaactggcatttacgttgatgcaacgcttggtggtggcggtcacagtgaggcaatcttaaaacagcttacgacaggacatctgtactcgtttgatcaagatcagactgcaattgactataatcaggagcatcttaagccgtacttaaaggctggccaagaaacctttattaaggacaatttccgccatttaaaatcggctttgaatgcgcagggcgtaacgagtattgatggcatcgtctatgatcttggcgtttcttcgccacagtttgacgatgccaagcgtggttttagctatcagcacgatgcattgctggatatgcgcatggatcagagccagtcgctttcagctatggaagtcgttaatgaatggccatatgaacgtctggtcaagattctgcaccgctatggcgaagaaaagtttgccaagcagatcgcgcgggcaatcgaacgacagcgcaaacaggctccgatcaagaccacgcttgaactggctgaagtcgttaaaaatgcaatcccagcggcagctcggcggcacggcggacatccggccaaaaagagctttcaagcgattcgcattgcggtcaatgatgagctgggcgccttggaggactcattggagcaggcgtttgagatgcttaacgttggtggccgcatcagtgcgattacctttcagtcactggaagatcgattggtcaagacaatgtttaaagaacaggcatcattgccagaattaccgccaggattgccagtagttccaccggacatggaacccagctttaaattggtaaataaaaagccaatcctgccaagcgatatggaactgcgcgacaaccatcgttcacacagtgccaaactgcggattattgaaaaaactaagtagaaatcagtaaggaacgtgttttatatggcctcaaatgcggcaagaaaattaaatcaaccaacgcctcaattgacgccgcaccctaatcagccgacgccacaagtaaagtctcatcagcatcgcttgccgttttcgccgtttgaaaagattttgatgatctttggcgctctcattgcattttcgatgatgatcatggtcgtaactactcagctgtcagtcgttaagcagcagcaccgtctgcagaatctgcaaacgcaggtagccaatgttaaacagcaaaatgtcagcgatcagcaggaagttactacgctgaccagtcaagcgcgattggagcagattgcgcagaaatatggcctcacggatgcgaattcaagcgtaaggaacgttaataagtaatgaaaaaccaacaacaacgaacgattggaaagaatcaaaaaaatcgcaaaatgttcggtatcgcattattcctaacatttttctgtatttttgttctgtttgtcgttcgtttttttgtcattgcaacgactaaggatgtccaaaatcgaaatttacagacgatggccagtcgaatgtacacctcgaaacgaattattgaggccaaaagaggtacgatctatgacgcgcagggcaatgcactggctcaggataccaaaacctataccgtaacagcggtcttgagtcatcaaagtctgactgccaagggaaagcctaattacgtaaccaataagaaaaaagcagctaaggtcttggctaagtatctggatatcacggaaaaaaaggccttgtcgatcatgtcgccaaagcgcaagaacgtttaccaggttgagttcggtacggctggcagcggtatttcagtcagcacgatgaaaaaaattaaagctcaaaaggttacgggactgcagtttaatgcaacaccggcgcgtcaatatccggctggtgactttgccagtcagttgattggtctggctactgccaagaccaatgacaagactggtcagaccaagttggttgggcgactgggattggaaagctatttcaataagaacctgaccggtatcaacggcctaaaggaaatcaagcaggacgtctatggctatcagctggctgacagtcaggtaaagggccgccccgccaaagatggtgccgacgtctatacgactttggacaatcgaacgcagcagcagcttgagactttaattaccaaagctgaaaaagaaacacaggccagttcgatgactgccgtggttatggaggccaagaccggcaagatcctggcagcaacgcagcggcctaatgtcaattcatcaaccccggtctggcgcaatgccttggtacaagatacctatgagccgggatcaacgatgaaggttttagcactggcggcggcgattgattctggcaactttaaccccgaggccgtgtacaagtcggggacctgggagcttggcggcggtaagatcactgactggaatacggctggctggggcaatattacatataaggaaggattttatcgttccagtaacgttgcctttgcccacatcgaacaggacatgggatcagctacctggaaaaagtacatccaaaagttcggcctgcttaaaaatgtcggcatctacggcatgagcggcgagtccaaaggctatactagctataaggggacgctggaacaggccaacacggcatttggtcaagggattaccgtcaacgtaatgcagatgatgcaggctttttcagctattgccaataatggcacaatggtcaagccctacttcataaaaaaaatcgtagccagtgacggaaagacgcttgaaaaaaccaaaccgcaaacaatcggccatccagtcagtcaggcaacggcaaaaaaggtgctccattatatgcaaggtgtcatctataacaagaatgggactggtcaagtatataagatcagcggctatcggattgctgggaagactgggactgctcagatcggcagctcgcatggttatgaaaccgggagcaccaactatctgtactcttttgtcgggatggcaccagctaaaaatccaaaatacgttgtctatattacgatgaaacagccgcagcacattaccaaagccgccgagcagtacatggccgaggtagtcaatccagtcactaagcagcttttggaccgggcaacggctaaggattctaagcaccaaggtgtcgtcaagctgccaaacgttgtaggaatgagtgcggctgatgcgcaaaaaaagctgcagaacaagaaactgaacgtggttgttttaggaaatggcaaaaaagtcaaaaagcagtcggccgctaaaggcagcagcgtgattatcaatgagcgcgtctttctgctgacgggcgggcaggttacgatgccggatatttctggctggtcacaggccgatgtcagccgttttgctcagttgctggggcttaaattaaaatcgactggtggtggctatgccgtttcacaaagcatcaaggccaatacggtccttaaagagggagatgccttgcaggtccgctacaaggcaaaataaaatcatatgagaattgattctaggaggatattatgagtatattagttgtcattttgacgctgctcagctcgtttttgattacgttcttgctgatgccgtctttgattcgctatttccgggccaaaaaagaaggacagcagattcgggaagaaggtccgacctggcatgctaaaaaagccgggacgccgacaatgggcgggcttttgtttatcattgccgctttggtaacctgcttgtgggttgcagtctggcaaggagtcttaaccaatacgatgtgggctttgctgtttgttttggtggtttatggattgattggcatgtgggatgactcgatcaaaatctttaatcatcaaaatgagggctttaagccatggcaaaaagcactttgccaaattgttgctgccatgatctttacggtaatctatcagcatgaaggctttcaaatgggttttggcagctcacagatcggttggttttatggcttgtttattattttctggatggttggcttctccaatgccgtaaacctgactgatggcttggatggcttggtaactggctgcggtatcgtatcctttttagcttacctgttcttggcagttatgcagcgtcaatatgaggttgctttgttctgtctggcaatggtgggggctttggccggctttttcccttgtaatcacaaaccggctaaaatcttcatgggtgacatgggttctttggcaatcggaggatcgttggctgccgttgcgctgcttcttcatcatgaatggtcgcttttgtttattggaatcatctatgttgccgagaccttgagcgtgattctgcaggtagcagcctttaagacaaccggtcatcgaatctttccgatgacgccgattcaccacagttttgaaatgaagggctggagtgaatggaagattgatatcgtcttttggagcgttacgctgctgttttcgatcctgacgattggtacgatcatgctgtttgaatagtcagctggtttttaacgataactttaaatataaatcagtataagtggtctatgattatttttatgattaaagaccaggtaaaataatttttgcttttataattgatgaaaatacgaggtgaattttcgtgcgacaagtaacgaagtatcaaggcaaaaaggcattagtattggggtttggcattagtggcattaacgctgcgcatctgttggtcaagctgggagcccaggtggtcgccaatgatcaaaagacgcctgaggatccggcggtcgtagctgatcttaaagcagacggcattgaggtaattacgggtgagaatcctttatggctggctgatgaggactttgatgtcgtcgttaaaaatcctggaatcccttatgatgttccgctggttcaaaaattcatggccccaaaaacgccaatcattactgaagctgaactggccagcgagatttttgcgggtcatctgattgcagttacgggcagcaatggaaagaccacgaccacgactttgattgaaaaaatggttgccaagagcaatccgcaccagaccgcctatgcaggcaatatcggcgtgtcattcagcaagactgctgaaaagatgggagccgatgatacgatcgtcgcggagctgtccagttttcagctgctgggcgcgccaacgattcatccccatattgccgttattaccaatatttttgccaatcacctcgactatcacaaaaatcgggaaaactatatcaatgccaagctcaacattacgcgcaaccaaaccaaggatgactacctgatcatcaactgggatcgtgatgaatggcaggcagttgcgcgacgctccaatgcaacgattattccgttctcccggcttaacaagagccatgagggagcctatgagcaagatggcatgatttattggcgggatgaagcaatcatggcagccaaggatattcgcctgattggaccgcaaaacgttgaaaatgcactggcagcaattgccgcggctaagctgagcggcgtttccaatgaggatatcgttgccgtattgacgactttttctggagtgcgtcatcgcctgcagtacgtaatggactatcaagggcggcgtttttacaatgattccaagtcgaccgatatcgaagccactgaagttgcactgcagggctttgagcagccggtaattctgcttgcaggtggcttggatcgtggctatacgtttgagcgtctggtaccatatttcaagaaacacgttaaggcaattatcgtctttggtgaatgcaagcagcagatgaaggatgcagctgagcaggctggcattgccaaaatcgttgaaaccgaaaatgccattacggcggttccagaagcttggaaacttagcgagcctggggacgtcatcctgctttcgccagccaatgccagctgggatcagttccctagctttgaagtacgcggcgacgaattcatcaaggcggttgaagaactgactggacaaaaggagcagaactaatgagaatcatcgtatccggtggcggtaccggtggccatatctatccagcattggcgttgattgagcgcctaaagcaagtggagccagatacccaggtcctttatgtcggtactgatcgcggtctggaaaacaaaatcgttccagcagcaggacttgaactaaaggttttgcatacgcagggctttaagcgttcattgtcgctggaaaactttaagacggcttatctgtttttaaaagccgttcatgatgccaaaaaaattattaaagaatttaagccggacgtggttttaggaacgggcggctatgtcagcggcgccgttttgtatgcggcagccaaactgcacgtaccaacggttatccatgaacaaaacagcgttgtcggtattacaaataaatttttgagccgttacgttgatgagattgccattgcctttgatgctgctagagatcagttcccagcagccaaggttacgatgtgcggcaatccacgtgcgcagcaggcagccgctaatgcgaattccgatttttcttggaccagctacggcttaagtgatgacaagccggttctgatgatctttgggggcagccaaggagcacctaagatcaatgccagtgtggttcaggccattcctgaattcagcaagcgcgattatcaggttgtttttgccacgggtcaaaagcgctatgatcaggttaaagaggcacttaaagacgttaaggttggatcaaacgtcaaggtcgttccttatattgaagatatgccgactaaaatgcctaaagttgcctgcctggtctcaagagccggtgcaaccacgattgctgagattacggcactgggcattccaacgattttgattccaagtccttacgtaacggccaaccaccaagtcaaaaatgctatggcgctggttaaaaacggtgccgcggccatgattaccgaagatcagcttgatggccgctcactgctggttcaagctgatcgtctaatggaagatcaggctgcccgtgatcagatggcacaggcctcaaaaaagatgggccgtccagatgcagctgatcgcttgattaagattctgcataaggcgattgccgatcaccaaaaataaagggggaaaaacatgaaaagcgacgaagaacgaaatcaagagcatcagcgatatgcacgacgtttggccaaattagaagcgcagagtgccgcggcttttgatcgtcgtcgtcgctatcaagaacagggcattggcagtcgtgtcatgggtatcaagcgtgcacagcgcgttgacaactcacggcgcgtactcagcatcttggttccttttttgatcattatgctgctggcctcgtatatcgtttctcctttaagcaagattaaaaaaatccaggtaactggcaatcaagatctgtcggctgctaaagttgaatcggcagcccagatcaaaaagggagccctgatctggcgagttttgtttcagcaaaaaaaacttgaacagacggctcaaaaagccaatccgcaggttaaaacgctcaaggttagtctaactggaccgcagtcgatcaaaatcaaggtcactgaatatccgattattggcgtaattgagcataatggggtcaatcagctgctgattggcaatggtcggctgactccagtcaagaatcgctcaatctctaattttgtccgctatgccggttttgagcatcatgaaaagatcatgcagcagacagcccgtcagattggcaggcttcccgccgcgatccggggtggcatctcagaagtaacctttgccccaacgacatcagatactaaacgtctgcgcatctatatgaatgatggcaacgagattttggttcgttctgacaatctgaatcaaaaaatgcgctattatccttcaattgcctctaaaatgaaggcaaacggcgtagttgatctgcaatatggggctttctcgtactcatatggcaccaaagacgagtaggttcgttgatcaagcgccaaataaacatggtttggaccttttttgtatcgtgttaagtgtggtaaaatttagtacagtttatggctacaatctgaatccgggttgaattttagaaaacaggagggttccaggcagatggaaaattcacaagtctacgtaggcttagatatcggaaccactttaattaaagtattggtatgcgaaaacgtaaaaggacaattaaaagtcgtaggcactggcgttcaaccatctgctgggctgaatcgtggcgtgatcgttgatattgacaaaacggcgcaggcaatttcaagagcggttgctgaggccgcggccaagtcgggcattgacatcaaaaaggtcgtcgttgctctgccagcaaactatctgcaaatgggtcacgttcatggtatgattacgatcgccagtcaaggccagtcgcgtgagatcgtcaatcaagacgtaatcgacgttgctcagtcaacgctgacgcagaatctgccgcctgaacgcgaaatcattgacctggttccacaagaattcacggtcgatggctttaagggaattaaagatccacggggaatggttggcgttcgcttggaattggcagctactctttatactggccccaagacgatcgttcacaacactaagaaggcagttgaacaagcggggctgcagattcaagatctggtcgtctcaccgattgccactggctttaaccttctcaacgatggcgagcaggactttggtacgctggtcgtcgacatgggtggcggtcagactacggccagcatcattcacgaccatcagctgaagtttgtctatgttgatcccgaaggcggtcaattagtaacgcgcgacatctcgacggtgttaaatacctcaatgcgcaatgctgagcgcctcaagcgagaccatggctatgccgacagtcgcatggctgatgaaaacgtgcagctggcagttgatgtcgttggtcaaaatcagccggtcgaatattctgaaaagtatctggcagaaatcatcgaggctcggattcggcagattttccaacgcatcagcaatcgtttaaaagaggtgcatgcgcctaatctgcctggtggcgtcattttgcttggcggcgtgacggccttgcctggtgtggttgagttggccaaagaatattttacgaccaatgtaaagacttttgttcctgaacagatgggagtccgtcatcctggctttgcactggcaattgctctgggaatgtatgaggatcacctaaacgatattgatcgtctgctgaagcaaaccgttcagcaaggtgccttgattatgagccctcatcaagccgagcagccgcgcaagctggaaacgactcgcagctactatcaagagtcatatcaaaaaccaatgcctgatgcctcgtcagaacctcagcaagcaaaagaagagccaatgacgccggaaaagcctgtcaaaaagcctaagagtaagggtggcattaagcgcttcttagagaacttctttgactaattagactaacttttaaagtgacggaggaaccaacgaatggacaatttaactaatgaaactgaccaaatgcaattagagggtgcgaagatcaaggttatcggtgtcggcggcggtggcggcaacgcagttaatcaaatgatcaatgataaagtgtccggcgttgattttatcgttgccaacactgacctgcaggcattggatgcctcacacgcccaaaccaagattcaattaggtcccaagctgaccaaaggactgggtgccggctctaatccggaagtcggctccaaggctgctcaagaaagcgagtctgaaatttcaaaagcccttgaaggtgctgacatggtattcgtaactgccggcatgggtggtggtaccgggactggtgctgctccagtcgttgctaagattgccaaggactctggtgcgctgacggttggtgtcgttacgcgtccatttacctttgaaggtcagcgccgtgccaaattggccagcgaaggacttgaaaaattaaagcaaaacgttgatacgctgatcgtcgttgccaataatcgactgttagaaatgattgacaagaagacgccgatgatggaagcctttaaagaggctgataacgttctgcgtcaaggtgtagaagggatttccgatctgattaccaatcctggctacatcaacctggactttgccgacattcgtcatacgatggaaaaccagggctctgctttgatgggaattggttcttcgacaggcgaaaaccgggctgccgaagccacgaagaaggccatttcctcaccactgcttgaagtatcgattgacggggctgaacatgtcctgatgaacattactggtggtaagaatctgtcgatgtttgaagcccaggaagcttccaacgtcatcagtcaggctgctaataccaatgttgatattgcctttgggatggccatggatgacacgcttggcgatgaggttcgcgtaacggttatcgctactggtatcgataaggccaaacagcagcgccaacaggcagccgctgctcggccagtaagcacgccagctgccagtgaaacgcacgctgcccgtgttgaaccagaggccaagccagtttctgaaagcacgcctgctgaacagcctgtagaagaacgtccagtcgaaaatcaacggagtgaacgagcagcttctcaggatccatttgctggctgggatgatccaaccgctggtactcatttaaccgatacgcgtgaacaaaacgatgagttcaatcacgttaaaaagccagaattcaatgtctttcatggggatgtagctgcatccgacgaacaagacgatgataatctgacgatgccaccattcttcaagaaccgtcgtcatgattaattagtgatttgggggagctgaataaaggcgctcccttttgctgtatcttcagctcagaattaaaggaggagcaaaaatggctaattttttaaataacttttttggaatcggctctgaatcagaaactgaagattacgagccgcagccggtcgcaccagcagctcccgtaacgccagccatcagcaaaaaggtggtcccgattgatcgagcacagcatgctgcggctaagccagcaccggttgaaaatggcaagatcatgctgtttgagccgcggttgtatggcgaggccaaggaaatcgttgatgagctgctgagtcatcatgccgttatcgttaatttcactcagatggacaacaaagctgccaacaaggtcgtggactttttaaatggggccgtctatgcaattgatggtgaaattaagcggattggcgagcagatctttctatgcgtgccacgtgacgttgatgttgccggcaagctggccggtgatcttaattccaataacagtgaacgactttaaggagaaatatggttgcttatcttgcatggctgatcaataaaattattgatgcttacattttactgattgttgtctggtgtcttttaacctggtttccgggtgcaatgcagagccgtttaggtgaattgatcactaagctggttcagccgtatctgcgtttttttgacgaacacattccgccactgggagggatcagttttgcgccggtggtggccgtattcgtgctatatctggtacagtatggcattattatgctgaccagaatgataggctattaggagcagaaaaatgacggatgaagaaaacattaagcagcattttcgtcctgatgaagcgcctttgattgctcaggttgaggattggctgaatatggccgctgatcaataccggccgattttgactgattttttgaatccgcgccaggtctatatcgctcaaacgctgaccaatcaacgtgatgatgttaaaatgcgggccaatggcggctgggagcatgctgagatgcagcggatcttgttttatcccagctattatgagccgcagcagactgactttgagctgcagctgattgaaatcgactacccaaccaaattcaccgagctgcatcatcggcagatcttgggaacactgattggcactggcttggtgcgttcatcatttggtgacgtgctcaacgagggaatgcgctggcaaatagtagtcagccgcagtctaaccgactatctgcggcagcaggttggtcagattggcaagatccacgttaaaatgaagccggttgaaccagaaatgatcgtgacgccccaagaagattgggaaaccatgactgatacggtttcatcaatgcgcttggatgctgtgattgcagccggctttaactattcacgcaaccgtgccaagcagctgattgaacatggtgatgcgcgggtaaactgggagactgagatgcgtcccgattatctgctggttgctcatgatctgctttcagtacggcatgcaggtcgaattcggattgatgagatccaaggaactacaagaaaaaataagattcgcgtcgccatgtcagtggtgcatgcttagtttggaggaaaagcaaatgacgttaaccgttgaagaaatcagcaaaaagcagtttgacaacaaaatgcggggctataatcccagcgaggtcaatgaatttctgcgtcaagtggccagtgagtttcaggcactgcaggctaagaatcatgaattaacggaaactatcaaggccaatgaagaaaaactaaaatacttcacggacttgaaggattctttgaacaagtcgattctggtcgcgcaagaagcagccgacaaggttaagaacaatgccaaacgcgaagccgaaatcatgattcgcgaggcgcaaaaacaggcaaccgatattgtttcagaggccaatgccaaggcaaatcaagttgttgaaaacagtgccgatgaaacgcggaaactgactacggaaaccaatgatcttaaaaaacagacacggattttcagacagcgactgcaggtaatgctggaatcacagctggaagtcgttaagagcaaggattgggatgagctgttggctaatgacgatctgagcaaatatgacgaaattcaaaagattttgggaagcagtcttgacaatcattcgacaaacagtgtagaatcacaagcaatcgatcaaccagttgctgaaaagtcgcaggaaagtcaagcaccaaagcaggatcaaaaagctgcggccaagcctgctgctaaaaatgatggcgagacggtcgttgtctttcctgacagttcggcacactagttgataattaatcgcgaacaaactgttgaggagaatcacgcccccagcgtcgtatttcagcgagccaacgaatggtgagaggttggcaattaaggcctgggcagctatcatctctgaacgtcaatgcgaactcagtagcattggccggctcattgccgttaccaaatgacttaaggaatcagacaactgatttgaacttgggtggtaccacgaaaacgcttcgtcccattgcggatggagcgttttgtcgtttggacgcgatttttaagtttagagaattgacaaggaggaattcgcagatgcgggtcaaagacactttgaacatcggcaagactaagttccctatgcgtggacgcttgccggaaaccgaagcacaacgcgaaaagctgtgggaagacaacaaagtctacgaacagcggcaaaaattgaatcagggcaagccaacttttattcttcacgatggtcctccatatgctaacgggaacatccacattggccatgccatgaacaagatctccaaagactttatcgttcgctacaagtcgatggctggttttcgggcaccatatgtaccaggctgggatacgcacggtctgccgattgagcatcagctgaccaagatgggctatgatcgcaagaagatgagcacgactgaatttcggaatctgtgccgcaagtttgccttggaacaggtcgacaagcagcggactgactttaagcggctgggagtttctggcgaatgggacaacccatacctgacgctggctaaggagtttgaagcacaacagatcaaagtctttggtgcttttgccaagaagggtctgctatatcaagctaaaaagccagtctactggtcatggtcatctgaatctgcattggcagaagccgaagttgaatatcatgacgttgtagccaagacggcctacttctgtgaacaggttattgatggcaagggacgtttggacaatgatacgtacctggttggctggacgactactccttggacgattccagcttctgaagccgttgccgtgaaccctaagattatctatgccgtagttaagccggctaatgatgatcgtaagtttgtaattgccgatgagctggttgccaaatgtgctgaaaagttcggctgggatgaatatgaagtcgttgatcggctgtctggtcaagacatggatcgcatgaccagcaagcacccatacaacgacaaggaaatgctggtcgttaatggtgatcacgtcacgcttgaagcagggacggggttggttcataccgcgcctggctatggtgatgatgactaccaagtcggcaagaagtatggtctgccgatctttgcaccaatgaacgatcaaggtgtcttgactgctgaaaacggtcctgagtttgatggcgtcttctatcaggatgcagacgacatttcgttggatcttttgaaaaagcatcatgcactcttaaagcaggaaccgctggaacacagctatccatttgactggcggactaaaaagccaatcgtctttcgggctaccgatcaatggttcgtctcaattgacaagatgcgcgatgaaatcttgaatgctgttgatgaagttaagtactacccaagctggggtaaggttcggctgcacaacatgctcaaggatcgcggcgactgggtcatctcgcgtcaacgggtctggggcgtaccattgccaatcttctacgctgaagacggcacgccaatcatgactgaggaaacgatcaaccatgtttccgacctgttccgtgagtatggctccaacgtttggtttgaacgcgatgccaaggacctgttgccagaaggatttaccagtgaacattcgccacatggtcagtttaagaaagaaaccgacatcatggacgtttggttcgactctggctccagtcaccaaggcgtattggcagagcgtgactacctgacctacccatgtgacatgtatctggaaggttctgaccaataccgtggctggttcaactccagcctgatctgcagcgtcgtgctctctggtcatgcgccatacaagtccattgtttcgcaaggctttacgctggacaaggacggcaagaagatgtccaagtcgatcggtaacgttattgatccaaacaaggtcgttaagcagatgggggccgaaattatccgtctttgggtaatgagtgccgatacttcagctgatgtgcgggtttcgatggatacgttcaagcaaatttcggatgcctaccggaagctgcgtaataccttccgcttccttttggccaacacggctgactttgatgccaatgatgacacggtttcttatgaaaagctggaaagtgttgaccaatacatggtcgttaagctgaaccgcttcttaaaggaaatgcgcgatctgtttgatgagtatgacttcatgacggcttacaagaagctgatcaactttgtgaacaatgatctgtcggcattctacatgaacgtagccaaggacgtcttgtacgtcgaagccaaggattctcatgcgcgtcgttcaatgcagacggtcttttatgacatcttggtaacgctggttaagctgctgacgccaattctgccgcacacgaccgaagaagtctgggaatacatggatgagccagaacagttcgtccagctgactgaaattccagagccacggacctacgccaatgaagaagaactgctgaacaagtgggacggctttatggagattcgctctcatgttttgaaggccttggaagaagcgcgtgatgccaagctgattggtaagtcgctggaagcacaggctgatctgtacttaaccgacagtcaaaagacgcttttggacagcatgaacgctgatgccgggctgctgtttggcgtatcggcactgcacgttcatgatgctgaccaagcaccagctgatgccgagaagttcaacgacaacgttgccgtaaaggtttccgtcgctgctggcgaaacctgccaacgctgccggatggtcaaagaagatgttggcgaggatgctgtttacccaatgctttgtgcgcgctgtgcaaagctggtacgggaaaacttccccgaaacggttgctactggcctagaaaagtaatcttaaacgaacctttattgaccggttaaagacaaggtttaataaacggtgtaaaatgtatcaagcagcatttaactgtttgatgcatttttattttgcagtgaaatggcaggtgaaaaaattgctaaaaggacgcgtaaaaaattttgatgcccaaaaaggctggggctttattgaagttgaaaacgagccagatgtctttgttcactttaatggcattgaaggcagcggccatcgtgagctaaagcccggacagctggtctccttagtcgtcgtacagggaagaaaagggccgcaagctgctcatgttcgaccattggataatttttagaaatgagggacgacaatggatctagaagaaaaaacgattgatcgacagacggtcttcaaaggccatgtagtcgacgttgagcttcagcacgtcaaaacaccgcagggaaatactgctgtgcgtgagatcgtgcgtcatgccccggcaattgctttgttggtaattgatgatgatcagaagatgattttggaaaaacagtggcgagccccagtgcagaatattacatgggaaattccggccggcaagctggatgaacgcgatcacggcgatgcaagacacgcggccgttcgtgagctgaacgaagaaacgcgccttaaagctgatagattgaccaagattacgtctttttacagttctgtaggcttttgcgatgaattcttgacgctttatctggctaaaggcctcaaaccggttgaacgtgccctgccacaagaccaagatgaagacatcaagctctaccgcttcagccttgaggaggctctgcagatgattgccaatggtgagattcaagactccaagacgatcgtagcggtttattattggcaggcgcagacattggcccaaaaattaaaggaaaataatgaaaaatcagcagattgatccagaaaaaatgacgcgccagcagtatcgtgaatggcaaaaacagcagcagcaaattcaggaaaatcctgaaccaccgtttgatgatgtcagtgagccaacaccgctgcaaccgcgccaaacggtaaaaaaggctcaagcacagcagctggctgaagaaaagactgctcgtttaaagcgccggctgaattgggcaattctagggcttagtctggcgattatcgtcgtctatctaattttgttttttgtaggttgatggaaggaagatcttaatgaagtttggaattatttgtgcgatgcaagaggagattaaggaactaaaggcagctctaaaaaataatcggaccaagacgctgggcgataaagagtactttgccggtcaaattgatggtcaagacgtcgtactggttgaatctgggatcggcaaggttgaggctgcgattactgctgagcatttggcagtggactttgccgttgacgtcattatcaattctggttcagctggcgggattggcgaaggcctgcatgttggcgatgtggtggtttcttcagagacggcctatcatgatgttgacgcgactgcttttggctatgaatacggccagctgccgcaaaaaacgcctcgtttcaaagcctcacagcaatggggcagtgccttgatgacggcgggtgaaaagactggcttgaacgtcaagcgcggcttgatcgtttcgggtgatcaatttgttgccagtcaggctgcgattgccaagatcaagcagcacttcccagatgctctgtccgctgaaatggagggcgctgctgtgggacaggtagcctgtgatcacaagcttccttacgttgttgtgcgggcaatgtctgatactggtgatgaaaaggccaatgtctcatttgatgagtttatcatcgaagccggtaagcgctcagctaagatgcttttgcagctgtttagcgatctaaacgctcaggagggataagatgtctgaattcgtttctaaactaaagcttcccggcgatactgacacatattcaatcagcccggagataaaaaagtatacgctgcttgatctaggatttgaacagtcggcgcggggcgtctatacctacttaggcagcctggatcggcaaaatccattcaaaccagttgctcgtttgaagattcgtatcaatccggaaatgacgggttttaaaatggaaaccgtcaataccaacggctttcgtgaagtcaatatttttaagcatccgcgtgctgatgaattgacgactcagtatcacttcatcttgaatgaaatggtcgagcggcatatctttgatcgtcaataatggtttttactggtcaaaccgggcgtgtctttgttacaatgaaaagcactgtgaacacgcgaccttcactcgtagattgttccagaatctattgaaaatgatggtgataaaatgacagacaactctaagactcgcgttgtcgttggcatgagcggcggcgttgactcctcagtcacggcgcttttgctgaaacggcagggctatgatgtcgtgggcgtctttatgaagaattgggatgacactgatgaaaacggcgtctgtactgcaactgaggactataaggacgtcgctaaggttgccacgcagattggtattccatattattcagtaaactttgaaaaggaatactgggaccgggtttttaagtacttcattgcagaatacaagaagggccgcacgcctaatcctgacgttatctgcaacaaagagatcaaattcaaggcttttattgaatatgctcatcagctgggtgccgagtacgttgcaaccggtcactatgctgatttgaaagcagatgcagatggcaatatgcacttgatgcgggcagctgatccgcataaagatcagacctatttcttgagtcagctggatcatgctcagctggatcatgttttgttcccactggctggctacaccaaaaagcaggtgcgcgagattgccaaggaagcaggactggcggttgctgataagaaagactcggtaggaatctgctttatcggagaagatggtcatttccgtgaattcttgagccagtatctgccagcccagcccggcaacatggaaaccgttgatggcaaggtagttggtcagcatgccggtctgatgtactacacgattggtcagcgacgtggtttgggccttggcggcaataaggaaagcaatgagccttggtttgtaatcggcaaggatattaccaaaaacgtgctttatgttggtcaaggctatgaaaatgagcatctgtatgctactcatctggaagccagcgacattcactgggttgatgacgtggtcagtcgctatggccgccatttccactgtacggccaagttccgctatcgtcagatcgatgagggcgttacggtaacaatcagtgatgacgatcagatggtaacggtcgagtttgatgaaccggcacgggcaattacgccaggccaggccgtagttttctatgacggtcaggaatgcttgggcagtgcaattatcgatcgtgcctacaatcatgatcatcaacttcaatacgtataatcaagaccgtctttgacagagccgcttgcagttacccgcgagcggttttttgctatcattgagtactttaatgatatctttatttatatttataatgataaatattggttatctcccagttatttttggtatcatataagcagacacatcaaaaaaggcagatatttggaagagaaaaatgacaaggatctattttatcagacatggtaagactcagtggaacctccaatcgcgctatcagggtgcccatggcgattcaccgctcttgaaaagcagttatcaagaaattgagttgttagcgaaatcattaaataacaccgcttttgctcatgtttatgctagtccgcttaaacgagcccgcgttacggcaatgacgctgcttgacaatctggagcagacggtgccgtttacgattgacagtcggctgcgtgaatttgatctgggactgatggaaggaatgcatttcagcgccgttgctgaaaagtggcccgcggttttggacagttttcgacatcatcctgatcgctatgatgcctcgatcgtgcaaagcgagagttttcctgaggtgattgctcgggttggtcaggccgttaaagagtacgcacgctgctattccggcaatcaaaatctattgatcgtttcccatggggccgctttaaatgccgccattaatggcctgcttgcagttccaatggcccatctaaaggatcgtggcggacttagcaatacatcgactacgattttgagaaccgatgatgctgagcattttgaattggaaaaatggaacgataccacttatctgcataaagaacatctagatccgactgatacgatttaatggggtgaataatatgagcaaccaagaaatcaatcgcgaagaacagaaaaaacagactcaaaagctggttcaccgcttggtaatggcaatcgatgaagaaccagacaaattcaacaattactatgacctgggtgcactcttgacgcgtcttaacgactttgagcaggcagaagagctgtttatgaaggctttgggcatctttgaaaagaaaaatgatgccaaagccgtcaacctgttaaactatggcttgggcaacgtctattactcagtcggcaagaccaatgaagcaatcaagcagtacaataaaatcgatgatgccaaactgaaggccgattcttatttgatgcttgcgcaaagctacatgaagcagaaaaactatcagcaggcggtggcatatggtttgacggctcatgatctgcgtccgcaagatcctgaaatcaatcaggcaattggggattcgttattggcactgggcgagtttaaacaggctaaaaactactatgacctgatcttaaagcgtcacccaggccgtgctgatacgcagttcaaccgaggactggtggcaatggtcttaggcgagccttaccaggattacctgaatcagtcacagcagcttgatccagactattatgcacaaagcgaaaaacgtatttcagatattgagcactttttgcaaaagcaatctggtcaagataaatgattgatgctcaaaaaaatagccgtccggcagcaacgtcatttatcggcgttctgcgtcgggcggcttttgttgcgccgaacagtttttatcaagtcttatacgtgcaggttttagaagcgccgtttgtcaagaagcaggctgagattaccgtggttggacgctttggtcagcttaaagtcggtcaggcctatcgcttcattggctactggcagacgcgcgcccgttttggcaatcagtttcgtgccgtcgactaccaggaagtaagggaggatttgcatggccaagagtaaaagcgcatcagctaaagagagtctgcgggggacggttaattttatcaagtttgctaaagaagaaggacccagagcttttcgtatctgcgtagttgatgtggaagaggccagttttccctggtcagaaatggagattacggtcaagggaccactgggagacattaaaaaacaccaaatgtacgaatttaccggtcggctggtcgacaatgccaattatggccggcaattcgaggctgcgggatgtcagattgccctaccgcagtcagaagatgagctgactgggaccttaaaccaggctgggattgcggttacggatgcggccgagatcagccaccgcttgtttaagaagtttggcaaaaaagcggtcgccaaaaccgttgatgatcctaagcgactggagaagatcaagatttctaatgaggctgatcgcaagctggctgctgattatttcaatgcccgccatgatgagcaccaaatgaatgatgaacttgtagaatggctggccaaactcggttttaaggatcgtctcagtgagcggatcattaataaatacggtgcggatacgatgaaggtcatcaaagagaatccctatcaactggttttggatattgatcgcatcggttttggtcgggcggactttgctgccggggtcttgggaattgcaccagatgatccgcggcgaattgcggcagccttattggaagtcttaaatcaagaaactatgaatcaaggtgctacctatgtcagtcaaaagacactgatcgcacgtgcaatgggtcagctgggcaacgtatccgatgcagcgctgtttgaaaacgagctggctgagctgattaaaacccatcaactgcaggctgaggatgccgaacatatctatccacgcttcttgtataattccgaatggctgattgctgagcatctgcatcgaattttgtttactgaagccaaagttgacgaaaaacgggttgatgaggccgtccagactgcagaaaaggcagcccggatcgattatgaccagcagcagaaaaaagcaatcaaaatggcgcttgaatccaaggtgcttttacttactggaggaccagggacagggaagacgaccattattcgggggatcgttaacagctttgctcagctgcatggtgttgatgatgaagaaatcattttagcggcgccaaccggtcgagctgcccagcaaatggcggctgcaaccaagatgccagccagcacgattcaccatctgttgggactgactggccaagaaacgccatctaaaatgacggctagccgtttgaaaggcagtctgctgatcgttgatgagatgtcaatggttgacacgttgctgtttaagactttagtcgccgcgattcctcaaacgatgcatatggttttggttggcgatcaggatcaattgccttcagttggtccaggacaggtttttcgggatcttttaagctttgcccaactgccgcaggttcgcttgacgcagattcatcgtcagtcagctaaatcaacgatcattccgctgtcaaaaagcatcaatgaaggccaggtaccagctgatttgtttaagcaggccttgccggatcgctcgtttattccaactgatgctcaaaatgctggccggtttatcaatcagctgatggattggggactaagccagccgggatgtgatctaatgaacgtgcaggtcttgatcccaatgcataagggaattgccggcattgaccagcaaaaccgcaatctacaggatcatttgaatcccgccagtccaaatcggcaggaggttaaatttggtgagacggtttttcgtaaaggcgataaggtaattcaaacagtcaacgacccaagcaacaacgtctataatggcgacatgggaatcattgccgcgattgaaggaggcgacaatgctccacagaccaaatcagcccaaaagccgcttaaggtaaccgtccgttttaacaatgacaacgaggttagctataatcgcaaagaactggccaatctacagctggcgtactgtgtaacgattcataaatcacaggggagtcagtttaaaatggtgatcctattgatgctggccaactaccgcttgatgtaccagcgtaatctgctgtatacgggagtcacacgggcgactgatttcctgttgctgcttggccagccagaagcttttcaggattgtattcagcagccggccctggctcggcacacgatgctgcctgatcgcttgctcaaggtttggcagcagccagacttttaccgagcacctgagccggtcagtgatggtgagggaatcaatctgtttgccaacgttcctaaagcagaagcaattgattttttaaagcatcatcaccaaaacaacgatcctcaggcccagtcgcagccagccgtacagttgcctgatcgtttgactgcacggctgattgaacaagagacgattgacccgatgattggaatgcaaaacgttacgcctaatgacgattaaatcagatacggcttgcacaacaagggatttgttgcgataatgttcttaatgtttaacataattgcgtggaggatttaaatgagcaagattgaaaatgcagaaaacgttcgtctgtttgcgctgaactccaatcagccactggcacggcgattgtctgaaaaattaggattgccgctgtcggatgctacgattacgcactttgcggatggcgaaatctcgattaccatcaatgaaagcgttcgtggtcgcgaagtatatgttttgcaatccgtttctcagccggttaacaccaatctgatggagcttttaatcatggtcgatgccttgcggcgggctagtgcggcaaaaatcaacgtgatcatgccttactatggctatgctcgtcaagatcgaaaagcccgcagtcgggaaccgatcacggccaagctgattgccaacctgttggagatggatcaaattgaccgcttgattgcgattgacttccatgcaccacaactgcaaggtttctttgatattccggttgatcacctgcaggctgcaccaattttggcttcctactttgcgcaaagtgatcttgacttggaaaatacggtcattgtagcgccggatcatgctggggttacgttggcacggcgttttgctgaatttttagggacgccgattgccattattgataatcgtaatcttgaacagcagcgcggcgccaaaactacggaaacgccaacctcaatcattggggacgttgccaataagacggccctggtagttgacgacatcgttgataccggcgtccgagttgccaactcagcagaactgctcaagagctgtggcgccaaagaagtctatggcgttgccacgcatgcagtcttatcaaaaggcgctgttgaacgaattcaaaactcggccgttaaaaacatggtggttaccgatacgatcgatctgccggcagaaaaacggatcgataagctggtgcggctgtcgattgctgatctattggccggcgccgttgcaagcattcataatcacgaatcgattcactatctctacaacatgccggaagttaagccggttgaagactaaactaaaaggattcagcgcttcaatgctgaatccttttagttatattaagtattgggcagcctaagccggtttagcctgcggacttggcgtggcgaaactttgtagaagtcgttttaactcgatgcgccgctgctgtttggagataaagagtcccattttttctttgtcgaagcccgtaatcaacttattctcactaaaaataatcgggttttttaagatatgcggacttttttgaatagctgcggttaattcgttgagcgtcatttgatcgggatcaatctttaaggccttggtttcacgagagcgctgagctaccaagtcgtcagtgccatttaaagaaatcgtcagcagctgctgaatctcggctgcgctcaatggttctttctcaatgttgcgctgcgtcaacgcgatatcatgcttggcaaaccattgaacggctttgcgcttggaaggatcattagtatgaaaatacagattaaccatttgaacgaaccaccttttatgtgctttaaaggacattttagcaagtttgacaataatataaagactaattgaccaattgttaaataaaatttatcaaatatgactttttttagaaagtcttaatctttttaaaaaggcttaacacagcatttagcaagcgattgactgattatcaccaataaagcgaacatggtgacgtcttcaaatatgcggtaaaaaatgttaaattaaaagagtataaattttttccgtggcgtcttgacgtcaatcgagtaaagctcaaagaggtgttaaattcatggttaaacggatcaaagctcagcgtcagcggcatggccggcaatggctgttggggacggtcagtgcattgagcctgctggcaacggctcatgccaaagctgatcaggttaccgttaaagatggtgatactgtttgggatctggcgaatcaataccaaaccagcgttaaagcaattgaagatgccaatcctcatgttaaaaaaatcaacagcagcgttgatctgatctatgccggccaacagctggaactgtcaaaaaacagtactgtcagtcaaacttcagctgttgatagtgactcttacacggtcaaaagtggcgacacgctgagtcagatcagtgaacggctgcatgtatcgcttgctgacctggtaagttggaatcatctgagcaatcctgatcagctggtgattggtcagcaactgatcgtcaaaggaacggcggctgccagtcaaacgccagcttcaatctcagcagctgaagcatcaaatactgctgtcagcgtaccagcaacgactaatgccagttccgtcagtcaagcggtcgttcagacagcaccggttgtctcagctgaatcgaccgcctcagatggtgcggattcaaacagtaatgcagtatcacaggcaagtcaggccgatgaaccagcagctgccccaagtcaagcggccacttctgcagtaacttcagcgcaggatttgaccagcagcactgaacaatcatctgcagcagcatcatcagagatgatatctgcagaatcgtcagctgctgatatggcttcggcagatacagtttccagttttgatgatcaatctgctgcaagctcaaccagtgaaacggtatccgttgagcagactactgcatccagcacggcaacgaccgcggcggcaatcagttcggcagatgcaatcagcgaaagcgcatcggctgaacaaccaatgcagtctacagtggcttcatcagttgccgaatcaaccagtcagcaagcagattcttcgaccagtctggcaaccgccgattcatcagcggcaagtactcagactgcgactactgactattccactgcggctgcttcatctagtacgtcagaacaggcaagtactaatagtacggttggtactgcagattctgctgtttcaaccagcagcagttcagatctgacgactggttcggtagtgagtctggcggttaagctggccaacgccaacattccatacgtatggggcggggcttcgctttccggaatggactgttctggtttggtcgattatgttttccaaaatgcggaaggaatctcgctgccacactatacggtatctttggaaagctgcgccagtcagcattcagttgctgaagctcagccaggtgatatcttattctggggcaatcatggcagtacctatcattgtgccatctacatcggcaacaatcagtacgtagcggcaccacagcctgggcaaaacgttgagattgagacgatcagtccttactttatgccaagctttgcggggacggtaatccactgatccataaataactgatccataaataaaagagcagccggcttgatctgcgggctgcttttctaattgcgtcgaacaagcaattgttttgaaagtacaaaatactaaaagatttcttattgaaacgtaacaaacttgtaaaatgaaaaaggttaacattttttaaagagagtgttaaattatgtttatccaatccggatcagctttaaatattttcattattggaggttgtttaaagtgagcaacaagtttgaaattcaacatgatttagttgaagcccaaaacaagcttaaccggttatgtcaggcagaatctaaggctaatgccgctcaatccggtacgcaaacgataacgatcgaacctcaatttggggatgaaatgcagcgtctgcgcgaggaatgcagtcagctaagtattattcttgaggcgatggaagcttctgaggattaatcggcttaataaatataaaaacaaacgattatttcaagtccgcttgagtaatcgtttttcgtttctaactgtagaggatattaaaaacgtgcgagctgcggcgataatgcctgctgttcgcacgtttttaattaaactttttttcttttagcgaagtgccccaaaaacggatattgacaggtatccagcgtcagatccataaaacgactgcccatctcctcgccatcggtttgcgcaaattctagtgaggtcgtaacgtaatgcagtctggatgaacggaagcatttggcaaaacgagaatgattcagcctgccgcgtgcaaactgccgcagacaccaaaacgtaatcagccagttgcgtctttcaactactaaaagctctagagttgatgaatgcagggattcgtcaggagcaatcttaaaaccgccgccgatgtagggatggttgctggcaatcagaataaaagttttggggaaaaggtgatgatgaccgtttttttcttgcaccatcgtcgcaaagggctcttgattgtataaaacgcccaaagcctgcgacaaatacgataagttgcccagatgccaacgattcagccgctttttggctcttgatgcgttagcctgactgacaatggcggcatcaaagccaattccaaggttatttaaaaagtagccttcttcctgcttgatcgcatcataataatgaccaacgttgatccgtgtcgggtgctgagcgtccaatacctgttgcaaggcggtcattggatcttgcgacagaccatagtcgcgagcaaagtcattgccgctgccagccggaatataggccagcggtaatgacgagttcgccttaatcagcccattgagtgtttcgtgcaaggttccatcgccgccaaccaccattacgacatgcgtagccacagcagaagcaaaacgatgagcaattcgctcggccaaatcgacggcatgtccatgatagcgggtttcaacgacttgatacacgatattcagcttgtttagacggctctgcagctgctgccagatttttttagcacggccgctgcctgctaatggattaacaatgattgaatactccatgcaacgctccttaaaaataataaaaagccgagacagacttgccgtcccagccattaaagaccattcagcctaaaattcggtaatcttgaagtctggattctgcttttcgtatgccaaagacttttcatccagcagttcaatgaattcaatttgatattcggtcttagtttccacgagctgacgtgccgctgcttcagagtcggcttccaagtaaagcgacttggtgttttcacgtcgaggagtcatggttttatctggttgatagtaaactttaaaagtcattttttctctccttagatattggatctcgataaatcaccaatttattttatcacaactaacgagcggtgtcgccattcttaatgaaccatgtggtattcttaagataagaataataaaacggaggaatttaaaatgcgactgtttatcatgattctagtctcggcaattattgtcattgcaatctatctgctgattcaccggacgatgatcaaccgagcaaccctcatgctgcgcaaacaggctcaagcggcaaccgatgcggcgatggcttatgcattgaagcaaaatctgctgcagctgccatcgatgccggaatcacagctggtagccgatgtttggggaaaaggcgtgctggcatttgaatatacgctcaaagctaagaaagtaacggaactaaaagaaaaagacgttgaaatggcgctgaatgcctatgcgaaagaaaaacacttggatcatctgccaacagcagtcaaaacgtttgtcgtgacagattggtggacctacgaacaaatgctgcatattgacgtagcctatatttataatgaggccacgcgcgaatacgtaatggatctgcgcaaattgaatcagaacaattgatatcgcttgtcagacgtcactgaggcaacataaaaagcccaagcgcacgaaaagcggtgtgctcagacttcttgaataggctaagcctagtcgaatagaatcgtatctttaggtgcctcaaaaggatgttccttattgatgtgatcatagaacaagaccccatgcagatgatcgatttcatgttggcagacaatggctggataatgcttgagccggatcttgtgcgtttcaccggtcgtgtcttggtatttcaaggtaatccgatcatgacgcggtacatagccgggaacgtcacgatcaaccgagagacagccttcgccttcagttaaagcgccatattgaaccgattcgctaatgattactggattgataataacgtctttaaaaaccggcttgtcatctggctcttcaccaggaaccaggacagcggccatctgtttggattcgccgacttgcggagccgccagcccgacgccggcccgcagcttatatttttcacacagttcaggatcttgactgaccaccaggtattccatcaagtccttggccaatttctggtcatcttcagaaagagggaactcgactttggccgcccgcttgcgcagaacggggtcgggatcacgaacaatgtctttcattaaaaacatacttggtttcgcctccatattaaacattcaaagaatagtctatcataaaaactcaaaaaaaagcggacagaagcctgtcaatttgataatgaaggcatatactagatgagataagcagaataccgtaaaaaggaagtgaagacagtgcacgataaaaattattcctatccactggatcctggctggagtacagctgagattgaaaccgtgattgcaatgtttcgagttgtggaagatgcttacgaaacaggcatcaatcgtcagcagatcatggactgttatcgagattttaagaacgtggtaccagctaaaagcgaggaaaaaaggctgggtaaagaatttgccaaggtgacggggggctatcagctctatgatgtcatcaaagccgctcgtgagcaaaaagcaggacaaatcaagctaagcgtaaaataacattagaggtgtaggaatgctcgaacaaattgatcagcaggcgcagcggttgatgtgggaagtccgtcagcaaacgctgcagctgatgaccaaaaaatttaacgttgctgaaaaaaacagtgccagggatctggtgacgactgttgataagcagaatgaaaaaatgattgatgaacggctcaaaacaattgatcctgcctgtcgaatcgtcagtgaggaaggctttggcgatcaggttgatgatttaaaggggcatgtttggattgtcgatccgattgatggcacgatgaattttgttatgcaaaagcgtaattttgcgattatgatgggactatacgttgatggtcagccaaccttgggctatatcatggatgttgtcgagggaacgctctatcatggcggcaaaggcatgggagtatttgccaaccagcagcggctgcatacacccgaaaataaatcactggccgatagtctgatggtaatgaatgggtatttgaccatgaataacgttcatggactgcaaaaagccgctcgcaaagcgcgtggtctgagaatgtatggcagtgccggcattgaaatgatctatgtgctgaccggatgcttaggtgcatacgtttcgcacctgcatccatgggatttggcggctggccgcgtcttggccgaagaactgggattagttgtgaaaccaattgacgatgatcatctcaatgtgttatcatctaaccttgtattagtagcgacgaagcaagccggtcaagatcttttgaccatcgctgaatagcccaagactgtgacagtggtcacagtttttttatgacaaggccgctgccccacaaaatttagaatattgattagacgaaaggaagataacttttgaaaacacgtgatgatattcgcaacattgcgatcattgcccacgtcgaccatggtaagactactctggtcaatgaaatgttgaagcagtctgacactttgccagaacacttcgaaattcaggatcgggccatggataccaacgccattgaacgtgaacgtggtatcaccatcctctccaagaacacggccgttaagtacggtaagtaccagatcaacattttggataccccaggccacgccgacttcggtggtgaagttgaacgggttatgaaaatggttgatggcgtgctgctggttgtcgatgcctttgaaggtacgatgccacagacgcggttcgtgctgcaaaaagctctggaacaacacctgacgccaatcgtggttatcaacaaggttgaccgtaaaggcgcgcgtccagaagaagttgttgatgaagtattggatctgttcattgaattgggtgccgatgaagatcagctggacttcccagttatctacacttcagctatgaacggtacttccagctacgactctgatgtctcaacgcaggaacacacgatgaagccattgtttgacacgatcgtcaagacgattccagcgccaatcgacaactccgatgaaccactgcagttccaagttgccattttggactacaacgactttgttggccgaattgggattggtcggattttccgtggcaagatcaaggtcggcgacaatgtttctgttatgaagctggatggctccaagaagaacttccgggttaccaagctgtttggtttctttggtctgaagcgtgaagaaattcaagaagccaaggcgggtgacttgattgccatttctgggatggaagacatcaacgttggtgaaacgattacggattctgaacatcctgaagccttgaagccattgcggatcgatccgcctacgctgcaaatgactttccggaccaatgactcaccatttgctggtcgggaaggtaagttcgttacgtctcgtcaactggaaaaccgtctgaacgctgaactgcacacggatgtttcactgcgggttgatccaactgacgaaccaggtgcctggacggtttctggtcgtggtgagctgcacctgtcaatcctgatcgaaacgatgcgtcgggaaggctacgagctgcaggtttctcgtccacaggttatctaccgtgaaatcgatggtacgacctgcgagccatttgaagaagtccaagtagacgttcctgatgaatacactggtggcatcattgactcactcgcaaagcgtaagggtgaaatgaagaacatggaaccttccaagaacggtcaaacgcggatgatctttgaagttccttcccgtggtctgattggctactcgactgaattcatgtcacagactcgtggttatgggatcatgagccactccttcaaggaataccgtccagttatcaagaactggaacccaggccggactaagggaacgctggtatcaatgaatgctggcaaggctacgacttatgcaatgatggggatcgaatcgcgtggtacgcttttgatcgacccaggtacggaagtctacgaaggtatgatcgttggtgaaaataaccgtgaaaacgacattactgttaacatcaccaagggtaagaacctgaccaacgtgcgggctgctggttctgatgaaatggcgcggatcaagacgccaacgcacctttcactggaagaatcactggaattcttgaacgatgatgaatactgtgaaattactcctgaaaacgtgcgcctgcgtaagcagattctgaacacgaatgctcgtgaaaaggaagccaagcgtcgtcgggcagcttcacgcaagtagtcagtgcttgatgcatatattaaaatccgataaagactcatcattcggcctagtgaccggatgatgagtcttttttaaatgctgttcagttttcagccggcctgtgatttgccgcatgtttgcatgaatagtggtgtataatgttacttgattttatcaaaaagcgaggaatggctagttgaagacgacgttaaaaaaaatctatcgaaaaatgcgcaacatcgactattggattttgattccgtatttggtgctgtgtctaatcggcgtagtcatggtttattcggccagtgccgcaatcagaatgcagacgggcgggtcgccggttggctatctgatcaagcagatcgtgtttgtcttgatgggctggggagtatttggattttttgcttcactcaatctagataagctaagaactaaaggcgttttaggattgtcttttggggttttgcttttggcgctgctttttgttaagtttgccggtcgtgccgttaatggtgccaatggctggatcaatctggggccgatcagcattcagccggccgagttcaccaagctttttatgattgtctattgggccgatcgctgtaccaaagtcaatgacgagctgcatcgtcccagtatgcaggattatgtttcaggattgattttgactgcaattttgctgattttaatcattattcagcctgacgtcggtggtttttcaatcaactttgccgttgctgccgtgatgatcatggcatcgggctataattcacgctggacgattctgatttttgacggtctgcttttgattggaataattgccttgcccagcttggctaaggttgtggcaactggtcatatcaaaaactatcaggtcgcgcgattcgtagcgtttgtcaatccgtttgggacccagagcggtgccggcagtcagctggttaattcatactatgcaatcagcaatggtgggctaaaaggtgttggtctgggcaatggtgttcaaaaaatgggctatctgccagagcccaataccgattttatcctatcagttgtcagcgaggagcttggctttattggtgtatttttgatcctggcgcttttggcggtcatcatctgccagatcattcggattggggtccgctctgacaatatgtatgagggactgctctgctatggagtgggtacttttattgccgttgaagctgcaattaacgttggtggggttactggtctgctgccgattacgggggtaacgtttccatttatcagttatgggggatccagtatgcttgcgttaagcattgcgcttggtttggcgatgaatgtcagcattcggcaaaagctgcggcgtaaaaaccagcggcgcctacaggcaattagacaaagggggatcgggtaatgagctttaagattcgtccccggcgcggcttgattgtctacctgaacagcatgaagacggtcaagtcgctgcggcggtatggtcatgttcaatattcatcgcgccggatgcattacgtggttttgtacgttgatgaagaaaatattgccaatacaattgaaaaattgcggcagctgcgtaatgtcagaaaagtaatgcagtcacactggccggaaattgatcctgaattgaccgatctggaagtgacgggactgtacaaaaaacatgatgaggatgaaaaagaatgagaattatttcaggcgagtttcgtggacggcgcttgaatgccgtacctggaatggcaacgcgaccaacgactgataaggtcaaagagtcgctgtttaatattatcggcccctattttgaaggcgggaccagtatagatctatatggcggcagcggtgggctgagtattgaagccgtttcgcggggaatcgatcatgcgaccttgattgatcggcagtatgcagccatcaaaaccatcaaaaaaaatattgaggttaccaagcaccctgagcgtttcagtgtttataaacaggatgccgaaaaagccctgcattttttgagtcggcaaacacagcattttgatttggtctttttggatccgccatatgccaagcagcatattattgatgatctggaaaaaatggttgacttgaatctattgaacgatcaagctttaatcgtagctgagaccaatcaagaagctcagctgccgactgagaattggggcagctttgagtttttgcgacagcagacttatggtattacggtattgacgatttatcgttttagaaaggatgaagcctaatgaagattgcactttttcccgggtcatttgatccactgactctgggccacttagatcttattcgtcgcggcagcgcgctgtttgatcagctggcggttgcagtaatgagcaatgattccaaaaagccgctgtttacggttgaggaacgcgttgcccaggttaaagaagcagtagccggactttccaatgtttcggtaatcacggctgagggcttgaccgttgatctgatgaacaagattggcgccgactatttgatgcgtggactgcgtaacgttactgattttcaatacgaacgcgatattgcagcgatgaatcagtttttagacgatcaagcagaaacgattttctttttagctgatcctaaatatcagcatctctccagcagccttttaaaggagaccgccgcagctggtggcgatatttctgcttatttgccaggcaatatcaataaggctttggagaaacggctgcgggaacaaaaactggagcaggtaaaagaacaaaatgagcagacaagataagcagattctcaagcggattgcgggggttctggccgcggttttgtttgttggctggtttttattctggccactgaactattatattgagacgccggggaccgccgataatctaaaatcatatgtaacggttaaggggcatccagataagcacaagggaagctatatgattacctccgtctacttgcagcaggcccgtcccgcaacctatatctgggcccattttgatccgcaggcaacgattgagaaggcttctgatgttacgggcggtcaaagcggtgccacttataacaaagtacaaaatttttatatgaagagtgccatcaatgaggcgattgccgttgcctacaaggctgctcatcaggaatacaccaagcagtatctagggatttacgttctcgaggttgaaaagcaatccaaattcaaaaatgatctaaaggttggcgacacgatcaccgaggttgacggcaggcattttgatactgctcaaggctatcaaaaatacattgccaatcagaaagtaggtcaagaccttacgattacctacctgcacaacggcaaaaagcatcagacaacgcacaagctgatcaagataatgggcgatcgtgccggcattggaattttactgactgacaacgtcaagattcataccaagattcccgtgaaggttgatccaggacaattgggcggaccatccggcggcttgatgttcagtctgcagatctatcagcaggtatctggcgagaatctacggcatggccgcaaaatcgctgggacgggaacgattgccccagatggatcggttggtgagattggcggcatcgataagaaggtcattaccgctcataaagccggcgcgacgattttcttcgctccttacgtcaagccaaccaaaacaatccttaaatatgaagaaggccatcagaccaactaccaattggctaaaaagacggccaaaaagtatgcgccggggatgaaggtcgtaccggtcaagagcttcaatgacgctgttgagtatctgagaactcatcaataaagaaataatgtgaaagtcggaaattttaagaattttcggcttttttaatgcaaataagtctttttggcataaagcatattgagggggtgaaaaaatgcagtggcaagaattttgggagctgcaccgcaagacgattttgatcgttttaggtggggcggcactgctgatcggtggctggctgtattccagactgacgccagccaatccaacttttgccacggctgtcagcaccaagccggcagccgttgataaaagcaaggcagcgacaacgcctgccaaagtctgtgttgatgtaaaaggagcggtcaatcggccgggagtatacacgctgggaaaaaatgcccgggttcaagaagcaattgcagcagcgggaggcgtccataccgatgccgacatgcgccaggtcaacttggctaagcagctgcaggatcagcaggtagtctatgttccagctcaaggagaacagctgccaggcggtttgacgacagggatggcagctgatcaaactgggccgagtacttcgactgggggacaggatacgcccaagattaatcttaatcaggccagcaaggaagaattatgtcagattaacggaattggcgataaaaaagctgatatgatcatccagtatcggcagcagcatggaccatttaaaagcatcgatgagctgaaaaacgtcgatggctttggtgataagacggttgccaagctaaaagaccaagtggcggtttaaaattgacgttggtgttgagattgaatctggtatactggttagcagaacaaaaaagaggatgataaaagtggaacatagaattgattgggatcagtattttatgatgcaggcggccttactggcttcccgcagtacttgccagcgactgtcggttggagccgtcttggttcgtgacaagcggattattgctggtgggtacaatggctcggtttcaggcgatgatcattgtctggatgcgggctgctatttacgtgacggtcattgcgtgcggacgattcatgctgaaatgaatgcaattctgcaatgtgccaagtttggtgcctcaacggatggcgcgagcctttatgtcaccgatttcccttgcctgcagtgcactaagagtcttttacaggctggaatcaaagagatcaattatatccgcaattatcataacgacgactatgcaatgaagctgatccgcttgaaacatgtcgctttacaccagatcaagcttgataccaacattttggaagaagcccatttggaccagtatatcaatccgcaaaagccatttaaggattgattgattcacggtggctttttcctgccctaaccgctgctttggttaccgggattatcctgggcagtcagctgtggctgagtctgctgctgctctatttgctgtttcgtgtttggacgctgcatgattttgcaacgatcaagtgggtgcttttagcgggtttaacggcgagtctggtttgcggctgtgcgctttacaatgctcaaactaagccgctgacaacgccgcagccggttgaatgtaattttaaggtactgcctgatcagattatagttaacggtaatctggttcagatgcagggaaccaatctgaattcaggcgagcgtgaatcagtggtcctaagactgcgttcttcacaagaaaaggcggcgctggttcacaaccaagccgtgctgttttggcagatcaaaggccaagagcagccaatcatcggtcctaccaattttggccagtttgactaccaaaagtaccaatggcgacatcatatctataatgagattcgggcacaaaaatggcattggcagccgcaaaaaccgcatacgctgattgaacgctgtcattgtctaagaattggtctgcatcagtattttcagacgctgccctcgccgctgagcgagtattgcgacagtctgatcattggccttaatacctttaagaccacgcagctgttgagttcagtcaaaaaactgggtgtgattcatctattttgcatctcaggcatgcacgtggttttattgattgcaattttaagaggacttttgatccggttgcggtttaacattgaaacgatcgactggcttttaattgctctgctgccgttttatctgattattggcggtggtgcggctagtctgattcgagcatcgattatggctgaagtgcgccttttgagtcaccggctgcgtttttcaagagttgatgcctggtcgatcagtttgctgatcggcattctgcttgatccatacgttttgttgacgcttggcggacagctgagctatttgatgtctttactgatgccgttgtcgctaagaaacgtttcggatctaaaaagagcattttggctgaatctggtcagtctgcccagcctgtttcattatatttatgaggtacacttattaagcacgctggtcagctggcttctgataccattattcggcacggtactgtttccgcttacgctgctggcggctttaactgccaactggctgccgcttttggcatatagtttcaatgaaatgctaaaactgctgcatcggattttggaccaattggcagccgggccaggcatgctggtgtttggtcaactgtcttcgcttggggccattataattctgctttttactttgtggctgttggcagagccagctaaaaaaagcagctggtatattttggctgctgcttattgcgtggcttttatgtcgattcatctaccgccagctggtgaggtgacgtttgtagatattggtcagggcgactgtgcgattgttaggacaccgtttaatcgccaagtagtgatgattgatacgggtggtcggctgcagtatcgcttgccgcagtgggccaagagtcagatgaccagcgatatggcagccagaacttcgatcagctatttaaagagtcgtggaatcacgcgacttgatgctatttgtctaagccatagcgatgctgatcatatcggctatctgccaactgtactcaaatcaatgcacgtaaaagaggtgttggtccccagtggaatggagcgtaatccgaaatttaagcgcctggtcaaccagccacttaaagtcataccggtgcgagccgatcaccagcccaatgatctgcccttaaaggtgctgcatccctttaaatctgggacgggaaaaaacgaagactcaatggtgctggcaggacgctttggatcacttgactttgtttttaccggtgatctggatcgcaaaagagaacgggccgttattgatcgctattcacagctgagagccgacgtgctgaaattaagccaccatggcagccggactggcagcgatcctaaatttctaagccgtctgcagccgcgttacggtatcatctcagccggtcgctttaatcgctatggtcatcctaattccgtgaccataaaaaatctgcggcgtttggggattacaccggtttctactcagcagtatgggatgatcagctattgttattatcaaaatcaaggatattggaaaacaagactaaaaggggatgaattaaaatggatgttgccaccttacgccaacagctaagcagccagacgccggcaatgatctatgtaatattgggaacacaaggaattttgcagcaacaggcgcgtgatgcttttatgaatctgattcctgaagcagagcgggtgatgaacgttggcagctacgatatggagacgacgccgctttcggttgcgcttgatgatgcaatgtcggcacctttttttggcgaacggcgcttggttttgatcaacaagccatattttttaacgggtaatcctgccaaggtcaaggtcaatcacgacttagacgcatttaaaaactatctggaacatcctgagccgtcaacggtactggtattaatggcaccttatgaaaaacttgacaatcgcaagggactggttaaagaactgaaaaaagtcgcagttgaggtcagtgcggcgcctttaagcgaacaggatgcccgccatcaggttgaacaaaagctcttaggtgacggttaccgcttggaaaatggtgcgatggatgaactaatcagacgtaccaatgccgattatggcttgatgatggggaacgttgagaaactagagcttttggcgtaccaaagcaaacgcatcaaacgcgatgacgtgatggggctggtaccacagtcattggatgagaacgtctttgatctgattacggcagtcttaaaaagagaccaggccaaggcgttggatatctaccagcagcttttggaaaccaatcacgagccgctgcagctgaatgcactgttggtcagtcagtttcgactgctgattcagataaaggtattgagcaagcgggggctgagccagggaacgctggccagtcggcttaaagtgcatccataccgggttaagcttggtatgcagacggcgcgtcgctttcaaatgaacgatttggtaagagcctatttaggtcttattcgctgtgaaaaagccttaaaaactacttcgcgcgagccagaactgctttttcagctgtttatgctgcagtttgctaaaaaagctgggtaaaacaaaaaaccgatgccgttgagacatcggttttttgttttatttaagcactacttgttgtaacgagccgtcagacgggacttgtcacgagcagccttgtttgccttgatcaggcccttggagtgggcacggtcaatagcggaaatagctgccttgtacaggtcgtcaaggttttcggcgccggctaccttagccttgtcgaacttcttaacagccgtgcgcatttcgctcatttgggaagcgttgcgtgcttgggccttttcgctggtccgtacacgttcgattgctgatttgatgattggcatgaatttcacctccgttaacccggtttaattagttgaccagaatttttcaacatttgtcattatacaaaagtcagttgtcgattgcaatagtcttagtcctatcgtttgaaaaaaggctttgttggttgcaattttgttcagaatccgttatactatcaaaggctgctaaaaatagcccatgcctcttctcggttcagcgatcctcaccgacgctctacctagaactcggcgcattaaaatttgaaaggtgggaatagcaacatggctatctctaaagaacgcaaaaacgaaatcatcaaggaatacgctacgcacgaaggtgacacgggttcaactcaagttcaagttgccgtgttgactgctgacatcaacgaactgaacaaccacctgcgtacgcacaagcatgactaccattcacaacgtggtctgatgaagaagatcggtcaccgtcgtaacctgctggcttacctgcgtcgtactgacctgcaagcttaccgtgaactgatcaagcgtctgggcctgcgtcgttaatcctaacgtctgctcagatcttaagtctcgacaaatgtcggggctttttttgttgctctttttaattaaaatttttcatggatagaatggttaattatcaatttgtgttgattctgtggtaagatgaataacagcaattatgaacgaataaattgccatgagccgtccaggaccgtggcgcgtttaaatacaatcataaaggagcaaacatgagcaagattaagattacgccttttgggggcgtgcacgaaaacggcaaaaacatgtatgccgtcgaggttgacgaacagatttttattttggactgtggtttaaaatatccggaaaacgaactgatgggaattgacgtagtcgtaccggactggtcatttttaaaggaaagtgccgatcgaatcgttggggtctttttaacccagggccatgccgatgcaattggcggcctgccatatttcctggctgattttaacgtaccggtatttgggagtgaattaacgattgccctggctaagctggccgttaaagacagcgccgacaagaaagtcaaaaaattcaatgacttccatgtcgttgatgctgcaactgaaatcgacttcaacgacgttacggtttcattctttaagaccacgcactcgattcctgataccatggggattgttttacagaccccagaaggcaacatcgtctacacgggtgactttaagtttgatcaaactgctgctgaaggctatcggaccgacttggctcggctcgctcagattggtcagcagggagtcttgcttttgctgtctgattcggccggttctgggattaccggcatgaataccaaggaaaaagatattgcagcctacattcaagatacttttgaagctgctccaggacgcgtggtggttgccagcgtagcctcaaatattatgcgcgttcagcagattttaaacgctgcagcggcaacgggacgcaaggtgattctttccggccatgacctggaacagatcattgacacggctatgtcccttaataagctgaagatgccagaagacgacctgctgattacgctggaagaagccaaaaaattgccgccagaggaactggttgtcttagaaacgggcaagatgggtgagccaatcaaggcactgcagcagattgccaatggcgacaataaaaacatcacgctcaacgagaacgacctggtttttgttacgacgacgccatcgtacgcgatggaaacaacggtgcaaaagactgaggacatgctttaccggactggtgccagcgtcaagtttattgcggctgatctgaatccatccggtcatgccaaccaaaatgatgagcagctgatgcttaactttatgcggccacaatggtttatgccgattcaaggggaatatcgcctgcttgatcagcatgccattttagctgaagaagttggcattccggctgaccacatctttttgactaataagggcgatgtcttgacctatgaagacggagcattccatttaggggcccacgtcgaggttggcaataccatgattgatggtaccggggttggtgatatcggcaatatcgtgctgcgtgatcgccgcgtattgtccgaggacggcatctttgtagtcgtggcaacgattgaccgtaaaaagaagaagatcgtggcgcggccgcagattacctcgcgcggttttgttttcgttaagaccaaccggcagctgatgaagcaaagtgccgatctggttgaaaaagtcgtgcaggaaaaccttgatcaaaaagagtttgactggacgcatcttaaatctgacgtgcgcgaaaagctgaatcgtttcctcttcaatcaaacgaagcgtcatccggtaattttgccggtgatcatggaaatcaatcagcatccaaagcgcaaaaatcactctaaaaagactaatgacaaggccgatgaagaatcaacggccaaaaagactgacgctaagcgtcgcggacgaggccgcggagccaagcgtcagcgtaagaccgaagccaaggcaggcaaataatcagcagcgtgagcatcagcaagtgctcgcgctgtttgacttttagaaaggaattttaagactatgacgcctttacaacaagagcagtttcatcaagcagatcagttgcttgaccagcagcactatcatgaggccgcccaacggtttgccgctttgtatgaagaggttgatgagtttgctattaatcgccagctggtaagagcactatatgaagatcagcagtacgctgaggctgctttttatgcagttgagcatctcaatgactatgtgacttctaaagagctgatgcagctattgatcaatgttgagctgcatgcccaagcgtttgttgacgtgcgcgtgcagctgaatgctctgccaaaatggcatgatgagtttattggtcaggtcgagcaggccgaaaatgagtttgccgctcactatcagacgacgctgaacagtcagctaaaacagttctaccacttaggcgatggcagttttgccgaacagcagcgtcgttttagagctgccagtcacctgccgcttaagcagtatctgattggggccaagtttctggttcgcgatccgtttgtcaatccgttgattagatcaagcctgatgcagatgctgcagcgattgcatcttacgggaaagattatgatctattggctggatgaacgagagcatttgattgatctggcaaaactgtcggatgtcgaatcaataccagttgtttcacaggttgaaaaaatgatcaaacgagatttcagccagcaggatccattgtcatatcagatgtttaatcaagaatttcacttgcagctagcctatttatatccactggttgaattggcaattcctgacgcaggtgcttggtatcaggctttgacggcttattctaaaagtaccgatcaagatcaagacgttgttttagctaaacggtggcagaatcagattgcgcgtctggctcagcaactgggcatgcattaaaaagtttcggttaaattcatttacaaatcaggatagagctgatattataattaagaattctttcggaaaaccggtttttaaacttttaattggctcccggaagtagtacaattttcattaagggtgtgtcagacaatgatttggttgtctggcattatacttgtaatttatcaggaggatttcattaatggctgaaaaagaacattatgaacgtactaaaccccatgtaaacattggtactattggccacgttgaccatggtaagactactctgactgctgctatcacgaaggttctggcagaaaagggtctggcaaaggctgaagactacgctgatatcgacaacgctccagaagaaaaggaacgtggtatcactatcaacacggcccacgttgaatacgaaacggaaacgcgtcactacgcacacatcgatgcccctggtcacgccgactacgttaagaacatgatcactggtgccgcacaaatggatggtgctatcctggttgttgctgctactgacggtcctatgccacaaactcgtgaacacattctgttggctcgtcaagttggtgttcaatacatcgttgtattcctgaacaagactgacttggttgacgacgacgaactggttgacttggttgaaatggaagttcgcgacctgctgagcgaatacgatttccctggcgatgacattccagttgttcgtggttctgctttgaaggctctggaaggtgaccctgaacaagaaaaggttatcctgcacctgatggatgttatcgacgaatacatcccaactccaaagcgtcctactgacaagccattcatgctgccaatcgaagacgtcttcactatcactggtcgtggtactgttgtttccggtcgtattgaccgtggtaccgttaaggtcggcgacgaagttgaaatcgttggtctgaaggacgaaatcctgaagtctactgttacgggtgttgaaatgttccacaagacgctggaccttggtgaagccggggacaacgttggtgttctgctgcgtggtatcggccacgaccaagtagaacgtggtcaagttctggcacaaccaggctccatccaaacgcacaagaacttcaagggtgaagtctacgttatgacgaaggaagaagggggccgtcacacgccattcttctccaactaccgtccacaattctacttccacactactgacgttacgggtacgatcgaactgccagatggtgtagaaatggttatgcctggggacaacgttacgttcactgtttccctgcaaaagccagttgccattgaaaagggtctgaagttcacgattcgtgaaggtggccacactgttggtgccggtgtcgtttctgacatcctggactaatttcaacttagtgcaattaatcaaagagcaagcagaaatctgcttgctctttttttggatctttgtcaaatcagagtggtgaagatcaattccctgcttcaaaaatgaagtggggaatttttttaggtacggatacagtcaaagcgccgcaaaagaaagactgaaatcactgatataaatagctgctaaaaataaaggcaatgacattcagtcagagatggattgattagctgcagctaggaaaacaattgaaaatcatttttgatttattattaccaggcttgcacattgatggccaggttttttaaaatttccgaacaatcgcatttaaacccttttacaaaagccaatttaaaaatcaaatgcgaacattcgtaattttatcgttttaatctattgcaaaaatccgaaaattgttgcataatcaaatcttgtttgttggattaaatgcataggagatgaattttaatgggtcaaagcacgaataactcgcctgcttctaccaatattttagagaaatggtttcatttaagcgagcagggcacgacgatcaagcgtgagttgctcgcgggtttgacgacttttgtttcaatggcctacattctgtttgtcaatcccagcgtcttgggaatggccggcatgaataagggcgcggtttttacggcaacggcattatctgcaattatcggctgtttattgatggcatttttagccaattatccgattgccattgcgcctggtcttggtgataacgcgttctttacatactcggtggttctggcaatggggatctcatggcagaccgcgatggctggtgtttttgtagcatcggtaatctttacgatcctttctttgatgaaggtgcgtgaagccgtaatcaacgcgattccgcatgatttgaaactggccattgcggctgggattggtctgttcattgcttttgttggactgcagggcggtggcctggtcgttgccagcaagagctcattggttcaattaggttcactgacggtaccaacgacctggctgacgatctttggggtcttagcgattgcactgttgatggctaaacgagttcctggatcaatctttatcgggatgattctgacgacgctattgggcttgtttacgggcctgattaagatgcctgctcatattatttcgttagctccttccatgaagccaacttttggcgtggcgctgaccaacctgggtaaggttaatacgccgcagatgtgggccgtggtgctgatcttccttttggtggcattctttgacacggccggaacactggtgggtttggcacaacaggctggtttaatgaaaaacgaccggatgccgcggattggccaggctttgatggcagattcaatttccatgctgagtggttcggtaatggggactacgccaacggctgcctacgttgaatcatcggctgggattgcagttggtggtcgaacgggattgactgcgttgacggtcggcgttttgtttgctttcagtctgctgttcagtccgctgctgacggtggttacgacccaggttacggcacctgcactgattattgttggttcgctgatggccagttcattggcgggtatcgattggcttcattttgaaattgcctttccagcattcatggtggttgccggtatgcctttgacctacaatatttcttacgggattgcgtttggctttattctctacccgctgacgatgacggttgcaggacggcgcaaagaaatcaattggatcatgtggacattgctctttgtcttcatcttgatgctgtacgtcttaaacgtattaccataacgactattaaaatggctcgatcgaaagcggtcgtgccttttttataatattttgacagaaatgaaagaggcttcagtcatgataaaaaaaacagaactaaaacacttgattgatgtggcagctggtcgcgtgccagctgacgtagtgattagaaacgcgcagatcgtggatgtctttttaggaaccattcggcgaggcgacgtggccttggcagctggttatattgctggaatcggtgagcgttatgaaggacagcaggtggttgatctggccgggcgcttcttgctgccagggttgattgatgctcacattcatgtggaatcttcctatgtttcgcctgaggaattcagccggatttttgtcccatgcggaacgacaactgctttatgcgatccgcatgaaattgtcaatgttgccggtttaaaaggcttggaatacatggagcaggctgccgaactggcaaaaatggatattcgttacttgatgccttcttgcgtgccttcgactccttttgagcatgccggcgccaaccttagtgctttagatatggaaccggccttgaaaaatggtaccgtggatggcttggctgaattaatgaattatgtcggcgtcgtcaataatgatgataagatgattgacgaggttatgctggccaaaaagtatcatcggcggatcgatggtcatgcgccgcaagtctttggcaaactgctgaatgcctatgcggctgcgggcgtagctaatgatcatgaatgctcaacggttcaagaagccaaagatcgtctggcttgcgggatgtatgttctgcttcggcaaggaactactgaacatgatctgaaaaatctcttgccggtcgtaaacccacaaaccgcgcgtcactgtcttttggctggcgatgacgtccaagctgttacggcaatgactttgggccatctggataatagtattcgcatctgtattgaacaaggtctttcaccaattacggctattcagatggcaacgctgaacgcagctgaatactgcgggttaaatgatcgaggcgccattgcccccggcagacgagctgatttagtagtcgtagacgatttgagaagttttcatgtggaacagacttggatcaaaggcgaaaaggtggctcaagctggccagtatctaccaaaggttcaacgctatccaatcgatgcggtggcagcctccatgcacgttaagccgttagccagcgattgttttaagctgcatctgactggcaaagcggtgcggacgattaaggtgattccgggggaggtcttgactgatgaagcaatccgtcaagtcagtcatgatgaaaccggtgattttgtctacgatcaaagtcaagatgtggttaaattagcagttattgagcgtcatcacgccaccggcaaaatgtgtacggcactagtcagcggatatggcatcaagcatggcgcgattgccatatcaatcggtcatgactcccacaatatcatgacagccggggtcagtgattctgagatgctggcagctgttgctgaactgatcaagcagggcggcggcgttgtcatggtaaaagatcaaaagcctattgcccgcatggcgctgccgattgctggtttgatgagtgatcaaccggctgaacaggtcgtggcggcccaaaatcagatcaatcagactgctcaccaagagctgggaattccagaaaatattgatccagtcatgtcactgagctttttgccattggcagtaattccaaaattgaaattgacggatgaggggctctttgacgttgccaatggtcggtttgtcacgctcgaagtcgatgatcaggcttaaattggcgataattaatgcgaatagttgaaatccagggcactgtacggtaaactattaaagtatgtacgggtcgctgtcatttgtgatatgagcagcgaccagttgaaaactgcaagttattggaggaaatgaaatgtcagcaaaatgggaacgcgacagcgaagccagcaaagggacattaacttttgaaatcgacgttgaaacggctaagaagggtattgaccaagcctttaagcgtacgcaaaaacggatcacggttcctggtttccgtaagggccacgtgccacgtcaactgtttaaccaaatgtacggtgaagaagctctgtaccaagatgctttgaacatcgtgctgccaaaggcttacgaagatgctgttaaagaaaccggtatcgaaccagttgaccaaccacaaatcgatgttaagagtctggaaaagggtcagccatgggtactgactgccgaagttgccgttaagccagaagttaagctgggcgactacaagggtatggaagttccagctcaagacacgacggtttccgacaaggaagttgaagacgaattggaatccaagcgtcaacaacaagctgaactggttctgaaggaagaccaaccagctgaaaacggcgacacggtcgttatcgactacgtaggttccgttgatggcgaaaagtttgacggcggctctgctgacaactactcgctggaactgggctcaggcgcctttatcccaggatttgaagaccaactggttggccacaagtctggcgaagacgttgaagttaaggtaaccttccctgaagaataccatgcacaagacctggccggtaaagaagccgtctttgaagtcaagctgcacgaagttaaggaaaagcaactgccagaaatggacgacgaatttgccaaggacgttgacgaagacgttgacacgcttgacgaattgaaggaaaagacgaagaagcagctgcaagaacaaaaagaagacgctgctcacgctgccattgaagatgctgctattgaagctgccgttaacaacgctgaaacggaagaaattccacaagcaatgctggacgacgacacggaccgtcaagtacaacaatacctgatgggcatgcagcaacaaggcatcaatcctaagatgtacttccaaatcactggtactactgaagacgacctgcgcaagcaattcgccaacgatgctgctaagcgggttaagaccaacctggttctggaagcaatcgttaaggatgccaacctggaagcaaccgatgaagacatcgatgctgaaatcaaggacctggctgctcaatacggtatggaagaagatgccgttaagaaggctctgtccaaggatatgctgagtcacgacattcaaatcaagaaggccgttgacctggttacggattctgctaagcaagttgaatccaaggacgcagaagaagacaagtaatctttgaaattgcgttaaaaacagctgcgatcagcactgttaaaacaacataggggcccagcgttcggttatccgggtgctgggccctgttgtcgtactgagtcgatcattttttatttaagcctacctgtcgtatcgatgatggtttgaattattcgaaatttggccgacagtttggtatgataaacacaatcattttaagaggaggacgcaagatgtttgaagataccagtggcatggatgccgtgcactgttctttttgtggcaagtcgcaagacgaagtaaaaaagatcgttgccggtcctggcgtctacatttgcaacgagtgtgtcgatctttgccagcagattattgaacaagagctggccgaagatcacgctaatgaaactttccgcgtaccaacgccggccgaaatcgtcaaggagcttaacgactatgtaatcgggcaagacgatgctaaaaagacgctggccgtagcggtatataatcactataaacgggtcaacgccatgatgacgggcgacaacaacgaaactgatctgcagaagagcaacattgccattattgggccgactggttctgggaagacctatctggcacaatcactggcaaagattttgaacgtgccatttgcgatcgctgatgcgactaccttaactgaagccggctatgtcggtgaggacgttgaaaacatcattttgaagcttttacaggccgctgactttgatgttgaacgagctgaaaaaggcattatctacattgatgaaattgataagatcgccaaaaaaggcgaaaacgtctcgattactcgtgacgtttccggcgaaggggttcagcaggcactgcttaagattctggaaggcacgattgccaacgttccgccgcagggtggccgtaaacatccgcaacaggagtttattcaagttgataccagcaatattttgttcattgttggtggggcctttgatggaattgaaaatattgtcaaggaacgcctgggtgacaagacgattggttttggaacggatactggcgagctgcaggacgtcaacgaaaagaacatcctccaacacgtcattccagaagatctgcttaagtttgggctgattcctgagttcatcggccgcttgccagttttgacggcgctgcaaaaattggatgaagatgatctggtccgcatcttaacggagccaaagaatgctctggtcaagcagtatcaggaactgatccgcttggatggcagtcagctgcagtttacggatggtgccttgcgggcaatggctcaattggcaatcaagcgaaatactggggcgcgtggactgcgttcgatcattgaagacgtaatgcgagacgtcatgtttgatctgccaagccgcaatgacgttgccaaggtcgtaattgacaagcgctgcgtggaaagccatggcgagccgcgttacgtattaaaggacgaaaaagcttcataacaggcagaaagggtcagcagtgacccttttttaacggaggaaaaacagattatggaagttcatcacgttgacttaacgatcagcgcggttgctgaagaacagtatccgaagaccgactacccagagattgctttggttggtcggtcgaatgtcggcaagtcttctttgaccaatgtgttgatcaatcgcaaaaacttcgctcatacctctagtcagcccggcaagacacagacgctgaacttttataacgttgaagatcagctcttttttgtcgatgtccctggctatggctatgccaaggtctccaaaaagcagcgcgaaaaatttggcaagatgattgaaacttatctgaccacacgtccgcagttaaagggtgtaattgaattggttgatgcccgtcacgcaccaagcgacgatgacgtagccatgtatcagtggttgaaatactaccaggtaccgcttttggtagtcggcaccaagatcgataaagtcaaacctagcgcacgaacgaaatcgatctcgcagattaccaagacgctggggatgactgacacgccactgcagcttttctcggctgagactaaattcggcaaggatgaagtctggcaatggattgaagctcgcatgcacgatcaaaaatagcagtttttgatcaatcagtcatgaatcagcaaaaagggccccatgtccggaactgaccggatacgggaccctcttgctttcttatgatgcaaaacgattattgcttgtttttgtcgctggcttctgtctggtcagccgacttggccttttccttggctttttcttttggatcgattgccaagtcgttgaacagtttttccagcttttgattgcgttgtgttaccaaacccatggctggccctcctttaattgctgcttgcaaatatcctatcacaaactggaaatgacgtaaatcaacttacaggcgattcttttgcgaccagctgccagtctgtactaaaattaaagataattaactaattggaggcgttcaatgaccacacagcgagtggagcataagctgatgctgctgccggataagcccggatgctatttaatgaaagacatcaatggtcagatcatctatgttggcaaggcaaagaatctcaagaaccgggtccgctcgtattttaagagcagtcatacggggaaggttgcggcaatggttgatcaggtcgcggattttgatatcattaccaccgattctaacaaagagagctttctgcttgagattacgctgattcaaaaacatcagccttactataacatcaagcttaagcggggaaccggctatccttacatcaagatcaccaatgagcgtgacccgcgcattgagattaccggtcagataaaaaaagatggtgcctattattttggcccttatccaaacgtctacgcagcggaagaaacgctgcactttattcaaaaggtctatccgctgcgccgctgccgaggacatcaaggacggccctgcctttactatcacatgggacagtgcctgggtgcctgttttaaagaagttccgcgggaagactatgatgctcagatcaaaaaaatcaagtcgtttctaaatggcaacactgccagcgtcaaaaagcagctgttggccaaaatgaaacaggccagtgctgatcttgaatttgaaagagcggccgagattcgcgatcaattgcactatatcgaggtgacggttgaaaaacaaaaaatcattaccaacgataaaacgccgcgtgatctgttcaacttttatatggacaaaggctggctgagtattcaagtgttctttattcgccagacaagactgatgaaacgagaaaagcgactgtttccggtagtcgacacggcagctgaagaaatgaccagctttattctgcagttttataaccgtaaaaacaatattctgcctaaagagattctcttgccggccgggctgcccaatcatgaaatcagcgagattctgggcgtaccggtgcgaacgccgcagcggggagaaaaacgcgatctgatgcacatggcctatgaaaatgcccaattgcagctgaatgagaaatttcggctgctggaaatggatcaggctaaaactagcggcgcgatgaaagagattacggatgctttaggcctttcagaatgtcataagatcgaggcctttgaccactcgcatattcaaggtgccgatccggtcagcgctatggtagtctttattgatggcgagccgatcaaaaagctgtaccgcaagtataaattgaaaacggtaatcaatcatgcggatgaagcggccagcacgcgcgaagtgattcggcgtcgctacagccggctgcttaaagagggtcagcccttgcccgatctgatctttatggatgggggcgagattcagatggacgcggcccgcgatgtcttggaaaatgagctgaatctggcaattccggtcgtggggatggtcaaaaacgataagcataaaacggctgatcttttatatggtcaagaagatcatcacgtgcatcttgatccgcgcagtcagggattttatctggtacagcggattcaagacgaggtgcatcgatttgcaattacctttcatcgcagcgtgcataccaaacattcactgagttcccgattggacgagatcaagggtgtgggaccaagaacgcgcaacaagctgttaaaagcgtacggctcattggatcggattgctgatgccaaggttgaggatatccaggcactagggatcaatcaaaagacggctcaattgatcaaaatatctttgcagggcaaggcagatgtggcaaaaggcagcagtcatgactgattttgacgcccgcaagatttttccttatactagacctagtagtcactattttaagaacggagaatatttttcatggctaacatgtttgtggatcaaataaaaattgaagcccatgccggaaaaggcggtaatgggatggtggcttttcggcgcgaaaagtacgttcccaacggtggtccagccggtggcgatggtggtcgcggcggcagcattattttaaaggtcgatccgggcttgcgaaccttgatggactttcgctaccaccggatttttaaggctaaaaatggccaaaacgggatgagcaagcagatgacgggagcagccgcctctgatctggtagtggccgtgcccgagggaaccacggtacgcgatctggatacgggtgcgatcatgggtgatctgactcagcctggccaggaattggtaattgccaagggcggtcgtggcggtcgcggcaacattcactttgcctcagccaaaaacccagcaccggaaattgctgaaaatggcgaaccaggcgaggaccgctacttggaactagaattaaagatgctggccgatgttgggctgattggttttccatccgtgggtaaatcaacgctgctttcggtcgttactggtgctaagcctaagattgccgcttatgaatttacaacgctggtgcctaatctagggatggtcatgctgccggacggtcgtgattttgcaatggctgatatgcctggcctgatcgaaggcgcgtcaaaaggggttggcctgggcttgacgttcctgcgtcatatcgaacgcacgcgggtattgctgcacttgatcgatatgggcagccaggaccccgaacaggctattgaacgctatcatcagattaatcatgagttggccgcgtatgatcctgagctgttgaaacgcccgcagatcattgttgctaccaagatggatctgccggatgctcaagaaaacctggcgcactttaaggagatgcttgctcaagacgatacgtttgctaagatgccgccagtcgtgccaatcagtgcgattacgcatcaaggcgtgcaggggctgatgcagatgacggcggatctgcttgatcagacgccagcctttgaaagcgagcaccatgacaagctgacaagcgtcgaatatcgtgctaaggaagccgaaccagactttacgattacgcgtgacgatgacggcacctgggtcttaggcggcgaaaaactgacgcgcctgtttaagatgtccaaccttgatcatgaagacggtcagctgcgatttgctcggcagctacggcatatgggcgttgacgatgcattgcgggctaagggcatcgaaaatggggatttggtacgaattgaaaagtttgtttttgaatttgtccaataatcgacgataatagaagacagaataggaaaatgatttatgcagattgaattcttaggaaccggtgccgggtcgccaagtaagcagcgcaacgtttccagcattgccttaaagctgttggaagaacgcaatgcagtctggctgtttgactgcggtgaggctactcagcaccagatcttgcggacgacgattcgcccccgcaagattgaaaaaatttttatcagccatcttcacggtgaccatatttttggcctgccgggtctgcttagttcacgatcgtttcaaggcggcaatgagccattgacgatctatggtcccgttggtatcaaggagtttgtcaagaccgcgttaaaagtcagcgaatcgcgtttgagctatcccttgaaattcgttgagctgcgtgatgatggcgagatttttagcgacaagacgtttacggtttataccaaaaagctcaatcacaagatcgcctgctttggctatcgggtggttgagcatgatcatccaggcgaattacaggtcgaaaagctgcgggctgcccaagtaccatcaggaccaatctatgggcaacttaaagccggtaaggtcgttgagctgccggatggacgagtgctggatggacatgactttatcggcgcgccgcaaaaaggtcgggtgattacgattatcagtgatacgcgtcatacgccagcggccatcgaactggctaaggatgccgacgtcttgattcatgagggcacctttgccaaggacgagaccaagatggcgcgcagctactaccattcaaccagtggtcaggcggcaatgacggcaaaaaaggcgcatgctaagaaactgctactgacgcacatctcggcacgctataccggcaaagcggcctatcagctggcctaccaggttcgcgatatattccctgacacgcgcgtcgttaatgattttgatatagttgacgtaccatttaaatagaggtgatggcaatgatgaagcgaatgaaggcattacggatgctgcgcaataaggttgtattgattactggcggatccagcggcattggcaaagaactggctttagaagcagctcgccgcggggcaatcgttgtggtttgcgcgcgtgatctggaaaagctcaatcaggttgcccagcagtgcctgattctttctggtcgcccatcatttgcctatcagttggacgttacggatccagaccgagttgacgaggtgttgaacacgattcgacatgaggttggcgaaatcgatgttttggtcaatgctgccggtctgggcgactttaccgcggttaaaagccagtcgcgcacggtcatgaaacgcatggttgacgtcgacttgctggcattgatgtatctgagccgctgcgtagctaagcagatgatggatcaaggctttggcgccattatcaatctaggctctttggatggcaagattccgaccccgaatgcggctgcctattcagcaaccaaggctggcgtgatccagttcgacaatattctgcgcatggaagtagccgattatggcgtccaggtgttgacggtcaatccaggcccggttgccacgtcgttttttgacaaggcggatcctgatggcagctatctaagcaaactgccgcgctggatgatcgtgcagccggcggaactggctaagcaggtttgggctcatgttggctatgagacccgtgagatcaacgtaccaggctggacctcctggctttcatggggctatcaggtgtggccaggacttggcgattgggcaatcaaaaagttctttgactatcagcaggacaagcgcagtctataaacagacgacgaccgggactgaaacaggttccggttgtcatgttttaaaggaatggtgaaataatggaagcgcgctatgcgtgggaattgtcccaaaataaagaccagcagctggcaaaagagcttcaagaacaatgtcagctttcaccgctgctggcacaattattggtccagcgcggcattgattcggtccaggcagccaagcagtacttggatcctcagttggcagagctgcatgatccgtttgagctgcatgatatgcaaaaagcagttgatcgaattcaagccgccgttgccaatggtgaaaagatcgtcgtctatggcgattatgatgcagatggcattaccagtacggcggttatgtatgaaacgctggatgaggtgggagcccaggttgaattttttattcctaatcggtttactgacggctatggtcccaatcttgatgaataccagcgcttgattgatggcggtgctcagctgatcgttacggtcgacaatggcgtttccggtgccaaggagattgagtatgccaattcacgcggcgttgacgttgtgattaccgatcaccatgaattgccggcccagctgcctgaagccgccgcaatcgttcatcccaagtttcctggcagtgagtatcaaggcggtgatctttcgggagtcggcgttgcttttaagacggcctgggcactgacggaagagtttccccaagagatgctggatctggtagcaattggcgaattggccgatctggttgacgttaccggtgaaaatcgggcattgattacctggggcctcaagcagctgcgtcagggaatgcggccgggactccatcagctggttaaactggccaagctcaatgaggatcggctgactgatcaagacgtcggctttggcatcgcaccccgcttgaatgcactgggtagaattgacgatgccagcgaaggcgtgctgcttttaacgaccatggatgatcgcgaaggcaaagagattgctcaagaagtcgaaaatgccaaccaaacgcgccaacagctggtggcaaagattactgatgaggctttaaaacaggcccgttcagccgaaaatgcagatcgatcgacgctcgtgctgcttgggcatgaatggcatcaaggcgttttaggtatcgttgccagtcgcgttgttgaagaaaccggcaagcccacgattgttgccagcgttaatgatggcgatgagattgccaagggttctggacgcagtcgcgacggttttgatctatttatggcactgcaaaagcatcgtgatttgatgacggcatttggcggtcatgcacaggcatgcgggatgtcatttaccattgaccaggttgatgaactgcggcaggccttggaacaggaagccgttgagcagagacttttcgaagcaggatcggctaaactggagctggcggctgaactgggacctgatgacatcaacgaagatctttatgatcagctgcagtgtctagcgccgtttggtcccggcaatccagaaccggtttttgcaatttatgctgatcgaatcaacaacgtcaaaacaatgggcaaggctcaggaacatctaaagtttgagctgcggggacaaaaacgcagcgcggccgtggtggcgtttggcaaggctgagctggcgccattgctgctggctggcgtaccggtgacgatcgcggctacggtggggattaatgaatggcgtggcaagcggaccgcgcaattgatgctaaaggacattcaaacgcaggggacggcaattctggatcaaagaacgcggcagcttttgccaagcatgtttacagaaaccggctattatgtcgcctttgatcagacgctgcggaaaaatattgccggtcatgcacaggggacggttttaagtccacagacggccgtcaaaaccgactttaaggatcagcaggtgacgatcgtggactgtccgccaagtttagagatgctcagttcgctttggcaaaatggcgggcagccggcaatgattcggctgctgctttgggaaagaaatccagtccgctttggtctgccgacgcgccagcagtttgcggttttgtatcgtttcttgcgtcagtatcctaagattgccaactatcgccaacagcagccggcaatggcgcgttcgctgcagatgccggttgaacaactaaattggatgattacggtgttttatgaggcaaaatttgttacaataaacgatggcgttctaaagttggcggatcatcccgaccatgttgatttagaacagacgaaatgctatcgtcagcatgcagctcatctgcgaagcgatcaggtgctgctgtatagcgacacgcgcacgctgcgaaaatacgttgctgactggctgatggcaaacgaataaggagaattttaaatggctctagatctttataaatatgttgcaagtattcctgactaccctgaaaaaggaatcatcttccgagacatcctgccgctgatggcagatggcgaggcttttaagcaggctactgacgaaatcacggcatttgctcgcgaacggcaggttgacatggtagttggtcctgaagcgcgcggctttatcgttggctgtccggttgcctatgaattaggcgttggctttgcgccagcacggaagaagggtaagctgccacgggcaacggtcagtgcttcttaccagctggaatatggcgaggcaacgctgcagatggaaaacgactctgttaagcctggtcagcgcgttttggtagttgacgatctgctggctactggcggtacgattggtgctacggtcgacatggttgagcaaatgggcggcaaggtcgttggtgcagctttcctgattgaattaaaagagctggaaggccgtaagcatctgcgcggtatcgatacgaagacgctgatggaattttagtcgctgatcggttggtttttcgtacaaaaagggtccaacgctcatggagtggaggacctttttattgtcatacggcttttttataatgatcatgcatctgatcagtcaaaaatctcaaattatgattgaaataaagtacgatccgtaaaaaattattgtaaagtagtaatgaaatagatttttatttaatgattacaaaggagctttccatgattttcttagttgtattcggcgcactgatgctgatcttgagtgccttttatctggttaattcctggcagcagtatcgccaatgggtagtgccaacgatcatgctggtgttaagtctggcagctacggtttatggtacgatcaatctgccatattggcaccatagtcaatcggcacagcaaacgacgagtgctgccagttcaggatcgtcgcttagttctgcgaccgattcgaaagctgattcgagttcaagttctagcttttcagtcaatggcgctaccgcggtcttcaaccagcaggacagcggcgccactcaggaacaaaaagaaatgtatctgcttcgtcagctgcagaaggcctacagcaagatgggcaccgtcaactatgacagcgactcgaaaacctatcagattatgccaaccaatgagaatacggttgaggctttaaactacattgcccaaaatccggctcaggctcagcaggcggggtggtcgaatctaaccagctcgcttaatcagacttcagcccagattaaaaaaatcgtggggagtggctactcgctgagcatgatgaagcccaacgatgatcagacggcattatataccgcaaaggatggtaaacagacttatggtattgtcaatcagtaagaggtgggataatgaaaaatcatgatcgattggttttggtaacggtgattgcgtttggcttggccatgcgtgcgcccatcgtcaccattccattgataatcgatcagcttgcgcgccaattaaagaccgcagtcggtaatctgggaattttgacgacgattccgctgattatgtttctgctgttttcgatcgttgtcgctaaggaaatgaccaggttcggcctgcgtcgcgctttaaatcttggcttgacggcgttggtcttaggcgccttgttgagactggacgttacctggccaatgctgctgctaggcacggtgctggttggactgggcattacgcatctaaacgttttgacgccttccgtagttgccacgtatgagcccaatcacaccgcattttatactacagcttattcgctggcgattatggttggttcatcagtattcagcctgctgacgcatccgttatcgagtacttttggctggtggtccgtcttggtcgttttattaatgttaacgatgtttccttggctgatgtggatacttttcaggttgccggtaccagtacgttctcaagcaaagcgcgctgataatcagtcagtcaaatcaattcatgaaccagacctaaaaacgactgccgcgccgctttggcagaatcgatatgcgtggtgctgcctgttgatgtttggtacacagtcgcttattaactatactttagtggcctggctgccagaattgatgcgctttaatggtatttctggcggtcagatcagcattgttttggcaatgtattcagcagcaggcatgccggtgtcattgctgctgccctgttttcttgaaacagccacgcatcgaagccagatcgtaatgtcgatcgtggttggactgttgacgctgttggcggccgttttgatgttttggcagtcgtccatgccacttgtttactggtattatttgtcaatcattactggtgcaatgacggctttttacttcattatggcgctaacgacttttccacttaagacgatttcaccaacccgaacggcacagctttccggtttgacgcaaagtggcggttatctgatagcatcgtttggtccagcgctttatggtctggcttttaaaagcagtccgctgggaatcatgcagatttggtgttttgccatcgtcatcgctttatgtactttggctagttttgtggttatcaaaatgccaaaaatctaaaaataaactcaaaaacagtggttgtttcgaccgctgtttttttaatgccttgacgaattttaagctagtcgctaaactggaaaaaattttaaaagggaatgattagaatgcttaaaattgatggccatacccatactaagctttgtccccacggcagtcacgagagcacgcgggcgatggttgaacgcgccattgagcttggctttgacgaatattggattactgagcacgcgcccatgccaaaagattttgttcaacggtttgccggtccagccgatgattggcaaacggaaggactcagctgggagcaggttgacgactatctaaacttagctgagcagctgcaaagtgaatatgccgatcagatcaagatcagcattggttttgagattgagtatctggcaggctttgaagaaacaacgcgcgcctttttggatcaatacggaaaaaatacccagcacaacatcttatcggtgcattatcttcaggatgatcaaggaaaattttgggggattgactactccgcagatgagctgcaggctgggtttgccaatgatctgaagacgccgcagctgctgtatcagcgttacttaaaaacggttctggccagtgctagctgcgacttgggcagctttggacctgatcggcttggccatcttagtctgatcaaaaaatatcaggattatttcggcctgccggaagcctttgatcgatcatgtcagcagctgattgatgagatcatgactaccgccagccagcggcagctgagtctggacttcaattcggctggcctttataaaaaatactgcaacgatttttatcccggcagtcagatcgttttggcagcgcttaaggccggtgtgccactgatttttggctctgatgcgcatggaatcgatcaggtgggacgtggctggcatgccatgaaaaatttcttaaaagttcttgacactcttaaaagatgagaataatataactacaataccaaatgaatctcattgttttttaatggtgatgaaccggagagtagctatcgtggattattaagagagtctcgcaaagttgggaagagattgattgcgatagtgaaccacaccggtgagccgaccagctgaaaggttataagtaggctgttccgggaccactcgttatcagggctgaattttatccagcatgaggatcgtttcgcaaggggcgatcgaatttgaggtgggaccacgcgaaaagcgtcctctttgtccagatgggcagagaggacgcttttttatataaaaaataaatgagtaaaaaatgagaggaggcattatcatgatgagcagcattgctttaccagctggcttgcgtgatcagtttggcacggaggcagaatcaaaggatcaaatcagtgcctggctgatgaaaaatctgcgcagtcgtggctatcgacgcattattacgccaatcgtggagcgacgggatctgtttgccgagttcaacatgcaaagtgaacagtatcgggtgattgacccggctggcgatgagttggtcttgagaccagatctgaccttgccggttgcccggttcttggcaacgaccaacgttaagctcccccaaaagatttattatctgggcgagcggtttcaagcggcacctgagctttcaggcgggcaaagcgagcagacgcaggctggcatcgaattgatcggctatggttcattgaaagcagaaatggaaggcgtgatcttaatgcatcggctgaaccgccatctgttggacaaccagttaacgattgagctgggacacgccagattggttgatacgattctcgatgcgcttgaattggatgaagaactgcaggagcaattggcccaggcactttatcataaaaactttccggcctatgaaaagctgctcagacaggttgatgccccccagacgatgccgtttctgcgtaaatggccatggctgtttggcacgctggcggaggtcaacgacatgctggcagaagtcaaggttcctgagccggcccttccgttgcttggtcagctcaagacggtggctgaattcgctggtgagctggctgatcagcaggtaattgtcgatctcagcagtgcggtgccgcaaaaatactatacgggtatcgttatgaaaggctatgtggaaaagacgactggcgcctatctgatcagcggcggccgctacaaccgtcttttagccaacttccagtcacaattggagcccgcggttggcttgggaatcaacattgatgctttggccgaggcgacagcactcaaacctgtcaaaaaacagccggtctttgtctacgcgccgtttgagcttctcggccaggcagcggcactggttgaaaagcatggcaactactcgctggctttggctgattcgttgcaggaggctcagcagcaggcccaaacagcgggagcgaaactggtcgccttggatgctgaaaaggggatgaaggaatgctgagaatcgcgctgaccaaaggaagagttgaaaagaagttcattccgcttttgcaaagatgcaatattgactgtcagcccttgatcgataagcagcgccgcttaattatcaatctgggtgatcagtatcagatcattctggtaaaaggggaagacgtctgcacctatctaagaaaaggagcggttgatctgggcgttgtgggcagcgatgttttagaagagcagggggctgatgagcaggtaaacgagctgctggatctaaataccggtcgctgtcagtttatcgtcgcctcaaaaagcgattttgactggaatcagcctcgccgcaaggtaattggcaccaagtatcctaatgtggcgcgccgctggtttgccagccaaggcgaagacgtcgagatcatcaagattgccggctcggttgaactggcaccactgaccggcttggccgatgccatcgttgacctgactgagactggaacgacgctgcgggttaatcacctggtcgtgcatgactggctggacgtaatcacgagtcggctggtggctaatccggttgctttaaagcagaagcgtgatgagatatttgcattgacgaatcaattaagacaggcaatggaggaagagtatgatgaagatttacgaaaagtcactgaatgaaatgaaaaaaatcgttgctcgctataccgaacagaccattgattttgaaatcgaaaaaacggtcagcgagattattcaaaacgttgctcaaaatggtgatcaggccgttcgcaactatgagcgcaaatttgataacgtcaatctggcagatttttcaattcccgcctttcagcttgatcaagcgctggatgcgatcgatgatgacttgcgggcagctttggaattggctaagcaaaacattaccagctttcacaaacaagaaatcgaaaacagctttgttgacgtcagcacgccaggtatcatgcgcggggaaaagattacgccattggccagcgtggggctgtatgtaccaggcggaacggcagcctatccttcaactattctgatgtgcggcattccagccaaattagcaggagtcaagcgggtcgtcatggtaacgccgccacagccagctggcatcaatccagcggtcttggcagctgctcgactggctggcgttgatgaggtctatcaggttggcggggctcaggccattgctgctttagcctatgggacggaaaccatccctgctgtcgataagattatggggcccggcaacattttcgtggcaacggccaagaagcaggtgtttggcaaggtagccattgatatggtggccggtccatctgaaatcggtattctggctgatgaaagtgccaatgccaaagaaatcgcggccgatcttttatcacaggctgaacacgacaagcgagctcgggccatgctgatcaccaacagcaagtcgctggccgaagccgtttctgaagagatcgatcgtcaattgaacactttgccgcgtcaagcgattgcccggacttccattgaggatcgcggttttattgcggtgatggaaaatacggctgagatgtttgagctgatgaacgacgtggctcctgaacacttggaggtccaattggcaaatccaacgcagtacttgggtctgatcaaaaatgccggttcggttttcctgggccgctatgccagcgagcctttgggagattacgttgccggaccaaaccacgtgctgccgactggtggaacggcgcggtttgcctcgccactgggggtttatgattttgtcaagcggactcagtttattcagtttgatcgtcaaaatcttaaagccgatcttaaagccatcaccaagctggcgcgcacggaaggtttggaagcccacgcccgcgctattgaagccagatttgacaaggaggactgatcagatgcgcaaggcaacgataaaccgagctacgaaagagacacagatcaaagtcgcattgaatcttgacgatcaaagtcaggttgccattaataccggcgttggcttttttgatcacatgctggagctgtttgccaagcacggtcgctttggtctggtcgtggaggtcaaaggcgatctgaatgttgatgctcatcacacggtggaagataccggcatcgtcttaggtcagtgctttaaagaagcgttgggcgacaaggcgcagattgagcgctatggcaatgcttttgtgccgatggatgagacgctggcacaagtgacggttgatttaagcgggcgctcttatctggtatttgatgccgagctgaccaatccgcggctgggtgcctatgaaacggaaattaccgaggatttcttccaggcactggcctttaatgccgagatgaacctgcacgccagagtattatatggccgcaacacgcaccacaagattgaaggattgttcaaggcaacggcccgtgcaatgcggcaggcggtcacgatcaatccagccattcaaggagttaactcaaccaaggggatgatttgatgatcgcggtaatcgattatggggcaggcaacgtctttaacgtgctcaaggcctgccagtatctgggccaaaaagctgagctgacggctgacccgcaaaaaatttcgcaggctgacgtggtgctgtttccaggcgtgggagcatttggcgctgcaatgacgcgcttaaaagaaaccggcctggatcaagtaattaaaagcacggttgccaatgggacgccatttttgggtatttgcctgggcatgcagctcttgtttgactcgtcaaccgaatttggcagtgcagccggcttgggcttgattcccgggcaggtcgtgcggattcccgatgatgatgggcaaaggatcgttccgcaggtgggctggaatcaaaacaagctgcaacagtcggaaagcatttttaagtcgatcaatcggcaatatacctattttgttcattcctattatgccaagtgtgctgatgaatatatcgtatcaacggttgactatggcgtggccgtgccggcgatcgttcaaaaagacaacgtttacggtttccagtttcaccctgaaaaaagcggtcaagtcgggttgaaactgctgcaaaccttttttgaaaaggcggtgagagcatgatctatccagcaattgatcttcaaaacggcagcagcgtgcggctctatcaaggcgacttcaaacaagaaacgctggtcagtgccgatccaatcagacaggcgcgcttgatcagagaagccgggatcggcggactgcatctggtggatctggatggcgctaagactggtcagccgcagaattttgagctggtaagtcagatcgttaaggtatttgccggtgaaactgagattggcggtggcattcgaaacgagcagacgatcagacgctacctaaaaagtggggttgatcgagtcattcttggttcagcagctctaaaagatcctaaatttaccaagcagatgctggaaaaattcggcagtcgagcaattacgatcggcgttgacggccgcaacggtcaagtagcaactgatggctggctcaatcagtccacgacttcaatggctgatctgattgcggcgatgactgatgccggagccaaacgctttatcgttactgacacggcaacggatggtacgctgacggggccgaatatcgagctgcttgaaggactgcagcaaaagttccccgaagtacggatcgtggcctcaggcggcgttggcagtcttgatgatctgaaaaagcttaagcaggctgggttaaaagacgtgatcgtaggtaaggcgattgcagcgggcaaggtaaccttagagcagattgcggaggtgaatgaggatgctggctaaacgaatcattccatgcctggacgtagctgacggacgggtgaaaaaaggcgttcatttcgtcaacttaaaagatgtcggcgatccggttgcaattgcagcagcatatgaaaaacagggcgctgatgaactggtttttttggacatcactgcaaccaatgaaaagcggcagaccatgagtaacgtggttgaggcagtttccaaacaagtcttcatgccgctgacggttggcggtggcatcaaaaatctggccgacatggagcgcatgttaaaagccggagctgacaaaaccgcgatcaactcagcagccgttgccaacccagcgctgatcagccagggtgccgaacgctttggcagtcaagccgttgtggtggcgattgacgttcgctgggatccagcagccggtaaatactttgtctatacgcatggcggtcagcaaaagacggatcttgaggcagttgcctgggctaaaaaagccgttgagctgggcgccggtgagctgctgataaccagcatggactgcgatgggaccaaagatggctttgatcttaagctctaccagacgattggccgggtcgtcaacgtgccgatcattgcttctggcggggccggtaaaatccaggactttgttgacgtatttaagcagacgccagtgacgggagctttggccgcctcggtctttcactttaaagagctgacgattccgcaggttaagcaggtgctggctaaggaaggagtgccggttcgccaatgaaacccgatttttcgaaaatgaatggtctgctgacgacggtggtggttgatgtcaataccaaagccgttttgatggtggcctggatgaatgaaaaaagctttcaaaaaacgctggccagtggggagacgtggttttggtctcgttcccgtcaagaactctggcataagggagctaccagcggcaatacgcagcgggtggtcagcatgacgcttgactgtgacggcgatacgcttttagtagcggtcgatcctaaagggccagcctgtcataccggacgatacagctgcttttttaatccaattgaaatcatgaaagaaggcaatgctaatgacacagcagaatcttgatgaactttatgaactggttaaacaacggaaagaaaatccaattgatggttcgtacactgactatctctttaaaaaaggcctggataagatcttgaaaaaagtcggcgaggaaacgactgaggttatcgtcgctgccaaaaacagcgatccggctgaactgcagtacgaaacggctgatctgctgtatcatttaatggtcctgctcgttgaatgcgatctgccatttgaaaaaatcaaagaagagctgggttcgcgcgttggtcagatgagccagtttaaggatcgtgtcccaatcaaaaaactttagaggtgagacgatgaaagaaacgattaagcaactggcaagctatgtaccgccaacgccgacggaaacgattgccaaacaatatggccttagccgcgttgccaagctttcggccaatgaaaatccatatggaacctcgcctaaggttgccgcggcggttgttgatgccgtggagcaggggagtggcaattggtatccagatggcaatgcaaccgtgctgcgagaaatgattgctcaaaaactggtcgttaaagcagaaaatatcgtctttggctgtggtctggatgagatcattaccttggtttcaagagtctttttggaatcaggagatgaagtcttggttgctgagccgacgttttccgaatacggtctcaatgctcagatcgaaggcgcgaccgtcaaaagcgtgcctgttgactcgcaaagcggcgccaatgatttgaatgcttttttaaacaacattacgccgaataccaaaatgatctggctgtgcaatcctaacaatccgaccggtggatataatcaaatcgctgctctgcgtgattttatgactcaggttcccaaagatgttttggtactgattgatgaggcatatattgattttgtcaggtccgctcagcctgcctcggcattgccgctgctcaaagaatttgacaacgtggctgttttaagaaccttctccaagatctatggactggccggctatcgggttggctatattattgtcgatgatcagcgggcgcgctatctgcagacggtgcgcctgccatacaacttaaatacgctgtcgcaggtcgcggcccaggcagcatttgctgatcaagagtttgtcgagcaggtcgcggttaaaaatgctcaagagcgtgataaatgggagacgtttttaaaacagcaccatgttttctactatcccagccaggctaacttcatctactttaagctgctgggtgccgatcagctggctaaacgattcttggaaaacggttatcagattcgcaccggatttgctgatgactggctgcgagttacgattggtctgccgaatgacaatctggcgatgcagcagattatggctgattttttaaattaagcgtgcgattaactgctttgtttaaacaaggcagtttttctgctgttaattgaaaaatagactgatttaacgactgcccttaaaaagatcagatatcggttttgggatggcaaatcgagcctgtcttatgtgatctttaagcgaattgttggatcgatgcttctgacaaaagccattagtggtggtgtcgcgtccatgcagttgattctttttaaataaagccggcagcatcgataatagtttatggattgatgcaacagcggccttcttatgattcatagtcttggaagatcgctgtttgcttttttgcaggacggctctatttgaaaaaacgatgatttattcttaaatattgccaaaaagttcaatatttccttgattaacaagtagtttctttgatgattgttcatgtttcttaaataaataaaaaagttttatttttgtcgttgacatttacttgcaatctcggtatattagataacgttgtcgcggcgataagctgctgatcacttgagtttggtggcttttcgcacaattgccaagataagtcaattaaaaaagttcttgacatgtagttgacaatttgttaaactgattaagttgcttgtttgaaacgaacgagcaacggtagacctttgaaaactgaatacagtttcgacgaacacaaatgtgcagggtcatcaatcattacgattgatgcaaaaacatttgcgaagtcaattcgcttaatttaaatttgagcttttccaagttcttatattttatatgagagtttgatccggctcaggatgaacgccggcggtgtgcctaatacatgcaagtcgaacgcgttggcccaactgattggacgtgcttgcacggaattgacgttggtttaccagcgagtggcggacgggtgagtaacacgtaggtaacctgccccaaagggggggataacatttggaaacagatgctaataccgcataacaatttgaatcgcatgattcaaatttaaaagatggcttcggctatcactttgggatggacctgcggcgcattagcttgttggtagggtaacggcctaccaaggctgtgatgcgtagccgagttgagagactgatcggccacaatggaactgagacacggtccatacccacgggaggcagcagtagggaatcttccacaatgggcgcaagcctgatggagcaacaccggtgagtgaagaagggtttcggctcgtaaagctctgttgttagagaagaacgtgcgtgagagcaactgttcacgcagtgacggtatctaaccagaaagtcaggctaactacgtgccagcagccgcggtaatagtaggtggcaagcgttatccggattattgggcgtaagcgaggcgcaggcggtttgataagtctgatgtgaaagcctttggcttaaccaaagaagtgcatcggaaactgtcagacttgagtgcaagaagaggacagggaactccatgtgtagcgggggaatgcgtagatatatggaagaacaccagtggcgaaggcggctgtctggtctgcaactgacgcggctcgaaagcatgggtagcgaacaggattagataccctggtagtccatgccgtaacgatgagtgctaggtgttggagggtttccgcccttcagtgccgcagctaacgcattaagaactccgcctggggagtacgaccgcaaggttgaaactcaaaggaattgacggggcccgcacaagcggtggagcatgtggtttaattcgaagctacgcgaagaaccttaccaggtcttgacatcttgcgccaaccctagagatagggcgtttccttcgggaaagcaatgacaggtggtgatggtcgtcgtcagctcgtgtcgtgagatgttgggttaagtcccgcaacgagcgcaacccttgttactagttgccagcattaggtgggcactctagtgagactgccggtgacaaccggaggaaggggggacgacgtcagatcatcatgccccttatgacctgggctacacacgtgctacaatggacggtacaacgagtcgcgaactcgcgagggcaagctaatcttaaaaccgttctcagttcggactgcaggctgcaatcgcctgcacgaagtcggaatcgctagtaatcggggatcagcatgccgtggtgaatacgttccgggcctgtacaccgcccgtcacaccatgagagtttgcaacacccaaagtcggtggggtaacccttcggggagctagccgcctaaggtggggcagatgattagggtgaagtcgtaacaagagccgtaggagaacctgcggctggatcaacctcttttaagggaattaatcggaaacctgcacattcgttgaaactgcgttcagttttgaggggtctacctcagcttgtactttgaaaactaaataatatttatttctttatcacaattaaacgagaacacgccgttatttggagttttattaacgaaattaatctgcatactcaataactgaggtgatcgtaagatcatcaaggttaagtatgaagggcgcatggtgaatgccttggtactatggagccgatgaagacggactaacaccgatatgcttcggggagcggtaagtacgctttgatccggagatttccgaatggggaaaccaatcatcttagtcgatgatgcctgagcagtgaatacaagctgtcaggcggtagacgcagtgaactgaaacattaagtagctgcaggaagagaaagaaaatcgattccatgagtagcggcgagcgaaacgggaagagcccaaaccaacgagcttgcttgttggggttgtaggactgaacatttgagttaccaaagtgcgaagagttgaaggcttgggaagcagacgccaaagatggtgatagcccagtaaacgaaacgtcacatctcagttcaggatcctgagtacggcgggacaacgtgaaaccccgtcggaatcgcgaggaccatctcgcaaggctaaatactccctagtgaccgatagtgaaccagtaccgtgagggaaaggtgaaaagcacccggagggtgagtgaaacagttcctggcaaccattgtgcctacaagctgtcggagcacatttacgtgtgacggcgtgcctagtgcagaatggaaccggcgagcatgatgcggcaaggttaaggtggaaaaaccggaggcgcagcgaaagagacgtcgaaatgggcgtacgaagtacgcagttatgtacccgaaacaagcgttgacctacccatgtccaggttgaaggtgcggtaaaaacgcactggaggaccgaacccgtgatcagttgaaaatgtttgggagaggtgtgggtagcgagtgaattccaaacgaaacttggagaagctggttttccgccgaaatctctttaggggggcctccgagtttagaatcatggaaggtagaaagcatctgtttggactaggggggcccgtcatggtgttactgacttcagataaatcgaaaatgccattgattttatcgcggagtacacaggtgagtgacccccgtagatccatcgggaaaagggacagccagattcatcagctaaggtccctaaatatatgctaacgtggaaagatgtggacatttgcacagacaactaggatgttggctcagaagcagcccatcatttaagagtgcgtaagagcgccactagtcgagtgatctttgcgcgaaatgtaccgggtgctaagatataccgaagctatggatgctccatcaggatggtggtaggagagcgttcaagggcgatgaacgtcagaccgtacggactggtggagcgcttggatagtgagaatgccggtatgagtagcgaaagacaggtgagaatcctgccaccgaatgactaggtttcctggggaaggctcgtcctcccagggtagtcgggacctaagtcgaggccgaagaggcgtagacgatggacaacaggtatgatattcgccttgtggctaccagttgattgttgctgagtgatgggagtgacgcagaaggctaagcgatccggacgattgaagtgtccggccaagcagcaagtcagtgatgagtcaaaggattagcagcgagttgacaagctgtgatggggagcgaaatatagtagcgaagtcgttgatgtcacgctgccgagaaaagttctagcgaataatcaaactgccccgtaccgcaaaaccacacaggtagtcgaggagagtatcctaggtgagggcgagcgaactctagttaaggaactcggcacaaaattgaccccgtaactgggagaaggggtgctgatcgcaagatcagccgcaagtgaaaaggcccaggcgactggtttatcaaaaacacaggttctcgcaaaatcgtaagatgaagtatagggggctgacggcctgccggtgctggaaggttaaaaggaagagttagcttcggcgaagccctgaatttgaagccccagtcaaacggcgccgtaactataaacggtcctaaggttagcgaaattcctgtcgggtaagttccgacccgcacgaaacgtagccgtaacgatcggggcactgtctcaacgagagacgccggtgaaattgaattgcctgtgaagatgcaggctaccgcgaccaggacggaaagaccccatggagctttactgtagctgatattgagtgcttgtactgcttgtacaggataggtaggagccatagaagccagacgctagttttggcagaggcgttggtgggaactacccttgcattatgatcacttaacccgccaccatgatcgtgggggagacagtgtcaggtgggacagtttgacggggcggtcgctctccaaaagataacggaggcgcccaaaggtgcgctcagaatggttggaaatccttcgcagagtgtaaaggcaaaagcgagctgactgcgagacagacaggtcgagcagggacgaaagtcgggcttagtgatcggtggttccgcatggaagggccatcgctcaacggataaaagctaccctggggataacagggcttatctcccccaagagtccacatcgacggggaggtttggcacctcgatgtcggctcatcgcatcctggggctgtagtcggtccaagggttgggctgttcgccattacaagcggtacgcgagctggggttcagaacgtcgtgagacgttcggtccctatccgtcgccgggcgtaggaaatttgagatggactgtcttagtacgagaggacagggatgggactacacctggtgtaccagttgttccgccaggcatcgctgggtagctatgtatggatgaggataaacgctgaaagcatctaagcgtgaaactcgcctcaagatgagattcccattccttatggaagtaagactcagagatgagaggtagataggatggacgtggaagtgccgcgaggcatggagcggacctcattactaatcggtcgaggacttaaccaagtttatgggtgtttcgattgaacggtgagaagatagatattgttggtagtttgagagtgcaagctcaatctgaaaggattagtgtggtgatgatggattgaaggatacactgttcccatgccgaacacagaagttaagcttcaacgcgccgaagtagtgggggatcgctccctgcgaggatagggcattgcacagcccatatacgaagtgtattagctcagttggagagcctatgccttacaagcagagggtcacaggttcgagccctgtatcctccatttttgtttattgggctatagccaagtggtaaggcaacggtttttggtaccgtcatgcgctggttcgaacccagctagcccaacttgagccgttagctcagtcggtagagcatctgacttttaatcagagggtcgacggttcgaacccgtcacggctcatcaacttaatagttatgcggaagtagttcagtggtagaacatcaccttgccatggtgggggtcgcgggttcgaatcccgtcttccgcttttatcatgcacccatagcgcaattggatagagtgtctgactacgaatcagaaggttgaaggttcgactccttctgggtgcacttttcgggaaatagctcagcttggtagagcacctggtttgggaccagggggtcgcaggttcgaatcctgttttcccgattaacaatgaaaattgttatcgcggtgtagctcagctggctagagcgtccggttcatacccgggaggtcgagggttcgatcccccctgccgcgataaatgggtctatagctcagttggttagagcgcacgcctgataagcgtgaggtcggtggttcgagtccacttagacccataacttgcaaaagttgcttttatgatcatgacccattagtcaagcggttaagacaccagcctttcacgctggtatcgtgggttcgaatcccgcatgggtcacttaatttattatcgcggggtagagcagcctggtagctcgtcgggctcataacccggaggtcgttggttcaaatccagcccccgcaattttggtccgttggtctagttttggttaggacgcatccctgtcacggatgagatcacgagttcgagtctcgtacggaccgtaaatggctcggtagctcagttggtagagcaacggattgaagctccgtgtgtcggcggttcgattccgtcccgcgccactagccattttattatcgttcagccacgttatgataatggggctgaacgattttttctttttctccaaaaattataaaacgacgcagtcagtaaatgatcactgatgttttttatgcttatgaaagcgtcaaatacgaattcgctattgaaagattgatgtccaaatagcttaggtgaactatccatcagcagcttttgcacgataacataatgaaaaacacgctgtcctaaccttggtatggctagaacagcgtgtttttggctgctggattatttctgcttgtcttttaaaagctcaacgatttcagctaaatatttttcctcagcacttggttcaggatcagccggtgcctcatcgtgacttggcatcagcttattgacaaacttcaccaataaaaagacaacaaaggcaatgattaagaagttgatgactgagtttaaaaaggccccatagtggaagtgcgcgtcgccaaaactaaagaccagattagaaagatcaatcttgcctaagaagattccaatcaatgggttgatcagattcttaaccagcgcattgacgattgacgtaaaggccgagccgatgattaccccgacggccatatccatgacattgccgcgtgaaataaattccttgaattcctgcaacgtttttttcattaaagtatctcctgttattcttagagcaacagtaagattatatgctaaatcaactaattgagcaattaaaaattaaatttagtatccatataattaaaaatattatagttattaaagttaatcaagtgactaattattgcttgtaaaattaagaaggttgattgtataatattagaaatttttaatttaagagaggaattctaattatgttcagtcaaattggtgaactcatttttaataatgaggccgttgctaagacttctgattttacaatgggattggaagtcgagatgcagcgcgtggatgaaaccggcaatgtcagtcaagaaccgtatccggccgcgattggcgatgaaaagaccaatccttggctgaccaatgactatttggagacgatgcctgaaatggtaacaccggctgccagccactcattggatgcaatgcattatctttataaaatcaataatgctctgcgtgcggccctggctcctggtgaactgctctggccactgtcaatgccgcctaagctgccagctgataaatcacagctgcgtttggcaaagatgggaccaaaaaaagaggcctatttgaaagaatggaccaagcgtcacagctattcagagggaacgccatgcggagtacacattaatctaagcattgatcagcatattatcgatctggtcaaagcaggctttcctgataagtttaaggacgaaaaagcagtacgcaactatctgtacgcggttttggcacaaggattcgttcgctatcgctggtttattacctatctgtttagtgccagcccaattgctgaggccaactattttgaaaaagggcaggggattgaccatccagttcgcagcattcgccaaagctcgtatggttttgggaccaaatttcagggtgactatacggatgtccaaagctacgttgatcgaattgaagacggggttaagcagggaattttgacctcagattatgaatttcacggcagcgtgcggttcaagggcaatgccaacctaaaagagctgcccaagactggggtggaatatattgagctgcgcatgctggatctggatcccagcagttcagttggtgtcagaacggatacactgcgttttattcgtctgctggccagttattttattatgcacccagccttgccgcttgcagaggttaatcgagtcctggataatgccgacgagatgaatgatgtggtggctaaagaactgccaactgaaccttgtcattatcaaaacaaggctttggcaatgatcaagagtctggagcgctatgccaaccagattcaactgggaccagaattttccgagattttggaggatctggaagaccgggttatcaatcctaaaaccacaccaagcgctaagctgatgaactacatcgaaaacggttctttagaaagctatgcactgcgccgggcgcgtcgctatcaagaagcggccatggaatcgctgcatccgttccagggatttgccggtgatcatattccaaatgccgatgagctgaagcgagaacttgataaatagacgaatttaagattagacataaaaaacggcactgccagcttgaagcttatgcagtgtcgtttttatgctagttgttttgattatcggtatgatgacgcttggctgcaaccttggctgagcggcggataaagtcgccaaacaaggcctgtgattcgcggtaatgcttatacatattttcaggatgccactgcacggccagaatctgatcactgtcactcgattctagggcttcaatgactagatcctgcgcgcgggcagcgaccttaagcgaaggcgctacccgatcaatggcctggtggtgtcgcgaattgatataaggatgcttgccgatcagcttgtagaggcgactgtccaggtcaacgtcaatatgatgcgaaggcagattgcctggggcaccttgaacatgttttaaatgagcgtctggattctcagaaaggtcttgatacacggttccacccagcccaatgttgatcagctgcataccgcggcagattcctaaaatggccttgccggactgaaccgcccccttgagcagtgcaatctcaaacaggtcccgtttacggtaggtcattcccagattcatgtgtggctcttgaccgtaaaatgttggatcaacatcggccccgccagcaaagacaatcccatcaaaagtctcgagatattcaggcgctaagtcgggctgcacgcttggaaaaataatcggcacgccccctgatttaacaacggcttcaataatcggccgcggcgcaaatggagcattgcgctcgttgataacgttggtggcttcagtcaaggttgcggctggaatcgcaatttttggtttcattagaaaaatcccccatttgcaaaaatcttattagaatgaacttatcatacttaatcagaaaaagtacagttaaatgctgaaaaatattaaaaaaagatgataaagcgattagtgaaacagttggtgccagttggccgttgcttttaatttttttgaaaattggtcgtaatcgctgaaataaaggcatttggtaactagaaagctgaattttcataacgatttactaaaaaaacgcaattgacaaagtgaccaacagcgagtatctttatttgcgatgaatgaatgtcctttaagtttagtccagagaggctagcaaggaaacgaattaaattgcggcatggtgaatgctgttttcgttgaacgctgccctcaagtaagggtggcgtttttttaagggcaaattcacaaaggaggatttttgatccgccatttaaaggacgacagtgagcgtccaaacggttactcgtgaatttaaggaaggattttttcaaatgttagaacctatgaatcttgtccgcttagaaaactttgtcagcgtagaagatctgtcggctgatgaagtcaacgctttgattgctcgtgctgaatacttcaagcgtggtggtgccgtgccaaagctgaacaaaccggtctatgtcgttaacggcttctttgaaaactctactcggacgcataccagctttgccgtggctgaacgtaagctgggcttgacggagattccatttgatccgacgcattcttcagttaagaagggtgagacgctgtacgacacgatgttgacgatgacggcgctgggaattgatctggcggttattcgtcacagtgaaaacaactactatcagccacttatcgacaccaaggaaggcgaacaggccaacattggaatcgttaatgccggtgatggttcgggccaacacccatcacaatgtctgctggacgtgatgacgatccatgaacagtttggtacctttaagggcctgaagattgccattatcggtgacatcagccactcccgcgttgcccgcagcaatgctcagctgctcaataagctgggggctgaagtctacttctctggtccagaatactggtttaatgaagactttacgcagtatggtcaatacaagccggttgacgaactggttggcgagatggatgccatcatgctgctgcgggttcaacatgaacggctttccaatgatgatgctcacgaaaaggacttcagcaaagaagcctaccatgaaaagtacggcatgaaccaagatcgctacaacaagatgaaagacaatgccatcatcatgcacccaggcccaatcaaccgtggcgttgaactggccagtgaactggttgaagcacctaaatccgtcttcttccgtcagatgcaaaacggggtcttcatgcggatggcaatgatcgaagcagttctgcgcggtcgtaagttgggtggtttggaataagatgacgacaaaactgatcaagggtggtacggtctttgtaaacggccaattggttaaaacggatgtccgaattgctgatgacaaaattcaggcaattggcaacgatctgccggccgccgatgaaacgattgatgccaccaataaattagtagcaccaggactggttgacgttcacgtgcatttcagagaaccgggccaaacctataaggaaacgatcgaagccggcagcaaggcagctgctcatggtggttttaccacggttggcgccatgccaaacgttgatccggtacctgacacgccagcacgcatgcaggcacagacttctttgaatcaaaaagaaggggtcatccatatttttcaatatggtgcaatcacgcatggacggaccagtgaggaactggttgactttcatggcctcaagcaggcaggcgcttatgccttcagcaacgatggcagcggtgtccagacggctggcaccatgtatcaagccatggaaggcatcgccaaagaaaagatgatcttggcggcgcatgttgaagatgattcgctgctgtttggcgggatcatgaatgctggcaaacgagctgaagaactgggactgccgggtgcacccagcgtttcggaatcggctcaggtggctcgggatctggtcttagccaacgcgacgggggttcactaccatatctgtcacgtttctaccaaggaaagcgttgcgatggtacggtttgccaagtcacagggcgtcaacgtaacctgtgaggcatcaccacatcatctgttgctggctgatcaagacatcccggccaataactcatattacaagatgaatccgccgctgcgtcatgaagatgatcggcaggcgctgattgagggactgcttgatggtacggttgacgtgattgcgactgaccatgccccacattcacaagctgaaaagccaaaagatgacatgcggggggcagctaacggtattactggcagtgagacggcttttccgatgatgtataccaaattcgtcaagggcggcatctgcaccttggaacagctgctgaactggatgagcaccaacccagctgacatttttggtctgcatgaagctgggcatctggaaccgggcaagccagccgatatcgtgattttcgacttgaccacgcagcgaacgcttaatgaagctgattatctttccaaaggcgtcaacaatccgtttaccggtgagcaggtctatggcacggctgatctgacgctggttgatggtaaggttgtctatcagcgataaaactattaaattcaaaccagatcgaaaagagcggtctggtttttttacttctcaaacatttgttcgcaattgagaaacgtgttaaaatgagataccaatccagaattaggaaaagaaaatggtgaaagctttgaaaacgataacttggcaagacatcatccgaatgcttaacagtgatgtctacttatatgaattaggtcgtaaatggggaaacgattttttaacttctgaacagcaggctgccatgattcgcaaatatcaaaacgaactgctagacctgcaggatgatctggcggactacacgagcttgccgctacctgacagtgcaactttgattggtatttttatggcgcgctgcgtgattgcggaactgatcaatcaagagccggttgccagtgatgagattttaaaggttgattatagtgccaagccggatcagtttgattctcgttggacgatcacgatctataatccggttgctgatgaagagatgattggcgtagcggagctctcctatgctgagattttggggatgcgcgtagcaatcgatgatgatactgattttatggccgggctggctgttttattcaatgagattaccaaatcaggactttatgactgggagcgcagtgcggtgatctatcgtcagaatgccgagcagcgggcagttgaatccgctatgtatgattttatggagcagacgcagcaaatcgcgctgtttttcgatgagtacgtggccagccatcccgatgatccgaatctgcccgatgagattgcacttttttggccattgactaccggcattatggcgccattagatgctgatgatccagccagtccgctgatttcaacaatgcagctagatcccaagctattggctaggttcaagctgcggtttggccaagcgtttcgccgttttaaaggtgaatagtcttttacagcgataacattcgtgtttttctgatttaaccgtctgaaatatcggaacgctattaaaaattattaaaattcacttctattaatgattgaatggttaaaaatgttcgctcaatatgttaagataaatataatcattttctaagcagattttaggaggaacattatgcgggcgattttaaccacgattggcaaggataaaaccgggatcattgcaggggtcagcagctatctggctcaaaatgacattaatatcgtagacgtctctcaaactattatggatggatactttacgatgatgatgatggtcgatgtagacgatgctgctgctgattttgaaaagctgacccaagaactggatgctttaggcaccaaactgggcgtcgacatcaacattcgcaaccaagaaatgtatgacgctatgcaccagctataggaggcctgttttggaaactgaaaagattatggaaacggttcgcatggtctctgaggaaaaacttgatctgcgaacgattacgatggggatctcgctgcttgattgtatcgacagcgacagtgatcggtcctgtcaaaaaatttacgacaagattacgaaaaaggccaaggatctggtgcgggttggcaaggaagtcgaaactgaattcggaattccagttgccaacaagcgtatcacggtgacgccgatttcattgattgccgcggcctctggtgatcacgactatgtcaagtatgccctggctttggatcgagctgccaaaacggtaggcgttgattttattggcggctattcagcactggttcaaaagggataccaaaatggcgacaagacgctaatcaagtcgctgcctgaagccttgacgcagactgacctggtctgtgcatccgttaatgttggctccacaagaacggggatcaacatggatgccgtcaaggaaatgggggaagtcgttaaagaagcttccgaactggactacatgaacaatgccaagatggtgatcttctgcaacgcggtcgaagataatccgtttatggcagggggctttcatggcgttggcgaatcggatgtcgtcatcaactgtggagtctcgggtccaggggttgtcaaggcagcccttgaaaaggttaagggcgaatcaatggacgtcgtagccgaaaccatcaaaaagacggcctttaaggttactcggatggggcaattggttggtaccacggcggccaagcgtctaggcgccaaatttggaattgttgacctttcattggcccccacggcagcgattggcgactcaattgccgaaatcttggaagaaatcgggctttcaagcgttggcgcgcatggaacgaccgcagctttggcaatgcttaacgatgctgttaaaaaaggcggcattatggcctgcagtcatgtcggcggactttccggcgctttcattccggtttctgaagatgctgggatgatcaaagccgtgaatgctggctacttgaacgtttccaagctagaggccatgacggcggtctgctcggtcgggcttgatatgattgcagtaccgggtgatatcgaagcttcaaccatcagcgggatgattgccgatgaagccgcaattgggatgatcaatgccaaaacaacggcagtccgggtcattccagttcctggcaaaaaggttggcgatacggttgaatttggtggtctgctgggctatgcgccaatcatggatgtcagtcacgcctcttcagcagccatgatcagtcgcggcggcacgattccggcaccggttcacagctttaaaaattaacgataatgttaaagatcgtacttgtctggttaaattgacaattaacggtcttttttttattattaaatgagaaattgcggatttatttagaatatggtatcataattctaatatttttttaatttagaattgggagtggagaatatgagtgtccgggttcgcgacctattgaaactgccaaccctgtcgcgatcacacatcgcagcaggcgaagcagggctggatcgaatagtttcaacagtatcggtaatcgactttacagcgacgtcggtggcccaacgagaactctatcagccggaaaattcggctaatgaacagctgctgctgacctcaattgaacaagacaactatgatctggtaacggattgcactaaaatcgaacagctggccaaaactggttgtgttggcgtggtaatttattatgttggtgagcgggtaccaagtctccttactgaaatcaaggaaacggctgatcgtctcagatttttaatgatttttgcccaggaaacgcaaaagaacatgacctatagtgccgttatctctgaaatcatgtttgcgattttccaagatcggatgcgtcatcccagctttgcaccgacaattatcggtcgcgtttcggcaatgccggaatatcggcgcagcgttggcgaggtcctaaagcttttggccgaacagatacaggcttcattggcagttatcgatgaccaaggcgagatcgtgtatcgtgaaaactggcctaaagaagcggttgtcaactgggaaagtctcttgaacgtggttgaaaaaattaatatgaatggcgagctgccggtaactacatctgatggtatgaagattacgcattggcgcttgccaaacagtgaggagacggtcttgttcgttggccgccagacggtaaccaatctgacgtgcgagcgagtggctgaaacgctgcagacggccttgaatctttggggcgggcagaatcaagatgatcaaaatctgattcgcgccatcattcaaggacagatcgttcgggccgccaaacttggtcgccagtaccgttttgagcctaaaaatacgcaggctgccttgattgtcagctgtccgaatgacgttaacaaagctaagatgaaaaaatgggttgatcaactgactgagcaatataccgaccagctgatcagtgactggtataatgaccaattgatcgtattgttggaaaagacgccttcctatcaaaactggcagaattgggaaactgactttaagaaggacgatcatcaattggctgctcaatgtgtcgtagtcgaagccgccctggttgatggcgttggcggcattcaaagactgtatcagctggtcagtcaatacttgccagcggcccgtacgatcttgccatatcgcttgtttttgaatcaggctgatttagagtttgcgcggggctgtcaaagagagctgcaggaagaaggcactgaggtcattcgttggcaaaaacggttggactccatgcagcataatctggtagaaacactaatggcctttttgcttgatacgccacagaatatagagcaggctggtgatctgctttacgttcaccgaaatacgatcaaataccggctgaataagatcagcaatcgatttggctttgttcccggcgtcatgcctgaatcattcgagctctaccaggctttaggcgtccatcggcttttgcgcggcaatgatgacccaggcgaattaggcgaataaaacaagtgcaatggaaaattttagttgacatgcctaatgacaagcggtgattttattcgtataatattgcgtatagttagaaatctatctgcgaacgtagacttctaattagctgtcagcgtcggcaagcgctggcacacttcaaattttcctaattccgagagtagctagagaaaaccttgatataaaggctttccggctacttttttattttggtcaacagaaacatgctgctgatcaagccggctgagcgattcgctagattaaagcattcggcgaccagccgttttaatttttgctgaaaagtgagtttcaactcaccttaacgtccgctataatgagtgcatactcacttaatgaaaagagggaaacaatggaaaatacgattgcaattaccgacctccagattggctatcagcaaaaacccgtagtcaaaaacatcaatcttatcgttcgtcctggtgagattcttgggctgcttggtcccagtggttcgggcaaaaccaccttgattagggcaattatggggatgatcaagccaatgagcggcacggtacgcgtttttggccaagccatgccgaatcgacacctgctggaaaagattggctatatgggacagacggatgctctatacgatacgcttacagcccgtgaaaatctccagttctttgccagcctgcgcaaaatgccgcatcagcagactgttgcggagattgagcgagttgcgcgggtggttagtctgcagtcgtttctggatcgacgcgtggctgacttttctggcggtatgaagcggcggctctcattggcaattacgctgttgggaaccagtgagcttttgattttggatgaaccgaccgtgggaattgaccccgagctgcggatccagatatggcaggagttaaagcagctggcagcagccggcaaaacgattctgatgacaacgcatgtaatggaggatgctgaacaggccacgcagcttttgatgattcgaaatggtgaggcgattgctgccggcacaccgcttgatctgaaacagcggtatgccgttgataacgttgaagaagtattcttaaaagcagggaggattcaagatgcgcatcttagcagtctttaagcgagttattttggaaatgctgcgtgatcgacgcacgctggctttaatgatgtttggaccgttgctgatgttgtctttgatttgggcgatgtttcagaccaatgccacgcaaacgaccgtcctggcgacacagaatgtcgatgcttcattggttaaggcagttgacggcaccaaacatctcaaggtcgtcaaacttgccaaaaacgaacggcaaacgccacgccagctgatcaggaaaagtgattacgcgggcgttttaaaagaacatgatgataaattaacgctgacattggcgaataacaatccgtcgcaaagcaagctgattcgccaaggcctcagtctggctaagatcaaactggcactgcagaaccagacatgaataatcaaacagcagcaggcaatgctccaaacactgcttgctcaactaccagcgacaggcaggcagctatctgttggcggtcagtcaacggccgagaaaaaagttgcggttaagtatctatatggcagtgccgcttcgacttatttcgatgcgatttttccaattatgatcagttttatcgtgttcttctttgtttttttaatttcaggaattgcactgcttagagaacggacacgcggcacgctggatcgggtcttggcaacaccgattcgtcgcggtgaattgatcggcggctatatccttggctatggcacgttcgcgatcgtacagaccttgatcatcgttggctttagcatctggatttttaaaatgcaggttttgggcagtttcagcggcgtctttttaaccaatattctagttgcgttggttgcgctcaccttaggtcttttgatatcggcatttgctcaatcagagttccagatgatgcagtttgtaccaatcgtcgttattccgcagcttttattctcaggcttgattccgtttgataccatgccgcattggttgaagctgatcggatattgcactccgctttattatggatccacggcgatgaccgatattattgaaaaaggtgctggtctgctgcaggttggcaatgaattgggcagtctcattgtatttgccgttttatttatctgtctgaatgtggtatctttgagaaaatatcgtccagtttaaaggagctgttgagatggctgaagatatttttgaaaacatgctggctaagatggatataacccagcgtcagcgggcagtattacgagccagcatggagctgtttgccacgcagggatttaaccagaccagtacgcggcagattgcccaaaaagccggtgttgctgaaggaacggtctataagcagtttaagaccaaacaagcgattttaacggcgattctgacaccgattcgcgaattggtaattcctcaagtagcagttgatttcgcacaaaatgtcttgacgcggcaatatccggaattaaacgacctggttcatgagatttttttgaatcggctggagttggttgataacaatcgcaactttgctcggttaatgtatggatcgtttttggaacagccacatctgcgccaagaagtagttgatgcctttgccaaagttgccacgcccttcattgaagtatttgaatactatcaaaagcagggcaagattcgtgaaggcctgacgatggaaagtatcgttcagttaatgatttcaacgattttgggctatacgaccaggatgattttatttggtcagcactttgatccgcatacggcagctgatgaaggaacgagtctggtcatgcacggcatcgccaattcctagctgttattgctgctgatttatgccgtatttgaaatcagactgaacataattaaaaccgcccgtttcttagtaaagaagcaggcggttgaatgtatcattaacattagaaacaagcatcacttgacaataacggtaagtgatgcttttgactttaattgatagctttagcgcggtgctgtgtcagatagaccaacaaaaagtccagcagcagggtacagccggtaatggcaaagacggctgaatagctgaacaggccagagatggttgagccgagcagcgcgcccaagacagcgccggcagcctggaatgattggttatagctgaagatgcgcccaaacgcctcggttggcacttccaacgtcagaatcgtctgcgcagccggcattaaagcagcattggcaaaaccaagcaagaagcgccagaacgcaagcatccgaggcgaattggtcaaagtcatcgggataaaaagcacggccgcgacaatcagtccagtcgtcaaaacttttttggggccgattcgatccatggtatgaccgactttagaagcagccaccagatttcccagtccgggcgtggcagcaacgataccggcaacaaaggcaatattgccggtatcatgcatcatttccttgacataaagcgatacgatcgggttaatcgacatcactgatgattgtaccagcatggtcgtgataaacataaccacgatcaattggcggttgtcgatttggcccatcaatgcctgtattggcttcatgttctcttttttgatcggcgtaaatttttccttgactaaaaatgaagtagcgataaaaacgccaaacatcaagccgccggtaatgaaaaacgggattcgatagccccaggcgccagacaaggctccacccaaaagcggtccaatcaggttgccggtaaccccggccgtcgtcatagccgacattacccagcctgatttgctgtgcggagtctcaccggccatcagcgcgatcgaattattgatatacccagagaacgcgccctgtaaaaagcgcatgccgataatcatccagacgttgaccgaaagcccagtaataaaaatcgtgcatgccatgacgccagaagctcgcatacacatcagtttgcggcccttgcgatcggcaagactgccccagtatggcgagacgattgcctgggaaataaacgtggcggcaaatgccatccccgaatataagttgagctcaaaacgagagaaatttcccagctcattgataaaaagcgagataaacggcatcgtcatcgagtatcccatcccggtaacaaagcagcccagccaaagcgtataaaaggtctggtgccatttgctgggtaattcgtgatgggtaccgatgtttgagtcttccaaaagatcaccttccaaacagattgtagctaaatcaatgagcaggcttagatccgctgatgattctgccagctaaggtagcgataaaagatcaccagcatcaaaacagccaggacaacggttacccacatggcagctcgaacgcccatcgtcaaagaagccggcaaaccggagataacgaccagaagcgtgactgaagctgccccgcaggcttgccgcagcgtattgttaagagccgttccgtgactgttttcttggggtgccagctgcgagaaggcttcggaaagagcagggttgaacaaaaatgagttgccgatcaatcgaatcatataggcaacagtcaagacccagaccggcatgtgggcactgacatgaaccagcggaatcgaagccaaaagcgtcaagatgccgccagtcgtaatcagccatttaggaccgtattgatcgtagagccgaccagcaattggcgcaaacaaggcattacagatggcgccaggcaacagaattaaaccagattcaaagctgccgatatgcatcacgttttgagtaaagatcggcaacagttgctcggttcccagcagaatcataaatgcgcagcagccgactgccgtcatcattcgaaacgaagggtagcgaatgatctggactttcagcattggatcggccattcgcagctggcgtttaataaagaaccagataatgatcagcccaatcagcagcatcgccaggccaatcagcaagttgagctcaaagacggtcagactgcctagaatcagtgatgatccgattaatgagatcaagaccgacaccagatcgatcttgatggggcgtggctgagaaaagttgggcatcttaaagaacgcgcccagccataccaaaagcattaatggcaagacaaaaataaagatatagcgccatgagaagtattccagaatcagtcccgataaagaaggtcccaaagctggtccagaagcaatcaccagaccagacattcccaaaacggaaccgcgcttttcaggtggatagatggtaatcatcgtcgtcatctgaaacgtcattaagattccgccagcgcaggcctgaaccaagcgtgccaatagcagcagccagaaattatttgcaaagcagccaatcagcgtgccgatgatgaaggtcccaaccgttgataaaaagacgctgcggttggtaaagcgttcatagatgtttgacgataatggcgtgataaccccgatcagcagcgtgtagccggtcgtcagccattgagcggcatttagcgaaacgtgcagatcgtttttaatcactggcaaggcggtaaccatcatagtttgacttgccagactgatgaaactggcaaccagcaggatgatcgttacgctgtggcgagtgcgcgcgtcgatattggttgcggacataacagacttcctttcataaaatatcaagcaacaaaagtagattaaagatataatttcataccaatctagtctagcattgaaagcgtcatgcaaaacaagtccacctggatgatttttcgatttttttgctcagaggtcagtcaggtttgatatgattgttcttgtgaataaataatgaggtgacatgatgagcaagcgaatcgcggtattttccgacgtgcacggcaatctgcatgctttgcaggcaatgtatgcagacagtctgcgccatagtgttgatgaatattggtttattggcgacctgctgatgcccggcccaggcgtaatggagatctggcagctgattaaaaaaatgcagccaagcgtaatggtacgcggcaactgggatgatttaacggtcaagggcgtgcggggacagatggatcttgaaaagccctcgcgaatctattttgctcgtttggcacagtacgttggcgagcatgtttccgccgctgtgattgatgagattgccagttggccgctgcatgttcaaaagcagactggcaaattaacgtttggcatttcgcataatctgccgacgctcaacatggggcaggcgctgtttcctaccaatccagttgagcattttgatcagctgtttgaaaatttcgatcagcaagacgtggcgatctatgctcacgttcatcacagtctgatgcgctatgccagtgatgagcgcttgatcttgaatccgggatcggtcggagagccgtttaatggctggtggccgctgcagcacgatacgcgggctcattatctgatcttggaggttgacgatgatgggattgctgaattggactatcggcacgtaccttatgatcgtgaatcggaatatgagctggctgttgaatcagatattccttacctggaactttataagcggacgcttgaaactggccgggtcaatacgcatgatcaagagctgcttgatcagatcaatcgcaaatgggactatctggctgagtatcaggcttatgccaaacgagttaagaagcgttcctgacatattgaccaactaatggtcgcttttttgccagattccaatttaatctgatttaattacaaaaagtaaggcaaaaaatttgcattcaaaaacgcaaattggcataatagccaacgaatgactatgcaaatgtaaaaatcttatttttaatcaaaatctacattaaatatggagggtagaaaatggcaaaaaagtctaagattgccaagctcaagcatcaagaagcgctggtcgaaaagtacgcggccaagcgcgccgaactgaaagccgccggtgactatattggtctgtccaagctgccgcgcaattcggcaccggtgcgcctgcatcaccgtgaccgcttggatggccgtccgcatgcctatatgcgcaaattcggcttgtcacggctgaacttccgtgagctggcacacaaaggtcagctgccgggcgtcaaaaaagccagctggtagctaaaaaggtccatggtctgaaatcgtcagccatgaacctttttatttttgcgagcatgctgttatcagccggttcgcggtatactaagcctaaacaatcttttaagaagtgaagtgaagctatgctgaacagattagtggagtggacggtgcgtttcaatcagcactcgtttatcaaaattacccggcagacattgatgctgctgtttccaatcgcctatgtcgggaccttggcagtgatgctgaaaaaagccttctttgccacggatagttttttctttaatattgccgatctgggcgacatcatgccagactggctttggacaggcattacggggctgacgggcggtctggccaagattacgtttgggatgtttggcgtgatggctgcctatgctgcggcccgctatactgccaaactttatcatcaggatgcaccgatggcagggatgaccggttttgccaccatgcttttgctggcctttcgctatacgcgtacaagcaatcccaacatgatctcatttgactggaatcttttgagcgtgcgcagtgtgttgtttgcgctgatcgttggctatggtgttggacaggtctatcgttggctgggaaaaggcggcgagcccagcgatcagacgattgagacgctggaaaaaatgcagcagcgggctctgaatgctatccgtccgctgtttttttcgctggcagtcggcgcggtcttaggagcgttgttcaactggctgacgttaagttcctggctggatcttgcctatacctggttggagaattttggtcagggcaatcagtcgctatgggtggcacttcctttgattgccgtttcgttactgatgagctggctaggcattggcggaccaacgatcaacatggctgctcagggattgaccggcgcggcggcggccaatctgaactacgcttttcagcatggctcaagctggaacgtgccatataaatgcctaacttctacgctttacagctcatttgccaactttggtggtgatggagtcatgatggcgttagtgattgccttgatcatcgtcggccggcagccggaaattcagcggttggcacgttggaacctattgccgaccctgtttaacagcagctatggcttgatgaccggtctgccagtaatcctaaatccggtctttctgctgccttatctcttgctgcccttggctaatcttttgttaggcgctttggcaaccttaatgcatctgatcccggcaacgccctatcctctgccaatggggactcctggaccattggcggcatttatcggttccaatggtgattgggaggcactgctgttttcattggtgctactgatttttgatgtctgggtatatatcccattcgttcggttggcgcttggtgctgaacttaaaacacaacagatcgaggcggtggcataatgctgattattaatgataaagagtgccaacgcagcatgcgcttattgatttttgtcgtagtcttgctgattgtcctggcgtttccggcctacttttggatgaaagacaacaaccactatctggcacagcgcagcaaggctcatatgtcgccggtcattatgattccaggcagttcggcaaccaagaatcgctttgataaaatggtgacgctgcttaataaagacaccagtcacaagcacagtctattaaagctggaggtctacaacagcggtaagattacatatactggcaagatcagcagtggcgacaacgaaccgattattgtcgtgggttttcaaaacaatcatgatggctatgacaacatcaagaaacaggccaaaatgtttgatgaagcctttaatgaactgattgatcaatataagtttaataattttaaagcgtttggtcattccaacggtggtttgatctggaccctatggctggaaaaatactactcagattattcagactatgtaaaaatcaaacggttgatgacggttggctcgccatttaatcttaatgaaagctcaaccagcaatccaacgcagatgtatacctactttttaaagcatcgtgataagctgccatcaagcatggatgtctactcagtttctggtgccgatacctatactgaagacggcatcgttaaattaggcagcgtaagagcggggcgctatatctatcaaaaacaggtcaagcattataccgagatgacggttaccggcagcaaggcgcaacactcatcactgccgcaaaatcgccagatcattaatttgattgaggaatatttactggacagtgatcagcctaatgccgtcaatagtaaaaataaacgggtaagtcacagctcttcagtttccaatccataaattatgtttgcaaaatccctctgcaaaaggttattctaaatgtgacgtgcagactggatacgcgtagtctgacaccgaaataaacagggggataacaatgaaaagacaacagcgttttgtcgagatcattctattattgttgctagctttagtggtttcgttttgggggtatcgcggctatcgatttatgcaggcgcatccgttgatcaatcgcgtctatcgctatcaagcatcatctgcagccaaagcagaactgaccagcacgccaaatgactatcagtatttggtatttggcgctggcagatatcggggaaaatacattagggttgataatcaaaaacagctgcgccgaattttaaatcatcggcaagcctatcaagcagcttttgatcaaaatggaacttgctacttggttcgtcaccatcagctacagcttgatctgggaaatgtctcggctggcgagagctatgttcagacaaacaagcaggcttgggtggctcaatcagatcggcatgatttagggcagacagtaaacgattcgttaaagctgacctcaatgcatgctactaaacaggcagtcagctgtctgccataggtttgggtaacacttactgtacaaaactaaataactatactagaggctgggaaaaaagtctcaaaacttaagaatcgttagaaaccacgttactgaaaacgttgatttccagcgatttttaatattactattctctaaaatttatctaaaaatatagttttttcccactctcttttattctttgtataataattcgcaaattcatggcttgtttacagaaattgaattgattaatttacgtttcgtacattaggtaggaatactaaatattatttttttaacgttgactatttgtatatattcatttaagaggctgaattatttgcatatattaaaatgaaattaaaatcataaaagctgattttgttaaaaaagcttttcaattgacagatgaatttagaagattttgaattcagtacgcgttttttgatgcagggtaaaaaaacacaatatgccagtgatgctttggtataccaagaagccatcgccaaggcccgccctttcattcggcaccgatcgcgggcacggcgggtacagcggctacggcaccaaccgcaccgactgactctggctacaagagggtagtggttgtcatcgttgttcatgttcattactctggctggtatggctataactaccgccaaagccgctccatgtattggctgccacgcgtacaccacagctggcactcattttatggatgctactgctaaaaaactcgtctcaaagggcataaaagccgcttgaggcgagtttttaaatggtgatggcttttcaatcaatgaaggagagctgaacagatttaagccgatcgctgctgatccggctaaaagatgtttttaaataaaaagaacaccaacggtcccaataaggatggcagcatatccagtgtcttgaactccttgatttttaacagcgagaagccagacgcggcaatcagaaagccgccaacgattgattcctcaaccacgaaggcattggaaaagaaactggcggacagaaacttggcgattaaatagatgccgccaaaccagactaaaacgatcggcgtttctaaaagcatcccccagccaaagccggtcccaaaaataatgccgcagaccagcgtcagcatggcgttggtataaagcatcgtctgattgccattggttgcggcaacgactggtcctaagatccctaaagcaccaatgcagtctaaaaagcttgccgtggccacgccttcgccaagcttagaggaaaaacgcgtgctgagccagtggttggaacggtcatccagttgccaataggtgcctagcgggatcccaactgccaggctgatgataaaaaggaccgggtagttgcttttaggcatgttgctgatgaccgactgcagtccaacgccaagagcagcgaagcctaatgctatccagagggtctcaatgtattttttctgtaagaactgcttaaaaaaacagccgattgcagtaccgacaactaccgcgccaacgttggcccagattccgatcatttaaaaaacctcgctttaagttaatctgccagactgagcagcatcagccagacattttgaacatacttaactattttagcttatttaatcgttataaaaaagaaattaccacagactctgaaacgatcaatcaaagagtcaagaagttgagtactgatttaaaaaaggactgacatgtgtgcaggacaccgtcagtcttttatcaagatgagattatttattacaggttttcatctgtgttaaaattcaaaggacagtaatcagtcattttggtgatcagttcgaggctcagctgacggtaggcatttaaaacgtcggttgcgaagttttctgactgacgcgtcaaatagttggtcagtttggcgccggccagaccagctgccttttcgtcggttgcctgaatcatggcaatggccttggcgttgcagtctttttgaacatcacgaagcattggcagaaaatcgtgcaggtgactgtcgactaaaacgctggcatgcttaaagatccagtatgccgagttgagctgagccggcagcttgcctcgtttgtatggtgctggggtgtcgttgatgttgctgaagaatggaacaaacgttgattcattggcaacccccatggcaatccagtgaatgctgtttttggaggcgcgggatgtctgcagaatgtgggcttcctgtgttttagccaggctgatgggacggtagcgatgcttttcttcatccgaaccggtaccgattggatcaaacggcgtcccttcataatgggagccaaggtaggcctgggcgtcaaagattgacagcttgcgttcaggcttcatcaaaaacggcaggtcggtagcttccggctgttcgttttgcgcagcttttggactgaacatttgatgaccataccaaacgcgcggctcactatagacggcatctgaacggtcagccgtaccaaagatctggcggaagttaaaggtaccagggtgcggattgaggtggttcttttcgacgaattcctgaatgccaggatggtacatgaagttgtctggatcgttaaaatcaatctcctggatggctaattgattggcaacgacagcatagcagtcatcgggaatccgctgggcaacccagtagtgaccagcgccagtctcaagataccaggcctcgtcatcgtcagcgaacaaaatgccattggtttcgccggttccgtatttggcaaccagctcgccaagtctttgcaccccttcgcgagcagtcttgacgtatggcaaaacaaccgtaaccatggcctcttcgtttaagccttctttaacgagtggatcatagcctaacaccagatcgttggaataggcgctttcggtcgcactcatggccacaccgtattcattgatgccggcttcttcaaataggccgtacttgtcggtccattctggcgttgccgtatagcgagcactgatcttaggcagcgacagctcaagtttggtatctttagaaacgaattgagatggcatctcgccgcgtgcgtgaacaaccaggcgttttggccaggctgccttggcatcttcattgcggccgatcatgattgagccatcgcgactggcctttttaccaatcagaatgctggtacatgccgatagtttttgtgacattttcaagtccccttatttggattttgtaactttatgtatttattttaacccaaacaatcaataaaattaaacaaaaagtggaggaaattaaataatggaacagctttcaatgtttattattatgttttcagccctgctgattccaatattgatggcgcgctttagggttgccagcgtacctaccgcggtggccgagattatcgtgggcatcattttgggtaaaagcggttttaatctggtcgtgcaaacccgtgacctgacttttttatctagcctgggcgtgatcgtcttgatgtttttgtcagggatggagatcaacttcagcttgttcaaaaagcggcctggggcacccaaagacaaaaagtcaccggttaatctggcggttgcctcatttgttggcatcatgctgacggcgtttattctcggaatggcattgaaggcaacggggatgttcaatgacgttctgttggcgacgatcatcttttcaacggtggcgcttggcgtagtgattgccacgctgaaggaaaaagaaatcctcagccggccgatgggacagacgattcttttgacggcggtcttaggcgagatcgttcccatgctttcactgacggtatatgcctcgatcaacggtggcaatgctgggcgcttatggatgatcgtgctgctgtttttggcggcgattctgctgctgcatcgcttcaagcagccatttatctggtttaacaaggttaccaaagcaacaacgcagctggacattcgattggctttctttctgatttttacgctggtgacgctggcagagacggtgggagccgaaaacatcctgggtgcctttttagccgggatggtaatgaaactgcttgagcccagtgaggccactcaagacaagctcacctcaatcggctacggctttttcatcccgatcttctttttgatgaccggtgtcaaactgaatctgcgcacgctgctgaccaattcgcatgctctggcgctgattccagtactggtagtctgctttattctggcaaagattacgccaatgctggtctttcggcagcgcttcaatgggcggaatgcatttgctggcgggttcctgctggttacgacgatcaccttggttctgccaacgctgcaggtcgcacgcaatctgcatgccattaccgcgacacagtcagatgcctttgtcttggcggcagtaattgtctgcattattgcgccaatcgtctttaactcggtctaccgtctcgcaccagaagacaagctcaaacagcgcgtcgtctttttgggtatgaacgtcttcagtgttcctgtcgctcagcagttgtcgcgtaactggtatgaggtacgaatggttacggacagtcaggacaattataaaacctatgacagtgaagttaaaaatctgacctatctgccggaactaagcgaagccgccttagaaaagggcaagttttttgactgtgacattatggcgattgactatctggatgatgccaagaatttccggctggctaaacttgccaaagcgcatcacgtcaaccgcgtaatcgccggtcaaaatcagcgcaatctggatgaggaccagcgcaacaagctgcaaaagatgggtgttgagatctttaatgtctacaacgtacaaaccagtgtcttacgggctttgattgaatcgccatctattatgacgatgcttaacagtaccgaagccgggctttatgaagtcgtagtccgcaatcgtcgttatacaggtcagcaattgcaggctctgccgtttatcgatcagatgacggtcagtcggattcgccgcgggacgcagtggctgattccacgggggacgacggtgatcgaacctggcgaccacttgatctttaccagtaaagccagtgatgttgccaatattcgggctgaactgcgcaaacgcaactaagataaaaccaaaacagtgctacggcaggctgatgattaagcttgcaatggcactgttttttatattgctgaaatcggctggcaacgggatgctggtttgattatttctgctcaaataacagagcacagataatcatgacggcagccagcccccaggcaactgctttaaagattcgcagtcccttaggcgtggtcttgatttctggatgacgtttccagtagatcggcattaaaacggccagcagcacacagccggttgcaattatccaaaacatattattcacctcacgtattcataaaaaactttaccatatattcagctgagattaacaatcattaatcatcttttggacaattcgcgattgataaagcctcagctcaaaaggtagccaccagtttatggggcaattaattgcactaaacggtgaaaatcgataaactaggatacgtttgcaagatttcatgctgtgggggaatttgatggaaaaaacatatatcgttgctgctcggcgaacgccaatcggcaaatttggcaagtctttggctggcgtttctgctgtagagcttggtgcaactgcaattgctgccgtcgtcaaagacagcggcgtaaccaaagaggccgttgatcaggttttaatgggcaacgtgattcaagccggtgctggccagaatccagctcgtcaggctgcaatcaaggcaggcctagactatgccacgcccgcaattacgattaatgacgtctgtggctctggattgtcaagcgttaatctggcagccagtctgattcaatcaaagcaagcgcgggtcgtgattgctggtggtatggaaagtatgtcgcgggcaccgtatatcttaaatcaggctcggggcggctatcgttttggtgatggtcagctgattgatgccttgcaaaaagatgccttgattgatgtcgaaaacggctatccaatgggaattaccgcggaaaacgtggctgaacttgatcaaatcagtcgtcaagaacaagatgagtttgccttgcgcagtcatcaaaaagcagtggcggcacaaaaagatcatgcctttgatcgcgaaatcgtcccagtcgaggttcagactcgcaaaggtacgatgatcgttaaaaatgatgaggcaccgcgcgcggatacctcaattgaagcattacagaaattaaagccgtcttttgccagtcaaggaacagttacagctgggaatgcctcgggacttaacgatggggcggcggccgtcatgctggcttctgaatcggcagtcaaggaatatgggctgcagccgttagcagagtggcaggcggcaaccctggtcggtattgatccggcatacatgggattgggaccggcctatgcaattgaaaaactgttcaacgagacaggaatcagtcgtgaagatgttgatctgtatgaaatcaacgaagcttttgcctcacaatcggttgcctgtctgcgccgactcaaactggacgaacggcgcgtcaacccacgtggcggtgcattagcgctgggtcatccggtgggctgttctggagcacgaatcttggtaacgctgattcatgaaatgcaggatcttgatgcccagaccgggattgccagtctgtgcattggcggcggcatgggcgtggcctgtttggttgaaaaggcgtaataagatcttaaaacagccgacgcgtttttgacgagtctggctgtttttttagttggttatggcttggcggtcaaacgtgtgttgacttagcaaaattacgatcagaaggaataattggcgcggattaggcattggtaaaggaatgaaaaaatagtaaaatattatcctagatgcaaagttttgagaggattttgattatgaaaaagtcgcgttggattgattttggcgttgtctgcggtttgttttttctggctttcatgtttgccgttttgcgtcatgactcccagatcaaaaccatggaccaggctgggtttgctttaacgctgccaattaccgccgtgaagactcgtattatgctttttatcaccgcgctaggctcgccccagtttttaggaccgataacgctggtgatgatgctgattttatggtggaaaaaacagcttggcagcagcatgtggtatggcgcaatgcagtttgtgggatatctgctggtaattttctttaagaccagcgtaatgcggccgcgtcccgctcatcgattagaaaaggtcggcggctacagctttcccagcggccatacctttgcaaccgtaatttttgtcctaacgattttggctttgctttggccgcacctcaagtcaaactggagccgactgcttggcgggatgcttggtgccggttggatcctgctgattatgtattcgcgcgtctatctgcacgttcactataccagtgacgtctgggccggtttgctgctggcgctttgctggtggctggtcgccaactcgcaaaaagagcgctttatgaattggcttaccgaaattcaaaaataattactgatcactcttgtcaaatctgtaaaaattcgctatactagttagcgttgacttatggagagttggcagagtggtaatgcaccggactcgaaatccggcgaacccgtgttgagcgggcgcgcaggttcaaatcctgtactctcctttttcagaaacatctataactgactagaaaccccaaagccttgacatgataggctttggggttttagtaatcactctaaattgaaaagttgggacgcctaatatagttgttcaaaagcaaggattgtttttggggctattgcagaatttattcattaattagtttaagggctaaaacctgaaagcacagatgcgcggaattttaccgtcgttctgtgcttttttgctctaaaacagaaaaacgcaattattcattagcaataatgcagtctgggctgctttttaggacgatttctgcacattttaattaatctgattcatcaatagacagatcggcaatctgaacttgttccaatgttttgtaaacgctatactaaacgtataaattgatgttatcgctttcgcaaggattattttacactggagggttttttatgtattattccaacggtaattatgaagcatttgcacgtcctcgcaagcctgagggaatcgaacagaaacacgcctatattattggtggcggtctggctggtttggcagcggccgtcttcatggttcgtgatgctcagatgcctggcgaaaacattcatatcttagaagaactgccggttgcgggtggctcactggatggcgagaagcgtcctggcgttgggtatgtcattcggggtggtcgtgaaatggaaaaccactttgaatgtctttgggatatgtaccgctcaattccttcacttgagattccaggtgcttcctatctggatgaatactactggttggacaaggatgattccaattcatcaaactgtcgcttgattcacaatcgcggcgatcgggtacctagtgatggcaagtatggcgtcgagaagttttcaaaatatatcgttaagttggtcttgacctcagaagatgagttagagggcaaaacgattggcgattggttcccagatgagttctttgacactaatttctggctgtactggtctacaatgtttgcctttgaaaagtggcactccttgattgaaatgcggcgctactgcatgcgctacattcaccatatcgatgggctgccaacgctgagcgccttgaaattcaacaaatacaaccagtatgagtcaatgactaagccagtcttggcatatctgcaggatcataatgtcgacattcaatacgacaccgtggtcaacaatgtcttggttgataccagcaatgacaagaagatcgccaaaaagattctgctgaccaaggatggcaaggatgaagaaatcgtcttgactgacaacgattatgtctttgttaccaatggctcaattactgagagttcaacttatggcgatcagaacacgccggcaccgattacgcacagcttagggccaagttggaagctgtgggagaatctttcctatcaggatgccgattttggtcatcccgatgtcttctgcaagaacgttcctgaccgtgcctggttcatctcagctacggcaacgctcaaaaaccgcaagctggcaccatactttgaacggctgaccaagcgcagtctttatgatggcaaggtcaacactggtgggatcatcacggttaccgactcgaactggatgctgagctttacgattcacagacaaccgcactttaaggatcaaaatccggatgaaacggttgtctggatctacgcgctttattccgacacggaaggcaactacatcaagaaacgggtcgtggactgttcaggcaaggagattactgaggaattactttatcacttgggcgttccagttgatgacattgaaggctatgccgaaaacgacgtcaataccgtacctgtctacatgccttacgttaccagctacttccagctacgcaaaaaaggcgatcggccggcagtcgtgccaaagggatcgcaaaacctggccttcttgggcaactttgccgaatcaccaactcgcgacacggtctttaccacggaatactcggttcggaccgcgatggaagccgtttacacgctctttaacgttgatcgcggcgttcctgaagtctttgattccgtctttgacatccgccaagaactgcgggccctgtactacttgagtgacaagaagacattgccggagatggatctgccggtaccaaagctggctgccaagaccgcgctgcgcaagctgaagggaacttggatcgaagaaattctcaaagagcagcatctgcttgactgattaaagcaatttatataaccagaacgtcaaaagaccaccagcgctaatctgcgggtggtcttttgctactgagtaaataaattaagataaatgatcagacttatggctgctgattgagcggactagttatgatgaatcaagcggacgagggtgatggcatcgacttggcttaaccggtcaattactttttgtgcggttgccggcgtgaggtttgaaacgtctagcatcgtataggcatagccgccgcgcgaacggttgaccagattttcaatgttgatgccttcatcggccataaacgtcgaaatctgccccagcatgttagggatgttttggtgaatcaaggtaaaacgatctgggctggcaaacggtgcggctacatctggcaggttgaccgagtttttgatgttgccggtttccagataggtcatgatttcatgagctgcaatctgcgcgcacttgacctcagcttcaatcgtcgagcccccgatatgcggcatgatgacgatatcaggattattcagaatctgagcctcgctaaagtcggtgtagtactttttcagcgtaccgtcagccagggcttttacggcagcggcattgtcaacgattcccagccgcgagtagttgagcaaaacggcgccgtgcttgaaatgctttaattctgccgtgccgatcagtccagtggtttcttcatttttaggaacgtgaaccgttacgaaatcagcatccttaatggcatcagtgatcgtttgcgcgcgcttgacctgactatccagctgccaagccgattcaacggaaaggtatggatcatagccgatgacgtccatgcctagatcaacggcggcgttggcaaccagcgagcccacgtgtcccatgccaataacggcgatgcgcttgcccaagagctcagtcccattgaaactggtcttctgcttttcggttcgcagcgtaatatcggcaccaggcttggcgttggcactccattgtacggcagcgatgatgttccggcttgccatgatcatcgaggcgacgaccagttccttaacggcgttggaattgccgccgggcgtgttgaagacgaccgtgccgttttcaagggctttgtccaatgggatgttgttaaaaccagccccacagcgcgcgatgactttcaggctcttgggaaactcatgatcatgcagatccacgctgcgaatcatgtaggcatcgggctgggcttcaggattattgatctggtagtcagccgtaaattcatcaagtccggcttgggcaatagcgttataggttttgatctggtacatgaaagattcctcctagcgattttctttttcgaattgctgtataaagtcacacaaagcaacaacaccatcatatggcatggcgttatagatacttgcccgcatgccgccaacgagtcggtgaccttttagattcaatagaccatgttcctgggcctcttggacgaatttagcatccagctgcgcgtcgccagttacgaatggcacgttcatcaacgagcgatagtgtgggtcaacgttgtttttaaacagcttggagttatccaggcagtcgtacagcaattgggccttcttgcggttgcgagcgtccatggccttaacgccgccttgttcatcgatccatttcaaaacgagcccggcaacatagatttggaagacaggcggcgtgttgagcgcggactttttagcggcctgcttggtgtagtcgagcatgcttggcagtcccttgacatgacccagcagcgattttttcaagattacgatcgttacgccagcgggagccagattcttttgcgccccggcatacatcagatcgaatttttcaaacgggtagtcttggcctaagaagttggaagaaaggtcgccaaccaacggcgtaccgtcagtttctggcagtttttgccaagccgtacccatgatggtgttgttggtcgtgatgtgtacgtagtcataggtatcttggggaatggctggtacttttggcagcgtggtgtaatgctggtctttagaagaggccagaacgtcagcttgaacgcctttgatcaagcgtgcttcttcaacggcgcgttcagaccagtgaccagtgtcgatataggcggcgcgatgatattgataggcaaggtttaatggtacggccgtaaactgcgtggtaccaccgccctgcatgaacaaaacgtcgtattcctgattatccaggttcattaatttatagatttgtgccttagcattttcataaacatcaacgaacagctgagagcggtgcgagatttccagaatgctcatgccagaattgttgaaatctaataattcagcctggacttttttcaagacttctttgggcagcacagcgggaccagcagcaaaattatagacagtcattgtcattcctccaaatcataaactaaaaaagcacccacttgagtaagtgagtgcccttcaaattcggttcaggatttgaattgacctcacttatcgcgaaggccaacgcaaaatatggccttctaaatcaaggaagaccatgatgaggaaaccatcaatgcaaattcaaaattattcaacagcatgttcagttccctcctcatcaaattattatttatcgttaacaaaattataatctaattacaaaaaaacgtcaataataaatttgattctggtataatgaccaaaaaccaaagtcgaaaggaaaagaatatgaccgaattttatatcgttcgccatggtcgcacctttgccaatgcggccgggcttaagcagggaatcattaatacgccgcagacctatctcactgatgagggacgggcgcaggcgcagcttttggcccagaattttgatttgcgtgattttgacgcgctttatgtttcgcctttggaacgcaccaagcagaccgcggcaattctaaatgaggaggcacagctgccagtcatcgaagacgggcggttgctggagatttcttatggcgactgggatggccagcccaatgatgagctgatgaatcaatatccagaattgttttcgacgtttgttaaagatgtgcgtcctgaatatgctgccgttgcccatggcgagacgtttacacatgttgaaaaacgggtccaggactttattaaagacgttacggctcagcatccagacgagcgagtcgtagtcgttacgcatggctttacggtccgctcgtttgcggccagtgccacgcatgcgccaggcttgacgattctggaaccagaaaactgcagcgttactaaactgattgttgaacccaccacgcttgagcagcatctgatctattacaaccgttccactcaaggattctaagtatcaaaaagacggatcacgcgttatgcgggacccgtctttaattgtttgctgacttttaagcgtagccgtgaaaatggttggctgaactgttggaaacgctgctaggcttgtttttgcatggcgtgtttaggcttttgaccaagattggcgaaaaagtgctcataaactagatccgtccaacgcgtcaggtgtgtcagacttgaatcgcccgtcaaagagaggacaaaggcaaaacccagggcgactgccgagacgtggtcgatgccaaacagactgccaaacagcgatgcgcagaccaaaagccccatgatgcagccataaaagatgatactgcggaacttattgagcggatgacagatctggtagagcaccatgaagccaaccgcagccagaatcatggttgaggccgttgaaatgtcttggcggctgaggccaaacagagctccacagactacgatgacgccaacggtaaacatatcggtaatcccaccaggcaaggcacgccgcataacgttgggcagaaacttgccatgaatacgctgatgattggtttccaacgccagcaggaatgaaggcgtcccaatcgtaaacagactgatcagcgtgatgtgggaaggatcgagcggatagttgaaggcaaagatcagcgtaaagatggacaagagcagtgagaagatgttcttgaccaaaaacagactggctgatcgttcgatgttattgacaacctgccgtccctgggctacgacctgtggcattttggcaaagtcagaatcaagcagcaccatctgagcggcattcatggtggcctcattgcctgaagccatggcaatactggtatccgctcgtttcatggctaaaatgtcattgacgccatctccagtcatggcaacgacttcaccttgcttttgcagcgcggtgacgaatttttgcttttgatctggcgtgacccgaccaaaaacggtgtagcgctgcagagcactttcgtattcatcatcggttaaagcagctgcactgatgcagttttgcgcgccttcgatctgtgcctgtttggctacgctggcaaccgttaatggatcgtcacccgagataaccttgatcttgacgccttgttcggcaaaatagcggaaagtggctggagcagtcttacgaacgggatttctcagcaaaatgaatcctaatggggtaaccggcgcactgagactggctttggtcagctgcccttgatactgaccgaataccaggactcggaagccttgcttggcatagggctcaaactcgctgctaaacatggcggcactttctcttaataccatttccggcgcgcctaagacgtagctttcattaccaaagcccacgcccgagtacttccaggctgaactgaacggcacgatttgatcagcttggcgtccgctgccttgcgtaaagtattctttcattgctttcatcgttgagttgtcgccaggcatggccgcgcaaaaatcactgatcagactgcgcagctgattgtcgtcaacctgcgcctgctgagcagaaaagaagcgttggacctgcatttgattttcggtgattgtcccggttttatcaacgcaaagtaccgtaacgcgggccagcgtctcaatgcttttcatgctgtgcaataagactcgctgctgcgccagtttcatggcactcaaagccagcgcaacggttgccaataaatagagcccttctggaatcataccgatcaaagctgcttccatagaaacgatgctttgtttgagcgtattgccattatgcacgtatgattcataaaacagcgcggcaccaattggaatgatgatgatgccgacgaatttgatcagccgattgagtgacttgatcatggctgattcttcggtcgtatccattttttgcgccttggccgtcagcttagccgcatatgaattggcgccgacatgcgtcaagcgtacgcgtgccaaaccggaaacgacaaagctgcctgacatcagactgtcgccgggatgcttggcaatctcatcagcctctccggtcagcagcgactcattgacgttgagcgagccggttaaaagctgggcgtcagctggaatctgctggccggttttcagttcgatgatgtcatctaaaaccagttgattagtcggcagctgaatcgatttgccatcacgaattaccgttgctttggcagcattcagcactgtcagtttttccagcacttttttggaccgtaattcctggataatgccaatgacggtgttggcgatgatgacgggcagaaaagtcatgtccttaaatgagcgaaccatgaccaataaaacggctaaaacaacgaaaatcaggttaaaaaaagtaaacgtgttgctgtagatgatctgccgtgtggttttaaaggtcgtattgattgcggtgttggtcaagcctgcctgggtccgctgtgccgcctgatctttagtcaagccggtatcgggagcagcattgaagtgctcaatctgctcgtctttagcggttgctgactgttgatgatgtctgcgcatacaatcatccctttctgcttaaattctaattttattttagcattctttgcgatttggtacggttacctttaagataaattaagaacgattttgagaggattgttgatatgagcacagaaccgacttttgaacgcgccgtaatcacgttttgtagtgaccggctaacgataaaagtagaatcgtcaggtcatggacagccatcgcgtactgattcgctatatgcaatttgcaacgctcaaaatcagtacccgggggatttataggttaccggggacgttaaacggatcagcgagttttgcggagcccatgattttgaacatgggatagttgatggtaaaataattgatggcgtatcggcggcttcaatccatgccaatcgtttacaaaaaggcgagcagcttgccgacatccagacgccggacaagacgcaggacgcggtttctggcgcttcagtagaacaatagcagggggaattgatttggcttcaaaaaagttttatgccgtgcgccgtggcaaaaagcccggcatctacaccagctggccggaatgccaaaaacaggttgctggctttgctaatgcgcgcttcaagggatttatgaccagagaagaggctttggcatggctgcagcagccggaaaagagcaagccgcgggccgtcaagcatgcaacacagaccagtctggatctattcggcgaggaacagggcccccgatttattccgacgattgttttttatacggatggtggttcacgcaatcgcggcaatcgacggggcgatcacgttcatcaagacgatctggcagcgtgggcctatctgattcggtttgaggatggcttaaaaatcaccgatacggctggtgaattgggtgctaccaacaatcgcatggaggtcatgggacttttaaagtgtctgcagcgtctgcttgagttaaacctgcaaaacgagccgattgaaggcatccttgactcgcaatacgttttaaatgcgatcaacaaaggatggctgtatggctggatacggcgcggctggaagacttctggcggcaagccggtcgctaatcaagagctttgggccgaggtgagcgtgctgctgcctaaattcaagcagctgcgctttaagtggactaaagggcatgccaacagtcatggcaacgttacggtcgatcagttgctgaattcgacaatggacaatcttaaagcttaaatttaatcaaaataaaagctcgtttggtcgcgcgtcatggcgaatcaaacgagtttttttgggcaacgaaagtatgagtagctgccaatcataacatgacggacaatgcttttaaggcagccaggcggatcttggggggacgtttagctaatcagtgttttgcgctgccttgcttacagttttatgcaaaaaaatctgtataaaacatatgatgagaaaatcattacctactttttgccaaaaattggggcgaagtaggtagtagcagttctcgcaaccgctccagatctgatttttcacaagtccagtagctttgcgaccacgaggatttttctgaattaacctgtcagcagtttgacgctgtttatagttgatggtgactattcaatatgtataaataaaaaaagctatcagatgacgatcccccgcagtttaaagaaacggaatcgcaccaaatagctggtagtcaagaaagaagtgaatgtcggcactccttacgattaattatattactatactggatcgaaaaagaaaaccccaaattgaaattttataagaaaaagcgtgaatattttttacatttcagtttaaagttgcaattacaaccgacaaccgatataatattgctcgtgaaaggaggcgagacggtgattgatgtattgcgcgagatgggaatggcatcgcgagccctagatgccatggctaacgcggaatttaagaagctggatctggcacgcggtcaattcgtatatttggttcgaatctatgagcaccctggcattattgcacgcgatttggcaaaattaatcttgatggataaaactacgattgccagagcagttgccaaactggaaaaaaacggcttgatcgtgcgacggtccgatccggccaatcatcgtatcaagcgaatgtacgtcacgaaaaaaggagcggaattatacccgtttatcattcgtgaaaacgagcattcaaatgacgttgctttacaaggcttttcacctcaagaagcgcagcaggctcacgactacttgcagcggatgcgtcaaaatctcgaaaaagactgggattttgttaaagcaggcggtcaaagaaattattaacgatatttaagagataataaagacattaaatgagtaaaggagttttattatgaaacgtgttgtagtagatgaaagtttttgggaagtctttccagatgcagagattgcaattatgtacgttgatgggattgataaccatgatacggatgaaaacaaggccgaacgtgctgaattattaaaacaggcaaccgcggaatcagccaagttcaccaaagaagaaactttccgtgataatccagtcgttgcacagtggcgtgaagcctatgccaagttccctaagcgtaagggtgcccgagcatcaattgaggcactgctgaaacgagccagccaaggacacgtttttgaaccgattgagccattggttgacgtctacaacagcatctcgctgcgctatggcgttccggttggcattgaagaccgtgacaagattgccggtgacatgcatctgggcaaggctaaaggcggcgaaagtttccaacctgttggcgctgacaaagatgatccagctcgtgaaggcgagattctctattatgacgatgagggtgctgtttgccgcagtctaaattggcgtgatgctcaacgcacgatgctgaccagcgattctaaaaacgtggttatcgttatggaagcagttaatgaggatcagattctgcggacgcatgaggcgatggatgagctgcaaaagctgattgaacactactttggtcaaaagccgagcgcaccacactacttgactaaagaaaatccgattgccgatgtagactaggtgagtgcagatgaagattggaattgataagatggcgtttgcgacaacgtcagaatatattgatttgactgaactggctaaagtgcgcggtgtcgatcccaataaatatctaattggcattggtcaaagcgagcaggcagttttaccgcctacgcaggatatcgtgacactgggagctgctgctgccgacaaaatgctgaatgaacgtgatcgagagcgcattgccacggtgatcgttgctaccgaatcaggaatcgacaattctaaagccagcgccatctatattaagcgactgctgaatctggatgactacgtaaggaccgttgaagttaaggaagcctgctattcagcaacggctgcgattcaatttgccagaggacaggtggcattggaaccagaaaaggcggttttggtaattgcagctgacgtggcgcgttatggcttaaagacggctggcgaggttacgcagggtgctggagcggttgccatgctgattacggctgaaccgcggattttagcgattgaacggaccagcgttgcttattcgcaagacgtgatggacttttggcggccgctttatgctactgaagccatggttgatggcaagtattcgaccaatgtctacattgactttttcaagcacacgctgaatcgctatgaaaagctgacggatcgcaagctggatgattttggggcaatcgcttttcatctgccatttaccaagatgggcaaaaaagctttggaagctgtcttgggtgaacgggatgatcaaacggcctggcgcctgcgcaaagcattgttggccagccaaaactacagccgccgggtcggcaatctctataccggttcgctttatttaggcttgatgtcgcttttgcaaaatgatcctgatctaaaggcaggtgagcgcatcggcctgtttagctatggatccggtgcggaaggcgagttttacagcgggattctgcagcctggatatcaagaacagctgagcaacgtggcaggagatctgagcgaacgccaactgatctcgattgcggcctatgagcagcagttcaatgaccagttaggaatgaataaagcagacgttgagtacgacattagtgcagatccggctcgttttgttttagctggtcaaaagaatcatcagcgccaatacgttgacaagcaacgatagctacaactttttcgttagcggatgataatcagaccataataaaaagagatggaaattcccatctcttttttagtagatactgtcgcgaaaaagcccgacgactttgcctaaaatagttacctgatccaagatgattggggccattgtgtcgttttccggctgtaggcgataatgaccgttttccttgaagaaacgcttgcaggtagcctcgttgtcatcattcatggcaattacgatatcgccatttttagcggtatcctgtttacgaacgataaccttgtcgccgtttaagatccccatgttgaccatggaattaccttgaatctgcagcataaacagatcgttatggtccggaatcgaaggcgggattgggaaataatcggttgcatcttcgaccgcgagaatcggctcaccggcagcaacgattcctaacaatggaattttttcttgctttggcgcaattcccaagacatccatgccggcgggcgtaatctctagggcacgtggcttggaaggatccttttgcaggtaccccttcttgataagccgattgatatgtccgtgaacggtagatgtagatgaaaggccgacagctttacagatttcgcgaacggttggcggatagccgtgagtggcgacctgttgatgaatgtagctgagaacggccatttgcttgctggctgctgtttttaccatgttgccacctcattttcagatttggagtaattatatcacacttgccaaatattttcaaacatacgttcgttgaaacttaacggcgcagattgcttgctaaataatgcggcgttcgctacactaagtaacgtaaaaatcgctgtttaaggcagaggggaagaaaattatggctgattcacaagcacaagaaaagctgctcaaacgaatcaatgagctggcacacaaaaacaaagcggaaggactgaccgcggccgaaaaagctgaacgcaaacagctgcgcgatcaatatctcaagaatttccgggaagcttttcgctcaaatattgagatgatgcggatttttgataaggatggcaaagaggttacaccggaaaaagttcggcagattcaacgcaaaaaagggctgcgcgacgactaattcaatgattaattcatcgaatgcgccttttatttgacgaagatatcgtgtaacattagtatcgttatctaaaataagggggaaacatccatgagtactgggcttagtatcatgttgatcatcctggcgctgctggttggccttttggttggcttctttggcgctcggaaatacatggaaaactacctgcgcaacaatccgccaatttctgaagatatgctgcggacgatgatgatgcaaatgggccaaaagccttcagatcgcaaactgcaccaaatgatgcaagcgatgaaggctcaagcgcgtaaagcaggcaaatagcaatcaaaaggaccggtgcactgcatcgatcctttttaattagtattgataaagattatcacgggcggcaacagattctggtgagccgattgccaggataaatttcaattcaaaaatgatgggcctgattaaaagtcatcgtttttgggcttttctggcatatagtagtggtaattgggatccagctcgttgtccagctgatcaaacgccgtctgcatctgtcgttccaattcctgctgattctcatcggtcagccgcattttacggtcaatatagattggctcgccaaaactgatcttgcgcttttgccgtttaaagataccgcttagcttcaatggtccctggtagacggcgggcaccagcggcacgttggccattttggcaataatcagcgcaccgcctttgatcttgctggagtagcgcgagccggtcgggaagatgatggttgagcgatcactgtttttcagcagcctgactggggttttgatggcagaggggccgggattcttacggttgaccggaaaggcacccagtttacgcagaaaccagttggcaaagcgccctttgaacagctcttctttggccatgaacgtaaatttcttaggataaacggccagagccaataaaaccgggtccatccaggtacgatgcggtgcgacgataatgtagttgccctcaggaaggcgatctttatgttcaatctgggggcggccattgaacagcgtcaaaagcggattgaccagatgaaccaagaaatcatagagcatttaaacaactcccaatttttaaagtgattttatatatttagtatgacgaaccatactcaaacatgcaagcaaacaaacgcatagcataattcgaaaacatgttaaatcaaataacagcaaccaagtgagggaaaacatgacaaccgttcagctaaaatcaaatgagcgtattgatcaactcagtgcgcaaggggtacaaatcattcaatccagcgaggtctttgctttttcgctggatgccgtcttgctggcagattttgtgcgtcccaatcaacgtcagcaaatcaaaatcgtggatctgtgtgccggcaatggcgcaatcggtctgtttttgcaccataagctggggggacatttttatgaaatcgagctgcaggaacggttggctgacatggcccggcgatcagtggccttaaatgatctgacggcccgttatgaagtgatcaatgatgatattgccaacgtctaccaatacgtagccaaggatcgagccgatgtggtcgtgtgcaatccgccttattttaagaacgcgccggccagtcaaaaaaatccaaatcgctatctagccattgcccgtcatgaattgacgattgatctggcaatggtctgtgatcggatgagcggtcttttgaagatgaatggacgtggctatctggttcatcgaccggaccgcctgccggaaatcttagcgacaatgacggctcatcgattggcgcccaagcggatcaagttcgtctatcccaaaccaggcatggaagccaatatggtgctgatcgaggcaattaaagacggcaagccgaatgggacgcggattatgccgccgttgatcgtagcgggtgaagatggtgagtatggtccggaagtgcaggcgatgcttaatggctcaaatatctgagcagcattattatttttacatcctctattgtgcggatcacacgctttatggcggctactccacggatgtctggcgccggtttgcgatgcatcaatccggcaagggagccaagtatacccgaccgcagaagcgtcacccgctcaagcttttgtactatgaggagtttgataatcagcatgatgcgctgagtgcggaatggcattttaaacatcagtcgcgcgccaagaagattgcttatctgcgtgctcataatattaaaatttgattaaagattcttccattcaagcaaatctgtctgtataatcggtttttggagataaagatttgtttatgtagtggaggaatttgagatatgaagattattgcgtacgggattcgtgaagacgaacgcccttatgttaaaaactggcaatgggccaatccagacgtggaactggtctgtaccggcaagctgctggacgttgagtcggctgaactggccaggggctgcgatggcgtggttgcctaccagcagaaaagctactcggctgaccttttaaaacggctgcatgaaatgaacattcacaacctttcattgcgcaatgtcggtattgataacgttgacgttgaggctgccgttaaatacggttttaagattaccaacgtgccggtctactcgccagctgcgattgctgaatttggcgtcacgcagctgttgaatcttttgcggcggaccaaggagtaccaggctaagtttgccaagcgcgactatcgctgggctcccaatatttctaaagagcttaatcaacagacggtcggcattgtcggggctggtcacattggccgggtaatggcgcatatctgccgcggctttggtgcccgcgtgatggtctacaatcaccgtcccaagccagatctggttaaggctggcgtgtttactgattctttagatgagctgtataaagagtcgacggtgatctctttgcacgtgccagccgttaagtcaacctaccacatgctcaatcgggatgcctttgccaaaatgcaaaagggtgttttgatcattaatatgtcgcgcggttctttaatcgatgagcaggatctgattgaagcgcttgatagcggccaggttggtggggctgccctggatgtcttggaagatgagaccaagatctttaacaaggatatggccaatcagccgtccaactatccggcatttgacgatttgaatcagcgcgagaacgttttgattacgccgcacactgctttttataccgatgaagccgtgcgcaatatggttgagcagagcctgaatgccaaccgggagctgattttaacgggggccagcgataaaatggtcagtctggcataacaaacgaaacacggtgttttagcgacatcgtgtttttttgagcaatcaatttggcttcggtcgggtatctagaagcgttttcttggtatttcggacgtattgatacggatttcataaacgatcaccaggaaatttgtttacttgtgagcttttggggtatactagagacacgatgaaaaataactaagccaatcggaggtatgaaatcaatgaagattttagcttacggtattcgtgaagatgaaaaacttttcgttaaggaatgggaacaagaaaatccagaagttgacgttgaaatcaccgaccagctgttggatgatgaaacggtcgcaatggccaagggctttgatggcgttgttgtctatcagcaaaagccatacacggacacggtttttgaaaagctggactcctatggcattcacaatgtctcactgcgcaacgttggggttgacaacatgaacccggctacggttaagaagtatgggtttaaggttaccaacgtaccggtatattcaccagcagccatcgcggaattttccgttacgcaattgatgaacctgctgcggcggaccaaggaatacttccacaagtttgaacgtggcgacttccgctgggccccacagatttctcaagaactgaaccagcagacggtcggcgttatcgggactggtcacattggccgcgttgcaatcgatatctacaagggctttggcgccaaagtaatcgcctatgacgtttatcacaatcctgaactggaaaaagaaggcctttacgttgacactttagatgagctctatgccaaggccacggtagttacgctgcatattccgctgttcccatcaactgagcacatgctgaacaaagcagccttcgataagatgcgtgatggcgtctttatcgtcaatgcatcgcgtggtccactgattgacgagcaggccttgatcgatgcgcttgactctggcaaggttgccggggcggcattggatgttttggaagacgaaaccaaagtctttaaccacaacatggtgggcaagaacatggcctatccagaattctggaatctcaattcgcgtgaaaacgttctgatttcgccacacacggctttctacaccaacattgccgttcagaacatggttaagttcagtctgtcagccaacaaagacctgattgaaacggggacttctgataagctggtcaagtttgactaattcaaataattgaagaaaaaaggcttgcggtggcaggtctttttttgtatactatcagtcggtgctaaatgcccaattcacacctggcgggatgtcagaggaagtgccaattggtgcccctgacagatgaacggcagggaggaaaaaactatttggaggtatgattcatgtctgttgttagcatgaagcaattgcttgaagccggtgtccactttggtcaccaaactcgtcgctggaaccctaagatgaagccattcatctttacggaacgcaacggcatctacattatcgatctgcaaaagacggtcaagatgatcgacactgcctacgactacatgaaggacgttgctgctaagggcggcgttgttctgttcgttggtactaagaagcaagcacaagactctgttgaagaagaagctgtgcgtgcaggtcaatactacgtcaaccaccgttggctgggtggtaccctgaccaactggaagacgatccaatctcggattgctcgcctgaaggaattgaagaagatgagcgaagacggtacgttcgacgtactgccaaagaaggaagtttccgtgctgactaagcaacgcgaaaagctggaacgtttcctgggcggtattgaagacatgccacgcatcccagacgttttgtacattgtggacccacacaaggaacaaatcgctgttaaagaagctcaaaagctgcacattccaatcgttgccatggttgacaccaacactgaccctgacgatgttgatgttatcatcccatccaacgatgatgctattcgtgccgttcgtctgatcacggctaagatggcagatgctgtcatcgaaggcaagcaaggccaagacgatgccaagcaagccgaagcagtcgttgaagctgctgacgaaccaaaggaagtttcttcggacgatctgcaaaatctgaagaacagcgttgaaggcaacaactaaccaaattagttaacgcttgggctgttttgcagtttggaccattttggcctaagcgcaaaacagcctttttcattaaaaacaactatttttaaggagagacgtactcatggctgaaatcaaagctaagcaagtaatggaactgcggaagaagtccggtgccggaatcatggacgctaaaaaggccctggttgccagtgatggcgacatggacaaggcaatggactggctgcgtgaaaaggggattgccaaggctgccaagaagagcgaccgcatcgctgctgaaggtctgaccaacattgctgttgacggcaacacggcagttatcgttgaattgaactcagaaacggactttgtggctgcttctgacccattcaaggaatcactggctgacgttaccaaggtgctgctggaaaacaagccagctgacctggacgctgctttggcttccaagacggccaacggtacgctgaacgatgacctgatctccacgactcaaaagactggtgaaaaggtttctctgcgtcgctttgcctttgttaacaaggaagacggcgacaactttggtgtttacctgcaccaaggcggtcggattgctgcgctggtcgttttgcaaggcgctgacgaagaaacggctaaggacgttgccatgcacgttgctgccgttaacccagaattcatgacgcgcgaagaagttccagctgatcgtctggctcacgaacgcgaagtcttcaaggaagaaacgctgaacgaaggcaagcctgaaaagatcgttgacaagattgttgaaggtcgtcttaacaagttcctgtcccaaatctgcctggcagaccaagactttgtcaaggacccagacgtaacggttgctgaatacgttgaatccaagggtggcaagctgaagagcttcatccgctacgaagtcggtgaaggtatcgaaaagaagcaaagcgacctggctgctgaagtcaaggaacaactgaagtaattcgttaattgacgaaattgcgcactggtcgatgacatcggtgcgctttttttgcaaaatcatgcatagcaggaaggaatttcaaatgtctaaagtaaaatacaaccggatcgttttgaagctcagtggtgaagctttggcgggtgaaaaaggctttggtatcaatccgccggtaatcaagaagatcgctgaagaaatcaagcaggtctgcgatttgggcgttcaagtctgcatcgtctgcggcggtggcaacatgtggcgcggcgttaccggcgaacaaatgggaatggaacgtgctcaggctgactacatcggcatgttgggtacgatcatgaacggtctgtcgctgcaggacgcgctggaatcagttggggtgccaacgcgggttcaaacggccattgaaatgcgtcagattgccgaaccatacattcgtcgcaaggccattcgtcacctggaaaagggtcgtgtggtaatcttctctgctggtacgggctcgccatacttctcgactgacacgacggctgcattgcgggctgccgaaatggatgccgatgcaatcttgatggctaaaaatggcgttgacggcgtctactctgctgatccaaacaaggtcaaggatgccgttaagtttgatcatctgacgcacatggacattttggacaaacacctgcaagtgatggactccactgccagctcgctgtcaatggacaatcacattccattggtagtcttcaatctgaacacgcctggcaacattgtccgtgtcgttaaaggtgaagagattgggaccacgattgagggggaataaataatggctgaaggtaaacaaatcctagcagaagctaaagaaaagatgagtaagtctggggacgcattgcggcgggcactggctgatattcgggccggtcgcgccaacgccagcttgctgaactcggttaaagttgagtactacggtgtgccaacgcctttgaatcaggttgcttcgattacgattccagaagcacggcagctgctgatctcaccatatgatgaaagtctgcttggtgaaatcgaaaaggcaatctatgcttccaatctgggcttgacgccacaaaacgacggttcggcaattcggctggtaattccacagctgactgaagaacggcgtaaggaactggtcaagcaggtcaaggcggaactggaaaaggccaaggttgcggttcgtaacgtgcggcgcgaagctatggacgacctgaagaagggtaacaagaacggcgactttaacgatgatgaattccacaagctggaagacaaggttcaaaaagaaactgatgaaggaatcaagaacctggaaaagattgccgacgaaaaagaaaaagaactaatggaaggttaagttctatattctaattcgaaagagaaatcagcgcacttcgcgttggtttctttttatttttactgagggccgcgcttgatctgttaaaatctggcttaatattatgcatagttggtgacaaatgtagagtcaggcctagatttctggtaaaatgaaaagtgttgcaattaaaaacaatgcggaaatggagggttgttcttgtttaacaagaatcaccaggcggcagacgagccgcaattggatatgtcccgcatcccagctcatgtcgccgttatcatggatggcaatggccgctgggcgcaggcgcgacacctgcctcgcgtggcgggtcataagcagggcatgcagacggtgaagaaagtcacgattgctgccagcgaccttggcgtaaaagtactctcgctttacgctttttcaacggaaaactggaaacggccagaaagcgaggtcaactacttgatggatttgccgattcgtttctttaatacgtttgtgccagatctggttaagcataacgttaaggtaacggttatgggcgatatcgctaagctgccggaaaaaacgcaaaaagccgttaacgatgcgatggcagataccaaggactgtgacggcatgattctaaacttcgcgcttaactatggtgcgcgtgatgaaatcaaacgggccgtgcagtcaatcgcacaacaggctgcagctggcgaacttgatcctgcttccatcactgaagatacgatcagcggacatctgatgtcagcacagctgggtgagtttgccgatcctgatcttttaattcggaccagcggcgaagagcggatctcgaactttatgctttggcagattgcctacagtgagctgctgttcgtgccggaacattggccagactttgatggcgagacgctcaaacgctgcctgattgaatttcaagggcggcaccgtcgttttggcggtttggtaaataaatagaaacgggtgaagattagtgaaaacacggattattacggcggtcgttgccttggcgatctttattccactgattgtctacggtggctggccattaacgattgcggcagttgtcttaggcatgatcgcaatgggcgagattctgagcatgaaaaagatgtttttgacgtcttttccagcgatcgtcagctacattggcgtggcaatcatggttctgccaaacagctggctggactttttgccgagtcacattacgcggctgtttgccatgtacgtaatggtgctgcttttattgctgcatacggttgtgcataaacagcgcttcagctttgatgatgccggggtcttggcattgggcatgctctacatcggcattggctttaacaatttcttggcagcccgggccgtcagctttacgacgcttttgtatgccatgctgattgtttggctgactgacagtggggcctacttgtttggccgcaagctgggcaagcataaactggcaccgcgcgtcagtccgaataaaacctgggaaggctcgatttgcggcacgcttttggccacggtggttctggccgtttatctttatttcttcccagttggctatcacaactggggcttgatggtctttttgacgctgctgctctcgattctgggtcaattcggcgacctggtcgaatcagcactcaagcgattctacggcgttaaggactccggtaagatcctgcctggccatggtggtattttggatcggtttgacagcatgctgctggtcatgccggcgctatacttgctggggattatctaagctggccgaaaggtgaggcgattctgtgatattaacgattattacctttattattgtctttggactgctggtcttggtgcatgaatatggccactactactttgccaaacgggccgggattctggttcgtgaattttcgattggcatgggccccaagatctggtggcatcgcaaaaacggcacgacctatacgatccggattctgccattgggcgggtatgtccggctggcaggtgctgatgaagaagatgaagagtcgctgcgtcccggaacgccggttgccattcagctcaatgaccagcaaaaagtcaccagcatcaataccagtgataaaaacacgctgtttcaaggcatcccattgcagctgattgatcatgacctgaatgaaggcttatggatcaaagggtatgtcaatggcgatgaaagcacggccaaaacatacgctgtcgatcatgacgctacgattatcgaaaatgacggcacggttgttcagattgcgcctaaagacgtgcagtttcgttctgccagtctggttaatcgcatgctgaccaacttcgcggggccgttcaacaacttcttgctgtcgttggtcgtctttattattctgggctttacgcttagcggtattccaaccaacagcaatcgactgggcgcggttcgttctgactcggtagcggccaaggcaggtttgcagaccggtgatcggattaccgagatcaatggtaaaaaaaccaagaactggactgctttggcaactgaaatttcgggcaatcccggcaaaaagctgacggttgagtatcagcgcgatggtcgtcaatataccacgacgatgacgcctaaaaaggtcaagcagggaaatgaaacggttggtcaggtcggcattgttgaagaacaaaaaaccgatgccaaatcaagaattatgtttggctggcagcggttcgttcaggccggcactctgattttcagcgtcttaggtcacatgtttacacatggctttagcctcaacgacttaggtggaccggtcgcaatttatgccggtacctcgcaggcaacggctttagggatcaatggcgtgcttaatttcttggcccttttgtcgatcaacctgggaatcgtcaatttgctgccaattcctgctcttgatggtggtaagctgttattgaacattatcgaggcagtcatcaggcggccgattcctgaaaaagccgagggaatcgttacgattattggttttgcctttttgatgctgttgatgattctggttacttggaacgatattcaacgctactttattcattaaaaatcttggctccgtttcatgaagccgttcaaaggagtatttttctaaattatgaagcaatcaaagattttgattcctaccaaaaaagaagcaccagctgatgccgaagcgctcagtcataagatgatggtgcgggctggctatatctatcaggtctctgccggggtctgggcttatctgccaatggcctaccgcgtaattcgcaaggttgaaaacatcattcgcgaagaaatggacaaggctggtgccgttgaaatgatgatgccggcgctgctgcctgccgatctgtggaagaagtcgggccgctacgaaagctatggcgacaacctgtttaagctcaaggaccgccgtgatcgtgaattcatcttgggaccaacgcatgaagaaacgattaccagtattctgcgtgacagcgtgcagtcatataagaaactgcctttagtcgtttaccagctgcaagacaagttccgtgatgaggatcggccacgctacggtattctgcggggtaaggaatttgaaatgctggatggctactccttctctgccgatcaagcaggtctggatgaggcatacaacctgcaggctaaggcataccgcaatatcttcgacaagattggcctggattacaaggtgatcctggctgattctggtacgatggggggcaagaactcccaggaattctccgcaccagctgaggttggggaagatacgattgcctacacggatggaacctatgctgccaacctggaaaaagccacgagcaagtttgtcggcgtccagcagacggctgatccggctgaactgcaaaaacaggctacgccaggcgcgcacagcgttgatgaggcagccgaaagtctgggtctggaaagcagtcagatcatcaagtcgatgctgtacatggctaagatggatgaagaagaaacggtgccggtactggtattgatgcgcggtaatgacgaggttaacgaaaccaaagtcgaaaatgcgctagactgtgaagagcttagtctggccactgaagaagacgcagaaaaatacctgggtgcgcatcctggttcgcttggtcccgttggcgtgggtgaagaagtcaagatcttggccgacaactacgtcaaagtcctggtcaacatggcttgcggtgctaatgaagacggcttccactacgtcaacgccaatttagatcgcgacttccgcgttgatgagttcggcgacttccgaaacgttcaagaaggcgaaatcgcgccagatggtcagccaatcaagtttacgcgtgggatcgagctgggacacatcttcaagcttggtacgcattattccaagatcttaggcgcgcaggtgctggatcaaaacggccggcaaaccgatatggtaatgggctgctatggcatcggcgtctcacggctgctctcggcggttgccgaacagacggctgacgaacatgggctggcatggccggacagcatcgcgccatttgacgtgcatgtaattccggttaacgctaaaaacgaagaacagatgcagatggccgaaagcatcaccaagactttggaagcggctggctatgaagtactgctcgacgatcgcaaggaacgggccggcgttaagtttgctgatgctgatctgattggtctgccattgcgggtgacggtcggcaagaaagtcagcgaagggatcgttgaagtcaagatccgcaagaccggcgagacgattgagattaagcaggaagaaattgaaaacacggttggcattttgcttaagcagctgacgccagctaccgagacagccgctgactaattattgagcggcagactttacaaaaggtggtttaaaggtagaatagattctgcttttagccgctttttttaatgaaatcagagaggagcattggagtggagttatcacgacatgaactgtttgagcacttgctggatcagctgaacatggctaaagacgatcctgcttttaaagacggcaagatcaagcaggtaatcgttcaccgcaagtccaagtgctgggaatttgatatcgtattgcgcaaggtaatgccttatgaattgtttcgccagttcgtctcagctttacagatcagttttcgcgagctggcgggcgtggatgccaaagtcagaatcgatacgccgactgatgaattggatgctaaggcgatcggcgactattggtcatacgtagtcgatgccgaagtcggtgaatccccaatggcacgcgaggtctgcgccaagacgattcctgaagtcgatggcaaccgagtgcagctgctgctggaaaacgaggcgatcaaagactttttcgtcaagaaccttttaagtgcaattgaagaaggctaccaaaaagtcggttttccacagtttcggattcatccattggtcgatcagtcagcttccgagcaaaaaatcaaggagctcaaggccaaacagcagcagcaggaccaggagctggttaaaaaagccatggagcgactgcagcagcaaaaggccgaaaaaaagcagcaggaatccgcgctgcctgacctgggcgatggtccgctggtcattggcaagtcgatcaatcccaaagagccggtacgacggatggctgagattactgaagaagagcgtaacgtggtcgtggaaggctatgtcttttcaaaagaagtccgtgagctgcacagtggccggcagttgctgattttggaagtaaccgactacacgtcatcgtttgccattaagaagttctccaacaacaaagaagacgaggccaagtttgcggcaatcaaagaaggcgagtggatcaaggcacgcggtccggttcaagaagacacctacatgcgtgatttgacgatcatggcctatgccatccagcaagtcagtcatcctgccagaaaggatactgcagaaggcgagaagcgggttgaactgcatctgcatactacgatgagcacgatggatgccaccaactcgatttctgattacatcaaacaggcggaaaaatggggaatgaaggcaatcgcggtcaccgatcatgccggcgtccaggcgttccccgaagcgtttaatgccagccacgacaaaaagggcaatgccaagatcaagattttatatggggtcgaggcgaatgtcgttgatgacgggattccgctggtctataacgaaaaccatgatgagcttttaggcaatacctatgtcatctttgacgtggaaacgacgggactttcagccatctatgacaaggtgattcagctgtcggccgttaagatgcgggacggcgaggtgctggactcgtttaatcagtttatcgatccaggctttccgctttctgaacaaactaaggaactgaccaagatcacagatgaggatgttaagggatccaaatcagaaactgaggtctttcagatgttccaggacttttgtaaaggctgtctgctggctggacacaacgtcagctttgacatgggctttttgaacaccggttatgaacgcgatggcttgccgcgcattacggccccggttatcgataccctgccgctggcgcgcttcttgcatccagaaatgcaccggttcacgctggatacgctgagtcgtaagtttaaagtcgggcttgatcatcaccaccgggccgaccacgatgccgaggcgacgggacacctgctgcacatctttttaagagatgccgaaaagcgctatgatgccaaatacgttgatgacttgaacaagcatatgtcagacaatggcgcctatcgtcatggccgaccgtttcatgccacgatttttgccaagaatcacacgggactgaagaatctttacaaactggtctcattggctaacgtcaaatacttctatcgggtgccgcgaattccgcgcagcgtgctcgaccactatcgcgagggcctgctgatcggtacggcctgttcaaaaggcgaggtctttactgcaatgatggaaaagggctatacggatgccaaacaaaaagcgcagtactatgactttattgaagtgcagcccaagcctaactacgcgccattgattgagcagcagatcatctcaaataccgcgcatctagaagacattatcaaaaacatggtcaagctgggagcggatatggacaagccggtcgtggcaactggcgacgcgcactaccttaatccagaagacaaaatctatcgtcacattctgatcaattcgcaaggcggtgccaatccgcttaaccgtacgcgccggcctgacgttccattccgcacgactgatgatatgctcaagcagtttgcgtttttgggtgaagaaaaggcgtatgagatcgtggtggaaaataccaatcggctggccgctgaaatggatgagatgcggccagtgcaagactcgctgcacacgccgaacatgaagggcgccaacgaggaactggccaagcgaacctgggatacggcccatgcctggtatggcgatccgttgccaaaactggtcaaggatcgggtcgaactggagcttaactcaattattggcaatgggtacgcggttatttatctgattgctcagcgtttggtagccaagtccaataaagacggctatctggttggctcgcggggatcagtcggctcatcagtcgtggccaatctggcagggatcacggaagtcaatgcctttccgcctcactatcgctgtcccaactgtcaatacagccatttctacacaaaaggtgagtacagctcgggctttgatatgcctgacaaagactgtcccaagtgcggtactttgatgatcaaagatggtcacgacattcctttccagaccttccttggctttaagggcaataaggttcccgatatcgatctgaacttctctggcgactaccagccaatcgcgcataactatatgaaagtgctgttcggcgaaaagaatgtttatcgagctgggacgattggaaccgtggccgataagactgcctatggatacgtcaaagcatttgagcgcgacaccgagcagcagtttagaggcgccgaagaagaccgtttggcaaaaggcgcgaccggcgttaagcgaacgaccggtcagcacccggctggaatcatcatcgtgcctgatgacatgagtatctatgactttacgccggttcagtatccagccgatgatcaaaacgcggcctgggaaaccacgcactttgattttcattcgattcatgacaacattttgaaaatggatattctgggacacgatgatccgaccatgattcggttcctgcaagatctttcaggcgtcaacccccaaacgataccgatggatgatccgggcgtaatgagtctgttctccagtcctgacattttaggcgttaccgaagaacagatccaaagtaagacgggaactttggggctgccggaattcgggacgcggttcgtacgggggatgcttgatgacacgcaccccaagaactactcgcagctgctgcagatttctggtctttcgcatgggactggcgtgtggctggataatgcccaggaactgatcaaaaacggcacggccacgattgccaacgttatcggctgtcgtgacaacatcatgaccgacttgattcactatggcctggattcagaaacctcctttcaggttatggaacacgtgcgtaaaggacgcgggatccccgatgaatggcaggaaaagatgctgcaggctggcgtgccgcaatggtatctggattcctgtctgaagattcagtacatgttcccaagagcgcacgcggcggcatatgtcttgatggcgctgcggattgcgtactttaaggtctacttcccgttggtttattacgcgggctacttttccgtgcgggcggatgactttgacgtcgtggccatggctcatggcaaggatgccgtcaaagcgcggatgcagcatatcaatgaccagggcaatgaggccagtgccaaggacaagagcctgctgacgattctggagctggccaatgagatgctggagcggggctacaactttgaaatggttgatctgaaccgttccgatgccactgactggctgattgacggtgattcgctgattgcaccgttcagagcgattccgggtctgggggtcaacgttgccaagcagatcgttgccgctcgagcacaacggccattcctttccaaagaggatctttctgagcggggaaaggtctcgcagacgctgattcagttcatgacggccaatcacgtcttagacgatctgccggatgaaaatcagctcagtctgttttgaccacggctgaatcgttgactgccatggctggtaatctgatcaaattagtttcaggctggtttttaacgatcttgattttagtctgatcagcgggcaaatgctgctcatggttgctaagccagaataaagatgctatactatcaatagtgaataactcgttagggagtgagcagcaatgctcgctctttttattgcaatgaaattggaggtggcggatttgagcagtacggtggttgacgcggtcgaaaagctggttgagccgatcttgaccgagcatgactttgagctgtatgatatcgaatttgtcaaagaaggacaaagctggtatttaagagtctacatcgacaaagacggcggcattacgctggaagactgtgccacggttagcgatcagctgagtgaggcgctggataatgccgacccagacccgattccccaggcatactttttagaagtatcttcaccaggtgcggaacggcctttaaaaaaggaaagcgactatcagcgggcactgaacgaatatattcatgtctcactgtaccaggcagttgacggccgcaaggtctatgagggtacgatgactgatctgacgcctgacagcttaaccttggattatttggataagacgcgacacaagacgattacgctggatcgtaaaaaaattgccaaggctcgcttagcaatcaagttttaataaaggagcagcaaaatgagcactaagaagcaaaagcaagcacaagaactgcttgatgccatgaacgtcctggaaaaggaaaagggcatcaagaaggaagtcgttatcgaagcactgacggatgctttggaaaaggcctacaagaccaactacaacgccagcaacgttgaagtaaagatcgatgaaaacacgggtgagttcaaggtcttttctgacaagacggtcgtggccgaagttgaaaaccctaaagaacagatcagtctgcacgatgcctgggaaaagagccatggctacagcctgggcgacactttccaagaagaagtgacgccgcatgactttggccgcctggcagcgcaaacggctaaaaacatcgtcctgcaaaaactgcgtgaggctgaacgcgaccgggtcatcaacaagtatgacaaaatgctgaatgaattggttgaaggggaagtctctcgtgaagacaaccgctttatctacattgacctgggtgatggcgtggaagccggcttgagcaagcgtcagacgatgcctaacgaagagtatcggattcacgatcgcgtccaggtctacatctacaaggtagccgatgccaagccaatgcagcagccagatggcacgcaaaagcgtcaataccgtggtccgctggtcttggtaagccggacggatccaggcatgctcaagcgcttgtttgaaaaagaggttcccgaactcaaggaacaaaacggcccaatcgaatggaagggcagtgcacgggaagccggcgatcgttccaaggttgccgtagcttcaaaagacccgaacatcgatccggttggtacctgtgttggtccacgaggcgcccgggttcaggcaatcgtcaaccaactgggcggcgaaaacatcgatatcatcgaatacagctctgacccagcgatcttcatcaagaatgccttgaagccagctacggttgaccgcctggactttgacgacaacaacggtgaagaagaggatacgggcagcgttgatcacgaaggcaacaagatcgtcaaggttcatcatggctgcacggtctacgtaccggacgatcagttgtcgctggcaatcggcaagcgtggtcaaaacgttcgtctggctgctcagctgaccaagtacaagattgacatcaagccatccagtgaggcaccggctgtcgaagatcaaactgatgatttcgctgatgatgctcaaaacgatgcaatggatggcgaataagactacaatagaaaaagaaattgaagcaagattgaatggaataaattgagcagcggggtgaaacaatgaaaaagagaaaagtaccgatgcgcaaagacatcgttaccggcgaaatgatgcccaagcgagagctgattcgcgtggtgcgcaacaaagaagatgaagtcagcgtggacccaaccggtaaaaaggctggtcgcggcgcctacattgccgcagatgtaaagattgccacgcgggcaaagaaggaacgcacttttgacaaggcattcggcgttaagctggatgatgccttctatgatcagctgattgactatgctgatcacctgcaggaacggatcaagctgttcggtcacgtttaatgacagcttcagaacagcagatcttgaaccttttgggattagcccggcgcgcccgtcagattacggctggggaaggattggtcttaaaatcgatccgcaatcatcaagccaagctggtctttttggcagctgacgccggtcattccacggtcaagcagtttatcaacaagtgtaattattatgaaattccactgatttgccgattcaataaagccgagctaagtcaggcgattggacaggcacgaacggtggttgccgttgaacaggccggttttgccaagcgcatgatcgaactgtcaaacgacgctgaagaaacaacaaaataaataaaggagcgtgattcgatggccaaagaacgaatttacgaactagccaaagagctgaaaatgccaagcaaggacttggtggatatggccaaaaaggagggaatcacggtgaaaagtcatatgtcttccgtgacctcagaagaagccaaccgtctgcgcagcatggccaagggtaccaataagccagccgctgccaaggccagccagccaaagcaggaacagccaaagcgcccagaacacaacagccgtccgcaaaacggtcagcagtctcaaaacaacaatcgccacagtaacaacaaccgtggcggcaatgatgacaatggccgtggcgttcacgttttcaacaaaaacaagaacaacaagaagaaccgtcgcaataaaaacaacaagcacaacaagaatcaacggatgcgcgaagtgaaaaagcagcagccaactcagcgtaaggatcgtccattgccagatgttcttgaatacacggaaggcatgaacgcgcaggatttggctaagcttttgcaccgcccagcagctgaaatcatcaagaagctgtttatgcttggcgtcatggttaaccaaaaccaatccctggatacggacacgattgagcttttggctgctgattatggcatcgaagccaaggaaaaggttcaagaagacattgccgacttggacaaattctttgatcaagaaaaccaaaatacggaacacatggtatcgcggccaccagtcgttacggttatgggtcacgttgaccacggtaagacgacgcttttggacaagattcgtcactcccacgttacggattctgaagctggtgggatcacgcaggcaattggtgcctaccaggttgactacaatggcaagctgatcacgttcttggatacgccaggtcacgctgcctttaccgaaatgcgggcgcgtggggccaacattaccgacatcacggtcctggttgtagctgccgatgacggggtcatgccacagacggttgaagccatcaaccacgccaaggctgcccacacgccaatcatcgtcgctgttaacaaggtcgacaagccaggtgccaatccaaaccgggttatcgaagaactggcccagtatgaattgatcccagaagactggggtggcgacacgatctttgtcaatatctcagctaagtttggcaagaacatcgatgaactgctcgatatgattctgctgcaggccgaaatgatggaattgaaggccaatccagatcaaaacgccgcgggttccgttgttgaagcccggctggatcaaggtcgcggtcccgtagccacgctgctggttcaacaaggtacgatgcatgttggtgacccaatcgttgtcggcaacacgtttggccgcgtccggacgatgaccaacgaaaacggtcgccgcatcaaggaagctacgccatctacgccagttgagatcactggtttaaacgacgtgccagaagccggggatcgcttcgtagtctttgacgatgaaaagacggcccgcgcagctggtgaggaacgggcaaagcgcgccttggttgaagaacggcaaaagaccagtcatgttacgctggacaacttgtttgccacgatgaagaagggtcagatgaagacgctgccggttatcatcaaggccgatgtgcaaggttccgttgaagccctggctcagtcattggaaaagatcaaggttgacggcgttcgcgttgacatcatccacaaggccgttggtgccatttctgaatccgatgtcacgctggccgaggcttccaatgccgttatcattggttttaacgtgcgccctacgccactggccaagtctatggctgaatcaaacaacatcgatatccggctgcaccgggtcatctacaacgcgattgaagaagttgaagatgccatgaaagggatgctggaaccggtttacaaggaagaaacggttggtcaggtagaagttcggcaaatctacaaggcttccaagattggtacgattgccggtgggatggtcatcgacggcaagattacgcgtgattccaaggtccgcctgattcgtgacggcgtggtcgtttacgaaggcgaactgggcagtctgaagcgtttcaaagacgatgtcaaggaagtcaagcagggctatgaatgtggtctgacaattcaaaactacaatgacatcaaggaaggcgacgttatcgaagcttaccagatgaaggaagttcccgttaagtagcttctagtcgctaaaggagaaaaacatgccaaataaacgctatcgggtggatcgactggctgaacagattcagcgtgaagttgatgacatcctcttaaagcgcgtgcgtgatccacgagttcaagacatcacgatcacgggcgttgacgttacgggcgacctgcagcaagcgacgatctactacagcctgctgtctgacaaggccagcgatggcgagaaggctcaacaaggtctggacaaggcaaaagggctgattcgcagcgaactgggcagtcgtcttaacattttcaagactccagagctcacgtttaagcgtgatccatcggttgcttatggcagtcggatcgaccaattgatcaaccagctgcacaagcaggagcgataatcagttaaaagggagcccagcttgcggcccccttttattatttcaaaaaatgaaagcggtgaaatttttggacgggattattccattgtacaaagaacgcggtatgaccagctttgactgtgtcagtcggttgcggcgaattctgcacacaaaaaagatcggtcattcaggaacgctggatccaaacgttgatggcgtcttgccgatctgcgtgggtcaggctaccaaagtcgttgagtttttgatggcctcgggtaagcaatatgtaggcgagcttttagttggtcaggcgacgacgactcaagatctggatggcgaagtcgtggcccaaaagccagtcacggcaccaattgatgaagacacgatcaagcaggccatgcaggagctgaccggtgacattgttcagattccgccgatgtattcggcaatcaaggttaatggcaagaagctctatgaatatgcccgcgctggcgaaaccgttgaacgtcccaagcgtcacgttcacattgcgcgctttgaaatgacggcttccagctatgatgaaaaaaagcagcagcagcggattcgttttgtggtcgactgcagcaagggaacctacgtgcggacgttggcctatgatctggcagaaaagttaggctatcctggcgtaatgagcagtctgacacgaactaagagtggcggctttgaattggatcagaccctgagtctaagcgatattcaagatgccatggaagcccagattatgaatcgctatgtctatccaatggactatgccttgcagaactatccacatcttgaattgacggaagcgcaatggaaaaaggttcaaaacggcggctggctgagcggtctgaacacccaagaacctgagatcgcgctgacttatcaaggcgaggtcaaggcactgtatcaggcaaaagatcagctctataaaccgctgaagatgctgtcgacaaagtaggtgggatagatgcaggttattaagattcatcatccatttgatccggcgttgataccagctggaccagttgttttagcaatgggcttttttgacggtattcatcgtggccaccaggcggtaatcaaaacggcgcgccgcattgctgatgaaaagggactgccattagctgttttgacttatgatcatcggcctgagatcgtctatcagcagtatccagctggcggcgttcattatctaacgccactgccgcgcaaattggatttgctaaagcagctgggagtcgatcgcgtttatctggttaatctcacctcggcgctgtcggctttagatccgcagacgtttgtcgatcaatatctggtgggatttcatacgcaggttgccgtagctggctatgaccatacttatggagctgatcccagtgtggccaatatggcgcatctaaaagagtttgccaaaggacgatttgaggtagtaaccgttgaaaaattgacgctgcaggataatcataaggttggctcaacacgcatccgagagctgttggagcttggtgacgtgcaatcggccaatgagcttttaggctacttttaccagacttccggcgtggtcgtgcatgggtttgcgcggggccgaacattgggctttcccacggctaacgttgcctggcctgaagcagagtggctgccatcaatcggcgtttacgtcgtgcagatgaaaatcggtgagcgttggtataatggaatggccagcgtgggtcgcaacgttacgtttggcgatcataatgaaaagacactggaaatctacctgttcaacttcaatcagctgatctatggcgaaaacgtgcaggtgcgctggatcaaacggttgcgcggcgaggtcaagtttaacagtgcggacgatttgattgcccagatgcgacttgatcagcatcattcggaactgacgctgcaaaatctcaagactctgccaggtcagattttgcaataaattaaaagtaaacggtgccgattttttaccggcaccgttttttactgtctgcaagggtcggaatggtttgtgattgatcaagaagaactgccaattttaaatcagcagcgtgttacaataaacgcaaatcaatcgcgaggtgatatgatgaaaattggctttattggcaccggtgtaatgggaaccggaatgattgccaacctgcttaaggcgggcaatcaagtccaggtctataatcgaactaaggagcatgctcaaaaagttttggacctgggcgcaaaatggtatgacacgccggctttggcaatgcagaactgtgaagtcgtgatgtcgattgttggctatccaaaagacgttgagcagatctattttggcgaagacggtctgctgagcggagcagttcctggtcagtacctgattgatatgaccaccagtcggccagctctggacaaaaaaattgtcgctgcggctccagctggcgtgcatattttggatgcaccagtttcgggcggtgatctgggagcaaaaaacggcacgctgacgatcatggtgggtggtcaaaaggctgattgcgaatatttaacgccgctgtttaaacagattggccaagatgtcaactggtttggtcctgccggcagtggtcagcatgccaagatggccaaccagatcatgatcgccggaacgatgactgggatgtgcgagatgcttgcgtatgccaaggctgctggtctggatctggcaacggtgatcaagacggtcggtgggggtgccacggccaattggagtctggacaactacgcccccgtattcttaaaaacgactttacgccgggctttttcgccaagcatttcttaaaggatctgtgaattgcgcttgatgaggctgcgcggatgaagctagagctgccggcgactaaggaagccgcgcgtctgtatgaaattctggttgatgaaaaacagctgggcaatgatggcacgcaggctttgatcaagttatggtgggattagcaaaaaatctcaatttatggttgacaatcagtactgatcgttatagtatgattacaacaaaattagaaattgcttagaagagatgagtagtcgcgggcagcctttaaagagaaccggggtaggtgagagccgggatcgtgaaacgcgatgaagatggtcttggagcaagtcggtgggcgagccgtttggtaagccggccgcggggtgacgtccgatatcacggtccgggtcttctaattttttagagtactcagtaagggctagattgtgaggtctagctgaatcagggtggtaacacgttgaataagcagtcaacgtccctgggagaaagtgcaggatgtgcttttcccagggatttttaatttcctgagaagtcctgccaaacaagcattttcgaaaggaagttatcacatatgacgcaagcacaaactttaacttttaccaaccgcacgacttcaccattccgttatgacattgtaggcagtttcctgcgcccagccgaactaaaggcagcccgggaaaaatttgccaaccatgaaattgatcatgatgaactaaaagccgttgaagacaagtgtatcaaggcgctggtcgcaaaagaggcacaagctgggctgcacgcggttactgatggcgagttccggcgttcatactggcatctggacacgttttggggctttgaagggatcgcgcatactaagccggcacatggctaccgtttccatgatgaagaaacgcgggctgattctgctcaggttgaaggcaagattcgttttaacggcacgcaccccgatctggaagcctttaagtaccttaagcgcttaacggatggcacggacttgatcccacgccaaagcattccggcaccggcgcagctttattctgaacttttccgggatgatgagcacgtggcggccatcaaaaaatactatgattctgaagatgatctgatcaaagacgtagctgctgcctaccatgatctgatcttggcactgtatgatgccggttgtcgcgatgtcaagctggatgactgtacctggggactgctggtagatgaagactactgggcaactcgttctaaagaaggcgcggatcgggaaaaactggaggcaacctatctcaagatcaacaatgcggctttggctgatctgccggctgatcttacggttacgacccatgtctgccgcgggaactatcattcaacctgggcggccaagggtggttatggtccagttgccgactacctgtttgccaaagaagacgtggcagccttttatctggaatatgattctgagcgggcgggcggctttgaacccctggccaaggtaccagctgacaaatacgtggtcttagggctggttacctctaagtctggtgaattggaagagcggcaggcaattttggatcgtattcatgaagctgcgcaataccatgatttggacaagctgtgcctgagtccacaatgcggcttttcctcaactgaagaaggcaatattctgactgaagagcagcaatgggctaagcttgcgttggtcaagagcgttgccgaagaagtctggggcgcttaaaccaagtcttgaccgctagcggatcggccacgctacgatagtctgtgtgaaaattagtgggtgggaaagcgaaacggatcagtcaaatcctaaatttccaatacaagtactcttataactctccttaaatttaaaagatagcgcatctcaaaaactaaaacttggctgttccgttcataccactaaaactacgtgacgcatttctcgaattaacgttctgacacttcaattaagaaaactcctgattaattactgaatcctaaaactcgcttggcagattttgccaggcgagtttttttgcgcaggactcaggatcgctaaccagagataccgcacgcagtcagtttcaacagtcgataaatggggtgtgtcaattcttaccgcagtcgtttttgactagcggtagaaaaaagcgaagcaatcagaaatttgcagttaggcaaggacttgatttcattgataagcagttgctcagcagtcataaagtcaaaggcggggatcaatgatgcggtttatgcaaaaaaatctgcataaaacatatgacaaaaagatcattacctacttttctcaaaaatcgattgcatagtaggtaaaaattaatgtatatcgagttagggttccctaacattacctactattagcggaaaattaccaaatagtaggtagttcacaaagtcggtataacccaatcaaccccaatcagctcttaaatatacatctttacctactatttcggaaaaagatgctgaaagtaggtaaagttaaaccggccgagtatgcagctacctacttccgatcaaaaatcagcgtaaagtaggtaaatttggcccgcttaatctttgaatgactgctttctggaggatggctggcgataaaaggccacctgttaatactgaagtacccatgacaacagctgaaataccattgactgtctgcccataacatgaaaaaaagctcatattaaaacatttttgttcattttaacaaatattaatttcttagattgttaaaaaatacaaagtaaaaacacgaacaataaatcttgttatatcggcgttctgaaatattaaataaattatacttatcgatttttaattttataacggatgaaatcagcctgatttgagttgtgcaaacgattttttgttgttgctttttaaattcgtgtctataatcgatcagtgaaatttgaaagtctatttaatgccttttttgtagattaaagatacaaggtgggaattgaaatggggagaaacaatcaaaatgaccggcaaaggcaattaatgtcgattttgccaagatatgctctgcgtaaaacaaagcttggctgtgtctcgatgttgattgcagtcggttttttccttggtggtgctaatgaactaaacgttaaggcagatgcgttgcccgcgcaaaatggcaaaacagctactgttcaaagcaaggctccatcagtagattatggatccttggcagctgctgccgattcttttacagcttcggtaaacgagaaaagcgatcatccggcaaaagcatcgtccttaacagcaacaacaagtgcggcttcagtagctgccaatgtcgctgctgataatagtgatagcaaggtttcttgtgatgcgttaggcagtgtgcaggctgaggcttctactgacgactcgacagcggtctatcaaaacagctcggccttagtcagttcatcagcgcgaggccaagctggtgcagccattagcaattcagccgatagtgcacaggatcccagcatggttatggccagtacagcccaaaaagtgtcagagccacctgccgttcaaggcaatgctactgaaccatcacttatcaatactactggtgcagtcatgaacgatccttcgctgctggctgaagacgtaaccgttgatgccaaaaacttcaatcactactttgatatgcatggtacggcaactgaccggcttaactctgatggctcggtaacgattacctttaccaaaaaagggcagcagtattcagttgggggcatatcgctaaaagaaaagatcaatatggacagcagttttaccctaaatggtcagatcaatctgggcaactttggcggtgctgatggaatgggaatcgtctttcatacgggaagcgttgatgcgcttggtcgaccgggcggcaatctaggaattgcggggctgccggatgcggttggctttaagcttgattcctattatgactactacaatgagccaacctcgagtctgccaggcgatcagatcccacttccgcaaaatggtgaggatgactctaaacatggccagtcacaggacccaacaatgaccgttccatatggcgatatcgttaccaccagtcatgaacaggttacaacgactactggcaaaaaggcttggcgatggtgggtcaataatcaagacggcacggttcaggcactgaccactagcttgatggacggcaggtttcatgattttcaaatgcaatataacggtcaaacccatgtcttgacaatcaaactgaaagaaccagctggacatcttaatgacggtgttcagacgcatgaagatgagcaatgggttacgtggacctaccagattcctgatattcctggcaatggcaatgtcgcgatggcacttgatctggcggcgacgactggcgaattaaccaacctgcaacagtttagattgaccagctttactttttcgccagctgcttcagtcaacgttgaatatctcaatgaacagggtcagctgattcatcagactggcgttcactacagcggcgcgccggtaattggcaatacgtattctacagatcagcttaatcttcctggctatacatatattggcttgggaaaaggtagtcttgctccaagcggcacgctaagaaaggagggacttaacggtacggttatctatgtttatggtcgtaccgaaaagatcacagttaattatcaagatgtcagtgcggatgatccgcaaaatctcagtgggtatgatcaagaactgaccggtgccagaaatcagagttcagactatagtacggctaagataatcaaagagctggaagcaaaaggctatcagctggtcaatgatccgactggcggcaaggtcttgaaatatggtgatggtgcgcaaagctatacggttaagctggaacatcgtcatctcataatcggtcccagtcattatcaagacaatggaattccgttgccagacaatccagcaaagacctatcaaggagttgagcgaaatgacctgaatcagcaagccacacggacgatcaagtatgagtttgcaaatggccagccagccgctgcggcagtaagtcagccggttgcatataccagaagtgctgatattgatgaggttaccggtgatgtggtctacacgccttggactgcagcgcctgcgaagtatccatcgattgcttcaccaaagattcctggctatttcacgaatacgccgtcagttgctgccgcctcgccaacgcttgggcaaaatccggttgtaacggtgatctaccagccatgtatagaaaagatcaggattgtctatgaggatgtcagctctaaagatccgcaaagcctcagtcagtatgacaagctgctgacgggaaagtatggatcaagtgccaactacagcacggctgatacgattaaggctctagaacggcaagggtatcagctcgtcagtgatccaactgatggtcagattctcagctttaacgacaccagcaaacaaacctacgtaatcaagctgaagcgtcagtcagctaatcctgatcgtcacgccagcggttctgttaagtcgccaacgtcaaagccgactgatacgcaagggaaaggtacagcgtcgactgctgccggggtcaagactgatgatcatcaaatcaaacaacagtctttcagccagccgattgacggtcagacggatcagtcgggtaaagctcatcatgtcgtaattgccgattcaacgtcatctgctatccaattaactaaaagcaacaattatgatgcggtttcagcccccaatgaaacggcatcagtcaaacatcttccacaaactgggaatcggcatgccgacttattgaccggcttaggactcttgatggctggaattggcggctggctgggctttgacgaggttcgtagacgtttcaaacgagtcttaaagtgaggcagacgcaatgaaaccattaatgaaaaaaattccgccataaaaggatgaatttgcatggatatcttaaggtagtcaaattttgcataatctcaattattaaaatctaatgaatgaaggcgaaagcttatggcaaatgaatcaatgaaaaccggtgccgaccttttaatcgacgctctgcaaaaaaatggactgcaaaatatttatggggtcgttgggattccagtaactgattttgcgcgtctggctcagttgcgcggcatgaagtactttggttttcggcgtgaggatgcggcagtggatgcggcggcagcggccggctatctgacacagaagccaggtgtggccctgaccgtttctgctcccggttttttaaatggtttgacggcattggcacaggcaaccaagaactgttttccattgattatgatttccggctcatcggaacgtcacattattgatctggaccaaggcgattatgaaggattagatcaatacaacgttgccaagccgttctgtaaggccgcctaccgagtcgatcgcgctcaagacatgggtttggccgttgccagagcagtcagaacggcattgtcgggtcgtcctggtggggtctaccttgatctgccagccaacacaattggccaacaaattgaggtcaccgatgactctgatgccggcatttatgaagttgtcgatccagcaccaaaacaggcaccaagcgatgaagcaatcaatcgggctgttgaggtaattaagggtgctaaaaagccgctgattattcttggtaaaggggcggcatacgcgcaaagcgaaaaactggtgcaaaagctggttgctgaaaccgatattccattcttgccaatgtcaatggcaaagggtttgatctctgatgaagacgatcattccgccgcggctgcccgctcgctttcgttaagtgaggcggacgtagtgattctgatcggtgcgcggctcaactggatgctttcacatggtgcggcacctacgtttaatccgaacgctaaattcgtacagctggaaattgaagcgaccgagtttgattccaaccaaaagattgctgcgccactgcagggtgatttgaattcaattttgaccaaactggtaccggcgcttaaaaaggctgactatcacgctccaacagattggctggcggcaatcaaggccaagactgccgaaaacgtcgctaagtttgcgaaacgcgttgaagccggcgaaaccaatgccaagtttggctactatggtgcgctggaaccaatcaaagagtacttcctgcagcatcctgatacctacctggtttctgagggtgcaaacacgttggacattggccggaacatgattgacatgaaactgccgcgccaccgtctggataccggtacgtggggcgtcatgggcgttggtctgggctatgcgattgcgacggctattgagaccggcaagccagtcgttgccttggaaggcgacagtgcctttggttttgatgggatggaaatggaaacgatctgtcgctatcacctgccaattactgtcgtcattgtcaacaacggtgggatctacaacgggaccgaccgtgaagttgccgatcagccaggtccaacgatgctggatgccacggcgcggtatgaatacatggccaaggcatttggcggtgacagctactttgtaagcagctatcaagagatgaaggttgtctttgaacaggcggttgcatccaagcggccaaacatcatcaatgttcagatcgacccatccatgggtaaggaatctggccacattggcaacctgaatccaaagctggatctgaagaagtagtgaaaggagcagataatcatggttgaagaaaagacaaatgaatatgcaccattaaagggaatcaaggtcgttgactggacgcaggtacaatccggtccttcatgtacgcagctgttggcttggctgggtgctgaggtaattaaggttgagcgtcccgacactggtgacccaacgcgtaatcaactgttggacattcaagattcctggagcctttactacctgcagctcaatgccaacaagaagtcattgacgctgaacatcaagactcctgaaggcaaacagatcatgacggacctgcttaaaaaggcggacgtgtttgttgaaaacgttcgcccaggagctgctgatcgcgccggctttggctgggaagacgtgcacaagctgaacccacgtttgatcatggcttcactgaaaggttttaaccaaggatcacgctttgctgacgtcaaggcctacgaaccagttgctcaatcagctggtggcgcggcttcaacgactggctggaataagggcgaaaacaacgtaccaacgcaatctgctgcggcattaggcgactccaactcagggatgcacctgacgattggtatcctggccgctttgatgcagcgggaacggactggcgaagggacgctggtttaccagtcaatgcaaaacgcggttatgaacctgtgccggatcaagctgcgtgaccagatcatgttagacaacctgggtgcactgccacactacgccgtctaccctgactacaagtggggcaaggctgtaccacgggccgaaaacactgagggtggtcaagttattggctggacttacaaggctaagggttgggaaactgatccaaatgcctacgtttacatcgttattcaagactccaacaagagctgggcagccatcgccaacacgatgggtcacccagaatggattgacgatgaacgcttcagcgactgggaacaccgtcagctacacaaggaagagatctatccactgatcgaatcctacaccaagcagtacgacaagtatgaattgacgcaaaagcttggtgaggcaggcattccagttggcccagtcattgattggcatgaattggaaaatgaccctgacttaaacgaagatggcacgatcgttacgattgaccaaggcggtaaccgtggtaacttcaagacgattgggatgccatttacgttaggcaactacaagccggactacaagcgggcaccagacctgggtgaaaacaacgtcgaagtactctctgctttaggctatgatgccgatgaaattaacgacttggttgaaaaaggcgtcatctcaaaggctcgtggccctaagaacccacgtcgggaagtaatcaagggcaaataagctaaaggcatttgccatggcttgggtgggatgaccggcattgaccgcatcccacctttttattgccaggcatgccaaaaagagaattggaggggtagacatggaaaaaatattaattgatgatattgttccaattttggttatcatgattttgggctatctgtgtggtaagttttcattctttgacgatgaccaacgacaagggctaaacaagctggtgctaaacattgctttaccggcggcattgttcatctcaatcgtttcggcaacgcgtgaaatgtttgctaaagatatcgtcttaaccttgattgcctttttcggggttacgggtctgttcttgctcagctactttttggacagaatcatgtttcaccggaccaagcaggaagccgccatttgtgcaatgatcgctggttcaccaacgatcgggttcctgggttttgcggttttggatccgatttatggcaatgatgccaataccaacctggttatcgggatcgtttcaatcgtagttaacgcagtgacgattccaattgggctggcactgatcaacaaaggtcaagccgaagctcgggataaggcttccaagaccgatggcgaaaaggtcaagatcaagctgccgcaaaagtctggagaggtggcaccggtaaaagaaaaagaagttaccgtcgcggacgggattccggttaccgatgctgaagccaaggcattgcgcgaaaaaggcattattcgtgaaatcgatctggttagagctgaggctcacaatcatttgggtaaaggtgaaaaggacaccagcaactcaacgatggctgcgattgtcaacgccatcaaaaagccggttgccgcagctccattattggccttcatcctggttttactgggtatcaagattccagcttcgtttgcacccagctttgatctgattgccaaggccaactccggggttgccgtattggcagctggtctgtcactttcaacggttaagttctcaatcgacaaggaatcgctttggaacacgttctatcgtttgcttttgacgccagccattattgttttggttgcctacctttgcgggatgggctctgatccaaccaagatctcgatgctttgcttggcaaatgctctgccacctgcattctctgggatcattatttccagtcgctacaacatctatgtcagagaaggggccagttcagtggcaatttccacagtggcatttgcagcgacctgcattttctggatctggctgttgccgatcctggctgcacacttctaagcagcaatagttgaatctttactcacagtcatactttcttcctggacataattaacatccactcactttctaaacggatatcgacttaaaacttcggacacatacaatagtagaaacctttcaaaaatagcgatcgcaccatttttcgacctcaatcaggccaagaaatggtgcgattttttgcattataaaaggctcccacaagcatgcggaagcctggtgattaaggcttaagtccctaaaactctttattttggttggagtaggtccatagaatacgtataagtcgttttactcatatcatctatattttcgataattagataatagtctcgattataatcatacgtttgtttctgcacggtaatagtgactgaaataacacgatcaattgcactacctttgcgatcggcatcaataactacctgattggagattaaattatctttatcatctgtaaagtagacacgatatctcgctggtcgtaccaaattactgattgctttaacttgattaaaagtgaggtgcatctggtaattattgattttatagtttgccatagcaagttttatttcagcgggaacagcttgtgatttatttgatcgtgctttgatatcaaggatcggaatcagcatctcttgtaatgaggaaccaccatgagcgtaattgctgttagatgacccacgtgagacaaagacacttttactacttggatagtaaatatgtgttggatcatcgttagctaaggaaactcccattgttgtttctttaattcccttgatattagttaattgatccttagttattaaatagcgggtatgtgcgttaccatcatatttctgatcagataggttaatcttgtcagtatcttcaagaggacgctcttgataaagaaaaccgtgatctgttgttacaatgatatgtgagacattatttgtacgcaaaacttgaatagcacttgtaatttccttaattgccttttcaacaccatcgattagttcattggtggtttttgtttcatgtccttttacatcaatttggttgtggtaaagataaataatgtcttgtcctgcaattacctgacgaatttctttagatgtcatatctaaaatgtcttttagttgtagggcgcgactatttatatcataactttgtaggatgttttcacggtcttttattgtagcaacactttggccatcaactttaattttgcctttttcataactcatacctttatgactatgtggcaacgctaaattcataccaaaactagtaattgaaggtaaacttgttaaggcgtaattcatatttagacttaagcggtcattttgatcaagttcatcttgtagttgttttccgacttcgtaacgtaaggaatcagaaaatataacgacaatacgttcattagagttttgaacatgattaaagtaaaagtgttcttgccgaaatttaggatcaactttttgtaagtcaaaagaattattccattgtttgattgaactatcaagttgcgtactgtagtagtaatctacttgtgttttgatttcactataaggatccgtattttgaattcggttataatctaacaagcataagcgatagatttgatcaatctgatagtcttgtcgaatataatcttgtaattcttcttgccaatcatctttagtatctaattgcatgttaaatagtaaagcagcctgttctaaaaagagatactcaggctcttggatagcgttatagttatgacgggtatgatcggtcattaatcggattgttgtcattaccatatcataatccgttacacggttttgagagaatttatctcgtaaccgtgccaaaacaagttcgttaacatcatcaaataatggtaatttagacaaatcatctaaggagcttttggcaaaagcatcctttaggtctaacttgttccaaacaaactcagtgtagtacttaaagtcatcggcataacgattagaatcggcatagcgatcaataaagatttgaacgttaatgagattagacaaataatattgatgtggtaagtgatcatctggacaataggtaactacgatgctgcacagtaattctaataaagatggattagcttgagtgtaaccaaagttatcagcaattaattgccagaaggcagcttgaacgttgtacttgttaaattcatctaaatattgattatcttctaaaccggctgacaaaaccttcattagcagttcattgatttctagtttttctgttttagtaattgctgctaaaataccatattctggttttgagataaaatcacggtcccaataacgtttaaagtcttttcgccgtgctttggccgcaaagtaagaacggtattttttaacaaagggaagttgttcattagtaaggcctaattcttcaacgattaattgggttgcatctgcactaaagatctttgaatagcgttccatatcggctaaaagatccaaagtaatttttggacgatcataaatggcatgaactaggtaatgattatttttatcattacgtaatgctagtttagtttctaattgatggtttttgtgagcagtatacactttaccatttagttgcggttcaatttccctaatggtttctgaaaactgatccttagggtcgaaccagaagacgtaaggatattgagtaaagtattgatttagtttatcaatgatattctgcttagtaagttctggcatgatcgtttcctctattttaattactaaattactattatagcgctcttaggtactaattagctagaacctgaactaattaaaaagcctttaacgatatatggggtttgaatccctcgttaaaggcttattctttataatttactcagtaatttatagccattttgcaatttagcatggttaactaagacaccatcgtcaaggtcaagatcaaccgggtttgctgataatgagcctaaaatttgatcgtacttaacgatttcgtcaatttgcttttttagattagcaataattcgacgatcaatggttttgttttttgaaacagtttcagcatctaacaacttttgtgtaactgataatcggctattcatcccagcttgtaaattatgcatgttttgccgtaccattgctaattcaccggtatcataacgatgcaagtacatcagtgctttgaatcccttactatgaccggaattgaattcccagtagatcgggcgcttactgtactttttatcatgatctttgaaaaagtcattgataaagtagttacggataattgtttcactatcggtccctttagcatatttattagcgtcaagtgactcagcgatgaaattcaaattatcgttaaccgtatcggcgccgaaagtcttagttaaaaattcccgcaaacgaacgattacgtcacgttcatcatcgaagtattgcgtatccgttagcatcagtaaattattctcgtttggcttaaaactaacgtatttgtccgcatcccagttgccgccggcatatgctaagccgtcggtatctagagaatagcgaccaaagatacagccaatgaagtaggacaagaagtctttaatatcacgttcccgatcggccaagcgaatagaaacatctttgtcttcttctttaggggtaagttcgtcctgtaatccatagagattgataaagatacggttaagttcttcttcgttactcttgagctggttaaaacgatcttgtgtttcggtttgccaagtggtgaaagcttcggagagcagccagttgtggttatgttcagttacgtgagagagtaacggtgagcgctgaaagtcccaggaagtttcgaaggcgtcccagtcggatttggatagggagatattttgaaaaactaatttttcaacattgtcaatattttcaattcttaaaggcaaattaataatattatttatatttgtattaattgtgggattaagtatttttaatattgatcttgcaacgactgaatttaagaagcctaaaatatagattaaatatttttcatcgtggaaaagtattgatggagctgccagattaaaggtagtcatatcactcaaatatctcattgcaaatccagaccctgatgatattaatgaccacgttattccctttctaaataaaacattatctttagggaatcttgcaacatgatcacttttatagtgattaatagctttcggtgaaatgttaattactgtatctacatttccataccatcttctatattctcctcccttagcatgtaaagcccattttttatgctttccaatatattttggatttacttcccaaatttttctcaaatagagatcattattgcccgttttaatctgaccatccgaaaaagtatagtctttaacttttttattttcaaaaaaatcttttataagttgctcacttgcccaataagcaatcggactgccagggattttgctgaagttactttggttagcatggtagagatctttcgtatcttcaccattaacaatgcttaaataagcttcttctttagtatcctgtgaattgtaatcaactagccgttcataggtgccttgatagccattggttttacccttttgcaaaataaagcttacggtctgaacaacttccccgccaatttcttcaaaagcacgtgttccaagatgggctaaattaacgatagttacgtcttgcagctttttacgcaatttttcaaaattagataagaacatccatgaatgttgcgtaatcatccccacgtagcccgttttttttgttaaattaagcattacttcgataaagacaccaaacatatctgctttgctatcaggatagtgcttttgtacatatttcttcaaagcaggatccatcttgccaccgcccatataaggcgggttggttactccaatatcgtaagttgagtttagtacttgagcaatttctaataaataggccaattcttgttgattatcacgctcatcatccataaacgataattgttcatattgtgattcattttctgatgagtcacggtcgggtttaatgagttctgatagggaggcaagatctagggcattagtttgaacgattgaacctaaatcattaccatttttaaacaacgctaacaaactagctaggtcttgcttaacctttttttgatcaagttgaccttgctcaatagcaatatcgaaatcagcagcttttaggtccgttacaggaatgtcgtaaatatgcggctttaaatctcttctgaacagtcgccgatcatattccctggctttcattagtagggcaaaataagacaattgataagcacgagtatcgatatctaggccaaacaaattgttgtttaggatggaaacggcggcttgtcgtttagaatacccttctgattcatagatttggcctaaaatatcgaaagcgtagaccaaaatgtgcccggaacccatggctggatcgataaaagtaatatcatggacatctttgttagctagctcttttttagaaattttgggatttttttcgtagtcgggcatgtaatattgccaattgaagtcttgagcgatctccttttcagttcgctgatcaccgcgggcttttaagatgtcaatccagtaccgtcccaaagaattttccaccatgtacttaacgatccagtccggagtgaataattgtgtaacggctggaatatcactagtagaatagttgcgtttcttaaatgctgcatttttaggttcggtgttgtagtactggtatagccacccaatgatctgcacttgcccttcatcttgcacgtcgaagtaactttcaggaatctccgttaccagttcttgaattacgccatgattgtaattaggtgtaaaaagtagttttaagtaatccttggttttctcgaagagtcccggtaagatttccgctagagcatcacattgcttaataaaaagtatttcgtaggcctggtcaagcttacgcgggtcaagagatagctgtgcatcttcaattaattgctcttcctcgggagtaaagccattgaagtcatcgcgtaagttcaaggcctcgtcaataatatctggctcactattgccactttcactggacaatactcgtactcgagtaggcagatagttgtttacttccatgaagcgaattgcaataattcggttgaaccaagtgtaggcaacttcttcgataaaatcttcgaggacagtttgttggttctcatcatagcctcgagttcttaattcattaacaatactagaacgccaagcaatttgttgaccagttaatccattattactagcaacttgttcttttgtatagtatttcagctctggtgtagaagcgggcagttcttgactaatcccgtcagttgtaattcctaattgtgctaagcgttggctaaccgaaccgattagttcccgccgtgcattgatggcgaagtttttaattttacttttatccataatgttcctttactagaagttgatgtttaaatcgtcgtaattcttcatttcgtgttcaattgaacgtcgtaattgtgcaagatatttatcaagatcggcttcactagaaatgttccaggtcttatcttgtaacagctgcgttacttgataagtgtggctaatccgggctttaacatgagctggttcattagtttttggttttgcgtccgtttttgaagcgttattgcttgagtttgtatcagaactagcatctgctgatgcagtgtcactatttgaatttgctaaacgaattcgtaattgttcgttagcgtcgttgaaggcatttcgaaattcttgatcagtttctttaatgtccttttgtaagccatacatttgagcataggcattagtgtcctggctgctgcttaacgctttggttttttgatcgatttcgtcaaaacgttgcataatactcttctgaaggtgattaatttcagaagtactaagggcggaattagttattaagtttaataaatcagttcgtttttgttgacttatggcagtaactgaagcttgtagtttatcaattatcttgatatattcatcagcgaattgagtattgagtgttttcaaattaccaatactataactggcattatcattcctcaaatttttaataagtttatcagtagtttcttttagcgtatcatcactaagaaacgcttcagcagctttataacgttgatagtaatcatagctccggttccaggttttttgttgtggactaaaggaagtactgttatcaccgtagaaatcagctaaacccttatcttcaaactcgtcagtccaatcttcaaatttatctagattcttggagatggtttcaaacagagtatcgctgtcttgatttaagattggcgttaagagtctaatgccatcgctcaataattcatggccagggtaagctaattcattagcatagctttgttgcttcatgtattgcaatttattaatgaatttttgagttttacttttaacttcattggcaattttttctgacggatcgtcaaagttagacagcatgcgttgttgcagcacttcatctaagtactctttaacatcttctttttgccgcttagacaattcttttacaggcttcaatttgatctttgaagtataggtgctttgcacgaagtacttagaaaagtttttcggatctttgcgagcttcttctaaggttaattgttcgttattatagaatagacgcaatttaccgtcagtaaaagctttggctgccagccaagcaatatcagcatcagcgtaaccaaaaggactgtccttaaaatgtttattaacattagctagtgatatatccttaatctggttattctgtagatcgacatatttaagcagagcattaatggcttgaatgttctcttcgttgtccaaaataccagcctgatttttacctgctaaaagatcaaaaagatcatcattgctcttgaaagtatcaatataatttaagtttcgatagagatcgtcaattaattgtttcttcgcatcagctaaacgagtcttaaagttactacccccactaaggacattgtctaagacgtaaatgtcagcatcttgaagatctttttcaattcgagtgttagtagattcgctaatttcttgatattcagcacttttgaccataatgacagcttgcttggctgggtcgctttgagtgctacccttgctaaggtattctttcaatcgtaggcgacggcgcatactttcaatatactgttcatcatttttaagggtgacgacaattgtattatttccagcggccgttaagctaaattgtgctggatcgtaggcatcaattactaatggcgaaatgatttgaatatttaatggtcttcctgtttggttaagagcacttccatcaatcgtttcactaaactcaaaaatatattgtttaggcttcttgggatattgatattttgcatcgattaaattgctattaagtaaatagttacctatttcttgaacaatactacgatcatcaatatcaatagagttgatctcttcgttaatttcttgttcagaatcagtcaagaattcataagtatcaacatgctgttgaacatagtttttacgtactaatagtttaagtgatgccgccactttattcttaagagcatttagatcaacgttgatgttatccaacattaacgtggtgatattttctagcgtagccttaaaggtttcgacatacttaaccatgaagagaactgctaagacttgttcgttaaaaccgaaatcttcattgttaggattaacttcattgtcattttcagctttagtgaagacaacttgatgatcatgacttaagaattgacgcattccggggaaaaaggcagcaaaaggtattaacacgtttatatttgattctttgtagcgaatagcagcttcctggaatgtagctaacattgagcgctctccatcagacatgtttttaccgttagcacctttacttcggatcatatttagagagtctttaagcaactcaaattgataaggaataaaaggatagttatttgcaaaacgttcaggtgtatcgaatttttctcgattcatgctatctgtaaagttgattttattatcaatggtaaaaccttgctcttgataaaggttttccaataattcttgataattaggctttttagaaagtaaacgtttttgaataacttcaccagcattagcactggtcatagtaatcattgttttaaaacgaccttggattttagaaaagtcgtcacgtgttttattgaaagtgctaaccaccgtgttcatttgttgttgagaagttacgacaacccatgcacggccctgacattgaatgcctagttgttcgacaatggtttgtaaattaagcatcttattgccatcatcaccaatgaattgtccaacttcatcggctaaaaatataaggtgatgatctttaccagcctgatcaagataatccttaatcaatttagcaaattgttcagcattaattgagaagggagcaggactagttacattgtctacataacgtttggccgcctctttattgttaataaatccgcatttttccagtgcttcctggatgcgactactcagcaaaatataagcacgacgagaatctttccaactagtattttcattaagctctttaaagacattttgaaattctttaaacttaccagcttggtctagttcacgctccatattggcaactctagctactggtgaatagcctaacttttcgttaaaaacacgcaagaatacgtctagaatggtattgccatcttggatactactatcagcctttgaatcaatattaaaaagaatgacgtcgtttggaatactagtagcctttaaaatgctattttttaaagaatcatcgtcaaacttgccatcttctaaaaagtaatcgatggcatttttaccagcaacaacatcgttttcaagcaagtaagagagaatctttaagaagtgggatttaccagaaccgaagaacccactgatccaaacacccatttcttcagtaggatgcccaatacttttatcgtattcgtcgaaaaatttcttaaagtcgttttgcagctcacgagttacaacatactctgaaagttcagtttgtttaacttgttcatcttctgagccaactttaataacaccgttaattggtcgatcgatttgtttagcaaaaatttcttttagttgtgtcatagtttttctttcctagtcaattctaaatgcgcgatagtaattttgatctttaacttcaccaaatgcctgtaagctaaaactgtcgtattttcccggataaaagaagattaccggataattatcgattacttgcgtcattgcgtttaaaattttatgagtacgcaacaggggataaacttctcccaaaccggtgataaagataatgctttcattcttaggtaggcggttttgaatgtattttacaattgcattatcttccttggtgatttccataatatttccgacttgttcgatcaggtagtccataccattcctttcctcgaccttttctagttcgtttacagcagctccatcagtttcgttagtttcagcaactaggtaatcaaagcttttgatttctttgatcataatatcgaaaacattaaaacagcggatgttaagctgagcagccataggtgaatctaggaatcgttttagtaatgtccgcatttttaaagtctcagtgactggatagtcaaagatgtaatagcccacctcatttgagagaccttgattatgctgaaaactaggtgattgaatcttatctttaagatgttgaaatcgttcttccaagctataagttacttgtgccattatctacctcctaaagcagctaattcataatctagttgtgtagccttcatggtagctactaaacggggatctagtaatggaaaacgagtaacaaggttcttaccatcttgttcaaagagccccgcacttttggtgagatatttgagagcacccttaaccctttgaatagtattaactgaccattcgcccacttctggattattaatacgttctacatttaagaaagattcaacttcgtaatcatgaaagctagtatcacgaacgattattttaggtcgataaacctcataaacaaattcatccaaaatacgactgattagcatgattgaaagtagtgccactaatttttgattacttgtgtcgagacttggaaataattcaataattggttgtggtaaagctttgacacgggcagcaagatttcccgaacatcttttggcttgtaaagtagttgattgtctaaataggttttcttcgcgtccttgttgtttaatgtctgagatactcatgccatttaaataaagattaataaattggctaagttctgtagtccagagttggtaagaagaaatacctccattatactttcgcttcatgatacactccttaattggattatcttaactattgaattatagcaaaataaaacttataaagctaaaacccgaacattgcctatcttattcacaaaataaaaggtaattaaggattaattatgagcatatatctccttaagctttttatcgatttctagcggagttggcagattgttctctctcagtgcctgtaagaagcgatataagtcaggctgagtcttttcataggtaagaattgcatttgtgtaggggcgcgtccaataattagtggttgtttcggcttcttgggcgatttcgatcaggtcgcttttcattttattgacgatcttttcaactttcacatagttttcaaaagaaagaatgccatgtgtactaagatgctcaatgtttacgtgctttcgcattttatccttagcaaggataattccccaagtataattagtgttgcataaacaataatgcttagaagaatcgacaccagcatgaccaacatcaaagcttatgaaccgataatttgattgcttaaaaatctttgttacagcaaaaccgtttagggagcaaaggagaggaatgactgtatcaatggcatcttttttaggttttgtaaacgatcgtgcaaagcgagaatattttgaatctaacttatctctttccttttttaaagtatttttttcgctgcttattgggcgctttaatttttgagtttgttttattgctgtattggatggggtttgatcagatttggtaactgatcgggctttgtttgatttagaagacttaatatcagcttgattggcttttatttgtgtagcgccataaattaaatcatgcagttggtggtaaatttctaaatcgatcatgtaaatattttgtttggcagcatcttttattaaagaaatcggccatgaatatagtttgaataactcttgctctcgattgggaagatgggcgggaagctcaaaaatcatcattttctcataaaaaatcttgcctatattattatgattgaataccttttgcctaagctcatacctttttaagttcaaggcagagtatagagcccagcaagcatagtcaagattattgctgatgattgggttggaaccgtcttgtggatagacatgcaagagcccatctttattttcaacgataatatcgatttgctttgactgttgattatttatgattggcaaagcagcatcaaattgtgaagtagctttaatccatttatcgttttttcgattaactaatggtaaaaagtcacgtaccgtatagcttggtaaaccaaagagcgttctgacattgtcaacattatcaagtttttgaattcggtaaaaaccagttcccgacattgacggatgtgaattggataagaaagaggtacgaataaaaagtcgcttattaaataccgcttctttagggggtgctggtaaatataaggttttatgatctcttttagtgcttaaaaagaaacctgtattgaggtatctttcaaagatataatcagcaacctctgatggagtagcgtcaaagatcttattgttggtatctttattaatgcctttatcctcattgattctttcaaaaagattgatgaattcaacggttgcattgatcagatcatgtttgttgattccttgctggttttcagataagacaaaaagcatctggcgagcggcagcactgtaaacaatgattgattggtataaactagatcgcttaacttgttgagtagcattatcaagtgctttaatgtccaggtcatttttgatttgctgtaggagggttattttatccatcagtcaagctcctggaatttcattaaataatgggcagttggtgtatcatctttggtcagcagctcattaagcaaatgctttttgttacttgcatagacatatccaaatagtggcaagtaggcatcgcgtttgtctagagctttggttatccaggtagtctcttcttcgatatgctttcgcattggttgattgatacctttgagattgtcaagatgaggatagtcaaatatatcaaaacgagtactcttatcaattgctggggtggctataatccccttaagggtgacacttgaaataataaaagtgttatttccttaagggggtttttgcatttcaagttattcgacaatgaatagactggagttgctttatggctatcaaaagacagaatccggcctcaaagtatatgccgatatgcatcatgtcaatcagaatacgatgacaagatggattcgacagtttctcttgcatggcttggcgggagttcgccatcgttcattcaatcatcgctattcactaaataccaagattgaagccgtcaaagagtatcaagccggtttcccaggtgaaaaaatcattgaaaagtatgatattcgtagcctctctcaactaaaacagtggtcgatccagtacaataatgatgagctaaagactaagtcaagaaagcgagtcagaaaaatgggtcgaaaagttagttttgaagagaaatgtaaaatcgtacagtgggtcttggaccatgacaatgactaccaaggagcaacaattcagtttaatgtaagctatcggcgtgtctactcatgggttcgcaaataccatgaggcagctgacagttgggaagccttgaaagataatcgcgggcatcgcaagccacaaaaagctttagaagagatgaccgaaaaagagcgacttgaagctgaaattaaaagactaaagaaaatcaatcgagaaatggagcttgagatcgcatttgcaaaaaaattagtcgaaatacgcaatcggggggtgaagcgaccggacgatatcaagcggttcaagaattaatcaacgaaaccgcaggttccgttagcgaactgactaaaattgccaaggtttcacgcaaatcatactatcagtggctcaaaagacagccaacacaaagagaaattgagaaccaagcaattttggaagcaatctatcagattgaaaaacgccatcagaactgtgctggttataaaaaagtaaccgcgattttgaacaatgagaacgggaaaaatcaagaaattccagaatacaccttttcgtttgcttttcgtatcaatattaagcgtgtgcgtcgaatcatgcggaagcacggcattaaagctgatgtccgtcagaaaaaacgcaaccgtaagcaggaacaataacagtatcaagaggataacttattggaacggaaatttattcaggtagcgccgaatctggtttgggtgtccgatacgacagaactaacctacggtcgcaataacaaggttcgtttacacgtagttttggacttatacggtcgttatgtgctcagttatcatatttcgccaactgagacagcagaagccgcaattgaagtctttaaacgcgctactaagcaggctggaaccttcgcaccaatgattcatacggatcgtggtgctgcctatacttcaaaagactttaacaactacttaaccagccataatagtaggcacagtctctctgcgcccggcactcccgcagataacgcagtgattgagcactattggggcgattttaagtacatctggatggcacatcatccacatccgcaaaccttgacagaactggaagctttggttaagcagggtgttgaatacttcaacaaagtcgaaatttccagcaagcgaaataatctcaccgcggaggacttccgcaatgaggccgtatagactagttttttattttttaagtgttaccttgacagggtacagtaccggttatagctactcgggatgactgcaatccaaaaatatcagtaaaaattggtgttgcaaaattatataaacctcgaggcgccaagttcaaatcatccataaagctttcggtcaagatgacccacttattaggtaagtgtactaacgaattaatatgtgacagccaagagctgcctacaagattgtttaaaacaataattggcgattctatcttttgcagttgttgatagatatctactgaaaaattaccggtacattcaacttgagtagcatactgaccagttaaacgcaatgcggtcaattgagcaatgtcaagtgcatcctcaccaattaataagaggggacgttgctgtctatataaaacgtaaagatatgctgccaattcattgcgaagatcttgattagtaattagtggcaaaaatgcattttggagtgatttaactgcacgctgttcattagtagtctcaagagtttctgtttgttggtccgccttaaatttagttgggttaactgatgagattgtcagtagctgcgagtggttttcagaagtagttttgggcatcatagcttgattaaaggccatttctgcaataaagtcagcagcatttttacgagctttttcgattcgttctttgaccttagtttcaacagcttcagccaattgttgttgtgactcgagcttttctttttcagctgtcagtttctcaatttgtttggtaagctcagttttcttggtactgagtgaactaatatcttttgttagtttttccagttggttagccttagagtcattttgttttttccagtcgtcttcaatttcgttgatggctacttgacgaattgactcattgtttttaattgtgtatttgaggttagccatatcctcatcattgccagctatcagattttgtgcgttttcaaagatgtcttcataggcgtcattgaccttttgaacgtcatagtgatactgttcggcaagctgagtagtccagtcatcctcattaagatcatttagaaacgacttgaacaactttaaattttgggaatatttactggcttttgcggtatgatctttaagccgttctaaaatttcggaacgaacgatgccataaacatctttggttggaacgtttgagatgtctggtgaatatatctcaagatcctcttcactggtcaaaaagaatcgatcacttgcattctttggagcagcaacttcatagcagtatttatgaagctgttttttggaatcaaagctgtattttctaagaaatgtattgctggatttatgaccactatcttttaagtagagatcatctttgatgttaaaatacagcccttgtacttgaccattggctgacggagctgttattaccaaggtattgtaatggggatggtcgatattgaatccagctgttctaaatgcttcaataatctctttaggtttactgaaactactttgttgaatgacaaccggtagtttttctgtacctttttttagttcgcgctgttgtttgaacaatataaggtcgcaaaaaatgtaagacttactgtagttcttaaaatgattttgaatatgttgattgatgcttagatcaatctctgaataataggaatttttgaccgattccaagaggccggaagctctgttaagattagccttgcgataggcagttaatttgttgttgtctgaatagtcgattaaaaatagcgatgttccgatagtttcattttccattagtaatcttctccgttgacgattttgctcaaaatgtttttggctttaattgtgatactcttctgacgggcttgactgcatacccactgataagtagttggacaatctgccagtaattttttaagatggttggaaacaatagtaaaagttgttgcctcaccgatttgtctttttagcaggttgagcagttctggatcattaagcctgctttgatcattgttagtcgatgacttatcgatagttgatggctgaggttgagacggtttagcttgagcattgctaatttttgccgtttgtgagaatacacagtcagcgccatagaaaacttttagactggaaccggctgccaggttaggtaggcgaaatggtttgttagcctcaagtgattgactgctaacttcaaatttacccatatattgttttaaggtggcattatataaaggctttatgtaatggttatgttcctttaaatatggctgaagtgccaggttgttgccaggctgttttgctgattgagagcaagggatgaattgcttatagttagtgatatcattaacgtttcgaccatatgcaacaattatcccgttattatcgttagagtttaaagtgaacagttgtgaatcttcaaatagttgtaaacggtcttgactaagatttgggcgtttattgcttcttggagcatagtcaagccacgcctggccatgtttataaaggtaaagcgtatcgcccaaatagctgatgccatcttcatttttgaaatgctcgggccagattaaatcaacatcagcaacgtttttggtgattcgataatcaattcccgcatcattaccgagatcgtttatttgcaaaaagggcctaagtttattgggaccaaaatgtgtatcaaagctaatttgaaaaacgttccaaccgtttgaatgtaccagcagtttttcattgattccggggtaggtaaagctatttttcgtcgtcaaaacaatatattcattattgggatttaactccccacccagattgactcgcatgccatcactacttctaaaaattagatactttgattgaagagtttcaaaatcggcaattttatcagagtgatccggcaaatcattataaagagtatatttattggcaacagtgcttcccagattaaccttggttgaaaaattattcgggtcaattttgactggtgcaattttctgaatttttttgtgatgtttatgataaatacccaaatttttgtacttagatagtccaggattggctgcatgtagaagtaccaactctaaatggaatttttgttctttatcaatgactatcttaagtccagcaaaatgagtcggaagtgtaaataaggcctgcttagaacgttcaggacagtttttatcgatgtctcctttgctgtgtttgaaataaggatctcttactttgccaacactgagggtaacaaagtgattgcaaagatcgcacagtaaccgcttttcattagctctgatggtatggcaatgtgatttttcagatgcctctttgacagtaacatgatgccagtccccgttttcccaataactgacatgatttaaactcataatatccccaacttttcattattaagtaaataacatgtttaattttaacacatgaaagcgattgagattaattgttaactgaaaaccctgtcacttcaccaagttagtttataaccatatcaactccaaaagtcatgcacacagtcaattgacagtctcattccaaactcgctagaataaattaactagcgaaaggaagcgatttcaatgacaaaagttttactgactggtgttgggggcaatctgggaacgcaggcagctgaagatctcatacgcttgactgatccgaagaacctgatctttgttggttatgatgaagcggcattggcaaagtatgctgaaaaaggagtcgacacgcgccaggctgatttcaaccatttggatggtttggctgacaaattcaagggtgccgatgtcttggggttgatctcaatgccatttgttgggcaaaaacgtcagcaggctcagcaaaacgtggtagatgcggccaaagcagctggagtcaaaaagattgtctacacttctttggttaatgctcaggatccaaccaatccaagcaaggaaaagatcgaccatgcctttactgaaaaatacattgaagatagtggcttggactacattttcctgcgtaactcacaatacgctgaggccatgatcaccaactatttcacgttcgtcaaaaacggcggggtgctgatgaacaaccagggcgatggcaagatggcctacatttcgcgtaaagactgtgccaaggcgatggcttatgcgctgctggctgacgatcggcaccaccagattctcaacatcaatggtgccgaattgatgacgatcagcgactttatcaaaatcggtaatgaacagactggcaatcacgttacctataaagaagtcactgacgaagaagactaccagatctttgatgcgatgggtgtgccgcggaccacggatggccagttcaagaagggatccgaagcgccattttcttcggaggggatggttacgtttggtcaggccattcgcgaaggtaaaatggacactttcaccgatgactttaagaagctgacaggcgatgatccaatcacggttgccgaaatgtttgcccacagtgatgactaccagattggtgagcgccactccaaagacgactaggcagatccttagttaacgcaaaaacgacctcacagcactatgccgtggggtcgtttgctttttggaattaaaatgttcagcttgtccgatattcattattgattgcataaaatatctgagcgaaaattcataacacacttttgaagcaaaaatacgattttgtgtgtaaaaacttcgtgccgatttcattttctgcgatttgattacacacaaatcactaaaaaatcccaaaaagtgtgtaatcgggctctgatttcgtttcgtcattacacacaaatcagccaaaaatattgaaaagtgtgtaatagtcaattcgacaggccgtcaatgatgtacagattaggttggtagctgttgaaaattcgaaaccgtcgttaggacttgtgcgaactggcagtccttgaaatgtcaaaccgcgttgataaattatttaattgtaccgtctagattaaacaatggcaacttgcccaagaataccacatcatcgcgtttagcagcatcaccctcagccaggatcgtcgccttggcaataatttgacagcccgccagtttcagcagtttttcagccgactgcaatgagcccccggtactgaccacgtcatcgactaagacgaccgactttcccttaagctcggcagcatcggccccatcaagcacgagcagctgttgtcccttggtcgtaatggagtcaactgcagtcgtcaatggattttccatatatcccttgactgacttacggatcacgaatgagcggggatgcccggacaacagactgatatcatgtgccaaggtaattcccttgctttcaacggttacgacataatcaaactttttaggcagcttgggcaaaagcagttcagctgccgttttggacatggcgtcgtcgcccagcagcacgaatgaagcaatggcaatgtcgtcactgatcggaatcagtggcaggtcacgagtttggtcgccaacggtaatacgatattttttcataatagcttccccctaaagtgcggctaacagcggcaaaacgactttcagcaagccaccagacaacaggcctacgaatggatcaaccagggcagtaatgatcatggtggcagcggcgatcagctgttctttgccagccagtgcggttgcggcattttcggggaaggtgacaaacatccccaaaaccagcaggaacccggcgattgaagcgcttgggacgtacttgccgatcttaggcagccaaccggcaaacagaatcacggccatgatcagcatcatcagacacccagcgatgactggctccggcgcgctggcagttgcggagataatggtttccaccggtgccccgcctaaaagactggttcccatgtcggccagtgcctgtgaggtcgtcagcaggtttaagttgacgggattgggcttgataccggtcatttgtcctgtgatcagtccgtatgacaggttggcgccgatgtttaggcaggccagactgagcgcaccccgcacgattcgtggattaaacgtcggcttggtgaaaataaagcggcgcatcgtcacgttggcgggcagctcgttgcggtagtgctcgccaaagacggcatacaggctggagccaatgactgaaagacagatcgtccagaccaggtcgtttgagatcaaataagtgactaccgcgatggcaattgaaacccagccagtgaagcttttctgattgttttgggccatttcgagcgcgattttggccagcatgataccaacgccggccatcattccggtaatgatatggttgcccagaatgccgacgatcttggtcaaggtaccggtcagaccgataatggccatgatgatcgagccgccaaagatgattgacgtgtattctttggtattgcggcctagattgccggtcagggccagcgactcagcctgaaaagaaaccggggcgaccgaattaaagataaagttgatcgcgcaaactaacagaaatgaaaacgtggttgggaataccgcaaatccaaggctcagtgccatgataccttggggaattccgtttaagaccacgccgattgcagcgatcaagtcagcgaaccagtgcataatctcctcctaaaacacgaacattaaataatagaactaactaaataaatgcaatttactagaatattattaaactgattatcgacaaatgtcaagataatcttaaaaaccgtctttcattcaagtgaaagacggtatcagccaaaagattcaattaggaccgcaatagcgaatcaactataatataattgaagaaacggcacgatgaaatatcagccaatcatgattaagcggggatgattatgagcgaacaagtcaaggatccattaatatttgaaacgtcctatcgtaaagacacggcggcgcatttggatgaagagatcgaaaaacgctatccgggtaaataccatgagcaggaactgttaacggattatccaacggtctacattatcgacaatcagggcaggcaaagcgactacaaagaagactacacggtttatgtcggcgaaaccatcgatattcagcgccggacgctagagcacttggatgccgatccggaaacgcgtgcggactgggaggagctgcgcaatgccaaaaacgcgcacatgtttgtgatcggtcatgagcattttaataaatcgttggcattagacatcgaaaaccgcatgatgcagtacctgagcagcgtggacgtgatctctaagttgaacaatcgccgcgagaacgcccagcgcaagtactacacgagcgaggagttcattccgatcttcaaccgtatctgggacaagctgggcgaaaataagcagtaccgcaacctgtttccgccgcgtcagcttctggaaaagtcggcaatctttaaggcctcgccgttcaataagctgactgacgagcagaatcaggccaagaaaaagattctcaaaaccgttgagcaggcgctggctaaaaatcagaccggtcagctggttttggtgactggcgaggcaggggccggcaaaacggtgctgatgagcaacattttttacgagctggccaaacaagatcagcttaacgccgtgatgatggtcaatcatccccagcaggtcaaggtttaccagcagatcgtcaaaaagctggggataggtgatgatgaaacggtcatcaagccatctcgcttcatcaatcgctatgatgaaaatcatcaagcagacgtggcctttatcgatgaggcacatttgttgtggacccagcagaatcaaggctatcacggccatgcaacaatcagctgctcgatattctcaaacgggccaaagtcgtcttggcggtttatgatcacaagcaggtactgacggccgatgagatcatggaaaatgaagattggcagcatctcaagcgactggctggtgacaaagtaattcgactgaaaaatcaaatgcggattgcggcctcggatgaaacgattcgctggattcgcgacttcgtggatcagcgccgcatctatccgattccagtcgacgacagctatgatctgcagatttttgatgatccacgcgcaatggaacaggcaattgccaggtttaacgctgaggatcatggccatggcatcagtcggatggtggcaacgtttgactggaaatattctagcagcaagcccaaagatggcagctactggtgcgtcagtgaagggaattggtcgatgccttggaatctgcagctgaaaagcaacgtcaaaaaaatcaatggtgtcaaatacagcgacctttcctgggccgaacagccgcatacgattcacgagatcggctcaacttataccgtccagggctttgatttaaatcatgttggcgtggttatcggtccatcggtgaagtatcgcgatggcaaggtcatctttgatccgagcgccagtgccaataaaaaagccgtttagcgtcggacgatgaaagatcactctaagcaaagatttggtgagcagttgctgcacaatgaattgaacgttttgctgacgcggggcgtgcatggcctatatctgcacgccgtcgatccgcagctgcaggcggccttaaaacgggcagccatgggcaagagataaaaataatctggcttatgcaattggcaaagaacagtcgggttatgagacgagacgcaatcattaatttttgagaggaatttttacttcgatggatgaatttgaaaaaatggctagcgggcggctgtacaatccagctgcccccaagctggatgcctatcatctgcaacgcatggctttgtgccaacagctgaatcagacttcgattttggatcagcaaacggttgagcggttaaaaacagagctgattccttcatccaaagggaaatcgctgggactgtttttgccgttttattgcgaatacggcaccaatatccacgttggcaaagaatgctttattaactatcactgtacttttttagacgttgcgccagttacgcttggtgacaatgtttggctgggcagtggggtaacgattgccacgccatgtcatccatttttgcctaaggagcgtttggtggctcaatatcccgatggctatcataatctggaatatgccaagccggtcacgattgaaaagaactgctggatctgtgccaacgccacgattacgggcggtgttacgatcggcgagggcagcattgtggcagccggtgccgtggtaaccaaagatgtaccagccaattctttggtagccggcgtgcccgcgcgcgtgcttcgccagctggacgaaaaagaccgcctcgatgtctggcagacttatcagcaaggtgaaataccgcgttcgctacgagaaaaggaacgcggctgataagtttattggctgtgctttggcttgctaaaaagcgtttgctctgccgtataaataaggcttattggcagctgatcttgattcatacttaaaataaaagcagcggccgattaggaaagcgaccgctgcttttgcgactatttttaatgacggctggcacggtgcgcactgctaccgcccattttgtggacctgacgcttgaatttttgaccattattggcaacaaaatgaaaatgccgcatcttgccggtaaatggtcggccactgagtcgaatcgtggtccagcgccgcatcaattcggtcatgtcatgcagatcagccaaaagcgcttcgttatgttcttcttcggcagcctgcttgatatctgtctgcaggcgcatgatcagattattgtgatattgaagcagttcggcggtcaatggggcattgcggtactggttgaacagtttttgaatcagttccatggcttctttggcgttttggggctgaacatagcggttttcttcgttcataagtaactcctttgcttggggacgctgccttgataatcaagaggcagcagcttttgactaatcttgacatttttatcgaaaaaaagtttgactattgttgacttttatcggtggggttggtatattataaattgtgtttagcacttaggcagttagagtgctaaaaggaagtgatgccaatgctaacacagcgtcaaaagcaaatcctgcaagcgattgtacgtcaatatacggcgactggtcaaccggtcggcagcaagctcttggctgacaagctcccaattaaggtcagctcggctacgatccgcaacgaaatggcggtgttggagcgagaaggtttcgtgaaaaaagagcattccagttctggtcgcgttccttccaagcaaggctatcgctattacgttgaccatctgcttgatccggcagccgttaccgatagtgatctgatggtaatccaaaattcattgggcgccgattttcacaagattgatgagatcgtttcgcattcagctgatattctgtcagcgttgacgtcttacacggcgtttacgttgaagccagaacaaaaagacgtgcacttgagcggttttcgtttggtgccgttgggtaatcaaaaagttattgccattctggttacggacagcggtgaggtggaaagtcaatcattcaccttgcctaagaatctggatacgcaggctttggaggccgtggtgcgtttgatcaatgaccagttggtaggcttgccgctggtcacggttgtcaagcatctgcagactgacattccgctaaaggttagtcagtatctgcacagtcccgacggctttctgcagatctttgacagtgtattggggcaggcagctcgcgaaaaatacttcgttggcggtcggctcaacattctcggctattctgatcggcagaatccacaggcgctgcgggcattgtatggactgctcgatcaaagcgataatctgtcaagcatcattgattccgattcaccaaatgatggggtcaacgtcaagattggcagtgagattgccgacaaccaggtgctcaacgattacagtctgatcaccgctacctacgacgtcaaccaatacggcaaaggcattatcgccgtgctggggccaacacgaatgccttattcgcgtacgattggcctggttgacgcgttcagacgcgagctggctaaacgactgctcgactactatcacaattattacgatttataggaggggttcgatggctgaaaagaaatcagcagctgccaaggaagaaaaggcggttcaagcagctgaacagactgcggctgaccaagcggctgagaatgccgaagaagccaaggatgccaagtcaactgccaaggaagatccaactgccgcgctcaagcagcagattgctgatctgaaaaagcagctcgatgaaaaagacgaccagtatctgcgcgcgcaagcggaaattcaaaacatgaacaaccactttaaaaaagaacgcgcgcaattgatcaaatacgatggtcaagggctggctaaagacatcctgcctgttttggacaacttgaagcgggccttggcaactcaactggatgacaagcaggctcaagagttcaagaagggcattcaaatggtgcacgaccatttggaaaaggcgcttaaggaccatgggattgttgagattccagctgagccaggcacgccttttgatccgaccaagcatcaggcggttcaaaccgcgccggcttcggatgatcaaaaagccgacaccattgttcaggttctgcaggctggctatgaaatgaaggatcgggtgctgcgtccttcaatggtcgttgttgcacaataacttagataaaccaatataaaaagagggaaaacatttatggcaagcaataagattatcggtatcgaccttggtaccactaattccgccgttgctgttatggaaggtaacgaacctaagattattaccaacccagaaggtggccggacgactccttctgtcgtatctttcaagaatggtgaggttcaagtcggtgaaacggctaagcgccaagcaatcaccaacccaaacaccattacttcaatcaagagtcacatgggcgaaccaggctacacggttgacgttgatggcaagaagtacacgccgcaagaaatctcagcaatgattctgcaatacatcaagaagtatgctgaagactacattggcgacacggtaactcaagccgttatcacggtgcctgcctacttcaacgatgctcagcgtcaagctaccaaggatgctggtaagattgccggtctggaagttaagcggatcattaacgaaccaactgcttcttcactggcatatggcctggacaagaaggacaaagacgaaaagatcctggtttatgaccttggtggtggtacgttcgacgtttccatccttgaactgggcgatggcgtcttccaagttctttccacttctggtgacactcatctgggtggtgacgactttgaccaaaagatcatggattggctgatcaatggcttcaaggctgaacaaggcattgacctgtctcaagacaagatggctctgcaacggttgaaggatgctgctgaaaaggctaagaaggaactttccagctcacaatccgctgaaatcaacctgccatttatcgcgcaaaaagacggtcagccggtacacctggaccaaacgctgacgcgggctaagttcaaccagctgaccaacgacctggttgaaaagaccaagcagccagttatgaacgctctgcacgatgccggcctggacttcaacgacattgatgaagttatcctaaacggtggctcaacgcggattccagccgttcaagaactggttaaggacttgactggcaaggaaccaaaccactctatcaaccctgatgaagccgttgcgctgggggctgccattcaaggtgggattctgactggtgacgttaaggacgttgttttgcttgatgttacgccgctttcccttggtattgaaaccatgggtggggtaatgacgaaactgatcgaccgcaacacgacgatcccaacttccaagagccagatcttctcgacggccgctgacaaccaaccagccgttgatatccatgttctgcaaggtgaacgtccaatggcagctgacaacaagacgcttggcaacttccaactgacggacattccacctgcaccacgtggcgttcctcaaatcaaggttaccttcgacatcgacaagaacgggatcgttaacgtttctgccgaagaccaaggtacgcacaagaagcaaaacattacgatcaagtccaactctggtctgtctgatgaagaaatcgaacggatgcgcaaggacgctgaagaacacgctgaagccgacaagaagaagaaagaagaagttgatctgatgaatgaatctgaccagctgatcttccaaaccgacaagaccattaaggaacttgacggcaaggtttctgaagatgagatcaagaaggccaaggacgctcgcgatgctctgcaaaaggctaaggatgccaaggacttcgatgcgatgaagaccaagaaggacgaattaaacaagatcgttcaagacttggcagtcaagctctaccaacaagctcaacaagaaaaccaacaaaatggtactgacggcaacaatggcggtgctgacaacaataacggcaagggcgacggcaagaccgttgatggcgactttactgaagtcaacgatgacgacaacaagtaggccagtcagccgaagccgatttagataagcaaaaagccaaagcccccctaacggactttggcttttgcttatttatcgtgactatgctataaagtaagagagaaaaattgcgttgcgagggatttaaatggcagagaaaaactattacgacattttaggcgtcaaaaaggatgcttcagacgctgaaatcaatcgggcctatcggaagctggcggctaagtatcatccagacgtcaaccatgagccgggagccgaagaaaaattcaaaaaaattaatgaagcctatgaagtactgcatgatcagcagaaacgggctcaatatgatcagtttggctccgctggccctcaaggcggctttggtggcggtcaaggcttcggcggcttcggtcagggcggtttcagtcaaggcggctttggcgattttggcgatatcttcagcgatctgttcggtggcggccgtgctcgtcgcgaccccacggcacctcgtcagggacgcgatctgcagtacaacatgacgctggactttatggatgccatctttggtaaggaaaccacgattaaatatgatcgggaagctgaatgtaacgtctgccacggttcaggcgccaagccgggcaagtcgccttcgacctgtcatacctgtggcggttctggggttgtaatgcagcggcggcaaacgatgatggggatgatgcagtcacagaccgtctgcccaacctgtcatggtaccggtaaggaaatcaagccagaagatcaatgtgacaagtgccatggttcaggtcatattcaagaaaagcacaagctcaaggtcaaagtgccggccggaatcgatgatggccagcagatgcgcctgcagaaccagggtgaagcaggaaccaatggcggcccatacggcgatctgtacattgtctttacggtaacgccaagccgcgactttaagcgggatggttccacgatctatgttgatcaggatatctcatttgctcaagccgcattgggtgataaaatcaaggtcaagaccgtgcatggcgatgttgacttaaagattccggctggtacggaatcagaaacctcattccggttgcggggcaaaggggtaccgcacatcaatggcaatggcaacggtgatgagcatgtgacggtccatgttaagacgcctaagaatcttaacaaacggcaaaaagaagcgatgctagcctttgctgaagccagtggcgaacatgtcgccggctacaagggcggtttctttgataagctcaaggatcgctttgaagaaaaataagcctgaaattttaaagagcaagacgctgcagtgcgcggcgaattgctcttttttcgatatttgcaccgacccagtttgagttgccaacgggatttgatatactggtagatagacatttaacgcagaaagtgagcacaaaaaatcaatgaatcttgaagaaatgaaagaacgccaaaagcacattcggaacttttcgattgtcgcccatattgaccatgggaaatccacgctggcggatcggatcctggaaatgacggattcgatctctaagcgggaaatgaaggcccagatccttgatgacatgccattggaacgggagcgtggcattaccatcaaattaaatgccgtggcgctgacctaccatgccaaagacggagaagactatattttccatttgatcgatacgccagggcacgtcgacttttcctatgaggtttcacgctctttggcagcctgtgaaggagctattctggttgttgacgcgacgcagggggttgaagcgcagacgctggccaatgtttatctggcattggacaacgacttggagatcctgccagtcatcaataaaatcgatctgccttccgctgacgttgcgggaacgaaaaagcagatcgaagaagaaattggtctggactgcagtgatgcctgtgacgtcagtgctaaaaccggtctgggcgttgaaaaggtgctggaaaaaatcgttgccgaagtaccggcgccaactggtgatctgacggctccgctaaaggcactgatttttgattccaagtacgatgactatcgtggcgtggtcttgagtgtccgtgtctttgaagggaccgtcaagaagggtgaccgcatcaaactgatgaactctggtactgaatatgaagtcgctgaagtcgggatcaactcgcctaagccactggcccgcgactttctgatggctggtgacgttggctatattaccgcggccattaaagacattaaggatacgcgggttggtgatacggttactgatgccaagcacccaactgacaagccattagccggctatcgtcaaatgacgccaatggtttacgcggggctttatccaaccgacaacgccaagttcaacgatctgcgggatgccttggaaaaactgcagcttaatgacgcggccttgacgtttgagccagaatcctcacaagcgttgggctttgggttccgctgcggcttcttgggacttttgcatatggatgtcgttcaagagcgtctggaacgagaattcaatctggatctgattaccacggcgccttccgtaacctatcatgtcgatctgcatgacggcacgatgaaggaagtggaaaaccccgctgaaatgccagatacgtcttctatcaaggatattaaagagccttacgttaaagcgtcaatcatggtgccaaacgattatgtcggcccggttatggagctttgccaacgtaagcggggcgagtttgacacgatggaatatctgagcgagacgcgggtcaatgtgatctatcatattccgttgtccgaaatcatctttgacttctttgataagctgaagagttccacgcatggttatgcctcgctggattatgagattgatgactatcgcgtcagtgacctggttaagatcgacatcctgcttaacggtgacaaggtcgatgccttgagcttcattgcgcaccgcgactttgccgaagaacggggacgcgaaatcacgaccaagctcaaaaagattattccgcggcaaaactttgaaattccaattcaagccgccattggttccaagatcatcgcacggaccaatatcaaggcttaccgcaaggacgttacggcacggattcatactggggatcctgatcggcgggctaagcttttggacaagcagaagcgcggtaagaagcggatgaaggcagttgggcgcgttgaggttccacaagaagccttcatggcagttttgaagaccgatgaggaaatcgacgaaaagaagaagtagctatgacggcatttgtgttttagggatgccaaaaactagaccaatttttggggtttttgccaacgataaaattaaacgggaaacctagcttcgcatgaactcggtcagacatatatttgaccgatgtaggagtgatgggtttcccgttttttataataatttacaagcagatccaccgcctcttaataaacatatgttcggtttacgtgcagaaattaatccccatcttctatgtttataaaaggttggggattttttagttttttagttcagctaatgcagctttattttcccaggagataacgtcaatatcataggcctgggcaatttttgccgctttttcactaatatttttttgcttttcattaaatataacgacataacgactttgtgcatacatattaggtagattggcggattttttgatgtcattgtgtttaaatgcatcaagcattatttcgtttgcagaaatattattctgaatattaaaaaggattagcggtttatctttacgtttaggtaaagcgtacaaaaatttatactctacgccgctttgccctctaactgtggttggcaaaccgccgaaattattagtatcaaagtaatttaaaacgtcctcggcaaaaaagcttttaacattttctttttgtgtgaatgaaatatcgttaattcgtaagatggcagatgtcaattgatatttcataattggaaattctttgggagtgccgacaattgataaagtttcatcttcaattattttgatatggaattgttggcacactgaatctattagacgtcttctggttggggtgagcttaatgcccatgaattccagattggcgatagtatagccgtcatctgtcagcattattttcttgtcggatacttcctcgacataaatagtgatgttatcgtttatatcatcgacaaaaggggtaactatttcatcgcattttcctaaatgattaatcgtatatcctttttttaaccattcaaaataattatctaacaatttaacggtattcatttatttcaccttctttactaaatcaatggttgttcaatagtgatatcactgatttcaaagttattgtatttaagaaattccataagcgatgtaacaatctcatcagtacaattataattcaccaaattagttagtggaattgcatgctgcccattttgatgctggtcatcaaaaatatgtacatgtggtgtcgcaacgccttcatgtggttttccgtttaagtcgatacggatcattttttcgcttttgtgatgaaacaacatgtagctaaggcaattagttcgtcgatgaccttttctattttggataactttaaatgtattcgatggttccagcaatgcaaaaccatcataattagcctgttgaccattggctgcacaaagcaggtgagtagatttagtctttttgggtaaatcatgtagggctttatattcagagtttttcatagttttctttcctaattacatatttaatttctatagttagaaaggcaattaagcagattcagtggaaatgttaaaaagtttggttagtgaaaccaaagattaagtcaatgattttttcttctttgataaacagtttatcactaaaaagattatggaatagaaaaaagcttttaatagatcctggtcacaattccatgagatgacatggtgataggcattaatgtgaattatcatattaggcccttgatcagtgatgtgtttactaggaaaaaataattgtttcttaacaataaatttttagaactttagcgctgtcatttggctgatttcaaaaaaatcgaaaaaatttttgaaaaaagtgcttaatagccgggtaatggtggaaaatagaagatagcagttaagctgcctttaataaagagggcttatagctgattaaaatgttgtacaggaggagttaattacgatgagtagttcaaagcaaggattgcgtagatatcatcttggtttggatattggtacaaattcaatcggttggaccgcaattgatgatcatttttcattgctgcgcgttaaaggcaaaaatgcaatcggcgttcggacttttaaagagggggaaacggcagcagatcggcgtggttttcgaacggcccggcgccgcttaagccgacgtcgctggcgccttcagtttttggatgatttttttgcgccatatttagctgaagtagatcctaattttttggcaagacttaagcaatctgatatctcggcaaaagatcctgctaaaaatcaagaatttatggggaaattgctgtttccggatcaagaagccacagtgaatggaaatggatatcctacgctgattcaaatgcgcaaagaaatgtcggctgaaaaggcagcggattttccagtctttaacatttatcagctgcggtatgcactgatgaatgaaaagcgtaagtttgatttacgtgaaatatatctggctgttcaccatatcgttaagtaccgcggtaattttttaaataatacaagtgttgacaagtttaaagccaatcaaattgatttcaataaatcgtttgagacgctaaatgacttattccgtcaagtgcaaccaactacctcgtttcagattgacttgaccaaggtagacgaattgggaaagcttttattggataccaagcaaaagaaggctgatcgtcaaaaggctgctgccaaactattgccattgattgaagatggaactgataaggagatcgttaaagcgcatcagcaaacggctcgtgaaatcagtaaactaatcttgggatataaggcaaaggtcggtttgatcctgcaaaacaatcttgaccagacgctggatatgagtacggaaaacagtgatgatcagttgatgcaaattgccgaagagctggacgactaccagaaggagctgattaatcaactgtcattgctgtattctcagatcatgctcaacgaaatcgtacccaatggcgaaaccgtttcggcatcaatgctgaaccgttactacaagcatcgccgtcagttaaaagaattaaagacttatggtgctgcccaagataaaaaaactcgtgagcagctcgatcatctttatgctgaatacattggtcaggttcctaaagacagcaaatttgactttaccaaagatttgaaaaagttgatggacaaatctgacctggaacaaaagattaaaggcgagattgaggctggcgactacctgccgaaacaacggacatctgcaaatggtgtaattccgcaccaaatgcatcaacaagagcttgatcaaataattgaaaatcaaaaagaatattatccttggctggcagaaccaaatccagttgaaaagaacatcaaaaataaaaatgccaaatactatctcgatcagttggtcagcttccgtgttccatattacgttggaccaatgattactttggctgatcaacaaaagacgtctaaggcctcttttgcatgggcagtcagaaaagaagctggcaagattacgccatggaatttttacgataagattgatcgtgaaaaatcggccaataattttatcaaacggatgactcataaggacacttatttattaagcgaggatgttttaccggcatcaagcctgctgtaccagaaatatacggttttagacgagctgaataatattcgcgtgaacggtcgcaagctgcagccagccctaaagcaagccatctatacggacctgtttaagaagcgtaaaacagttaatcttaaggcgttgacgaatttcttgacggttcacgaaccaacgttgaccaagccgaaaatcaaaggactgtcgaacggtcgcagctttaattcaagccttggtacctatattgatatgtctaagatacttggaaaccgcgttgatgatttaaactatcgcgatgatattgaaaagattattgaatggtcaaccgtatttgaagatagtgagatttacggcgacaaactgcaagaaatccaatggctgaccaacaagcaaagagaaaaattggttcggaaacgttatcagggatggggaaggctctccaagaaactgttaacgggtatcactgatgaaaatggtcaacgcattattgatctaatgtgggataccaacaaaaactttatgcagattgtgcatcaaccagtctttgaagaacaaattactgaacttaatcagcagttgctgcaagacgctgataaggcaccattggaagttgtcgacgatattttggctgacgcgtatacatcacctcaaaataaaaaagcaattcgccaagttgtcaaagttgttgctgatgttgtcaaggcggttggcaatgccccagcatcgatttcaattgagtttgctcgtaatgaggatcgtaataaggaattgaaaaacagccggcggcgcagcattgaaaagctttatcatgaaacggccgaaaaactggtcaagcaaaccaatctgcttgaagaattgggaaatgtcaaggatttgaacgatcgctattatctttactttacccaggctggtcgtgatatgtatgatggcacgccaatcaatatcgatgagatcagcacgcattacgagattgatcacattttgccacaatcattcttgaaggataattccttggataaccgggtcttggttaagaaatctgaaaacgcggctaagtcggatcgagtaccggcaaagatttatggagccaaaatgagagacttttggaagcagcttaaagaaagccagctgatcagcaatcgcaagtatcttaatctgacgaccgatccagaacatgttgacaagtatcagatgcagggatttgttcatcggcagttggtggagacgcgccaaattatcaagctggcagccaatatttttggttcgctttacccagacagtgccgtgatcgaaacgcgggccgagtttaccaagcaattgcgtgaaaagttcagcctttataaagtccgtgacgtaaatgactatcaccacgctgttgatgcttacttgacggcgtttgctggccactatctgtatcagcgctatccaaaactgcggccgatgtttgtctacggtgactatgccaaaatctatgccgatgatttgaaacggttgcgctcagttaatctttttcatgatttggaaaaagatcaatacaatagtggaaccgcggtaaatccagaaaccaaggaaaaaatcgtggatgtcgactggctgagcgattatgtatccaagattcagcgtttcaaatatatgctgatctctaaagccgtctatactaagcacggacaaatgtatggtgcaacaattgctcccgtatcagaggccgttacgatgtctaacccaattaaaattaaaaatagtaaaccggtagacatctatggtgcttatactaaagaggttgctgcctatatggcaatcgttcgcgttaacggcaaaaagcctaagtataaggttgtcagcgtaccagtcagaatgctgcagcgactgaagatggctgaacaaaagagtcatgatcagtatatgcagaccctgcacgatgttttatcgcgaaacttcacttcatttaaaaagaatcgtaaaaccggattaaaagaagccgtggtaaaagactttgacgtgctggttccttgtgtgcgctataatcagctagtcattgacgggaaggccaaatttacgctaggaagtcatgagtatcagcataatgccaagcagctggttttaagcgttcgttcattagaaacgttagctaataattttgaatatgtcagaaaacatcctgataaagctgatgaacggatgacaatgctttatgacgatattcttgatcgggtcaaccgctactttacgctgtatgataaaaataaattccgtgaaaagttaaatgctggccgagataaatatctgaaactgccaactttctcgcaatttgaaaacaataagaagacggcaattggcaaaactgaggctgtgatcaacatattgagaggcttgcatgccaatgcggtaacttccgatttgaaatgtttagatatttcaacgccatttggaaaaatgcagtcacaatcaggcattgaattatcagaaaatgcaaaattagtatatcaatcaccaacgggcttatttagcagagaagttttgttgaaagatctgtagcaaaagaaaaggaatggctcatcgatggtgaaccattcctttttaatatgtatcgcccattaattaataaatggatcagaagaaataactttgcgaaatgcattgtttgactttaactctggatgttaaatcaatgatgttattcctgttgggagctacccaacaaatatagtataaccttaaatttttaaattggcaaggaggagtatttatgggatggcggtcagtcattgtaactcagcatgcaaaaatgtcctattcagcaggcctgatggtggtacaaacgatggatggaaccagtgaaataccgcttgatgacatggcactgttgatggtaagtacgacacaggcggtgattacttcggctttaatcagtgccttggtaaagaacaatattaaggtgatttttgttgatcatgctcatcagccaattggcgaggtgaatggctatcaatccgccaatcgtgactgcaaggtgttggaaaatcagtttaattggcagcaacagcgcaaggatgtcttatggacgaagatcgtggctgccaagatcaacaatcagatttcggttttaaaatgttttcataaggatgttgaatgtctgcaaaatgaactggatcaactagtggttggtgatgagtccaatcgcgaggccgtggttgccagaaagtattttccgttactttatgatgatgacttttcaaggcataacggcagtgcgatcaatgccgcgttagattatggctattcgatcttgttgtctgaaaccaatcgcataattgctggcaacggttatttgacggaactggggatccatcatcgtaatcaagccaatcattttaatttgggctccgacctgatggaaccctttcgaccaatcattgattactgggttgccgggcaaaagtttcgtgagctgacgccagaagtaaaaatcggtttgattgattgcatgaatatcgagattctttttaacggtaaaaaagaaattttacgcaatgcgatttctcggtatgtaactgactgtctaaattacttgagtggtgacaaagacgaaacgagaatcgaggtggaatttacaagtgaggtaccgaatgatgcgcttaatggtaatgtttgacctgccagtagaaactagtaaacagcgtcgggaataccgcaaatttcataaaaggctgattcaagaaggctttttaatgattcaatattcagtttacgcgcgagtatgagttagtcggcagtcggctaatttcatggagcagcgaatcaaagcctttctgcctgacgagggagtagtacagacatttatgatgactgaaaagcagtataatgacatgcattttttgcggggcaagaaagtacaggatgttagaaatacctcgaaaaggacgattgtattatgaatttgatatatgcagttcatcagccaatggaacttgaaaatggtcgtgtaaccgtgttgatgaccaataaccagaacgtttactttaaaatggcacaagcactggcaggaaagaatgatttacttcgtttaattgatgatgatttttcggaactgaatctgtcgacagctttatgttgggacgcggatttatcttcagcacctgatttaatggacaagtatggctcagctttaattaaaaagatcagcaatgaattgacggttgatcaaaggcagcgattgcttgctaagcagcaagaattactaacagccattcaagatacgctgttttcagttgatttgcccttggaagtcagtcttgatgatggctttcaaagattatacaaatatgcccgcccacatttcatcagcagtgcaaatgcgacaccatatgatataataaaaaataatttaaatattcatttagagttgaatgactgtcgcattttagcaatgaagaacgtcgctaattttttgttgccagaacaatttaaggcttttcttcagctggttgaagaaaatggcttcgcagtctttctattggaattctcagaaaagcaacagcgtgcgtattatcaaaacgccgatgtttattggattgatgaagatttcgttgattggcatctctaaatcgttagtttttgattagaaaacaacggctttagatggatgttaaatcaatgatgtaattcattgtataaattgtaaaggagctgtggcaatggctttagatggatgttaaatcaatgatgtaattcatacttaaaaataaaaaatgggcgcactccctgctttagatggatgttaaatcaatgatgtaattcatgtcattgctgaacaacagaacactacgcaagctttagatggatgttaaatcaatgatgtaattcatatggcactcgaattaatcaacaacggacaagctttagatggatgttaaatcaatgatgtaattcatctcgtgagtgaggattgacgtacccgcgtcgctttagatggatgttaaatcaatgatgtaatttactcggcgcgctggaagctaacaacactctgcgctttagatggatgttaaatcaatgatgtaatttacagcagcatcagtaaatacaacgggcttgccgctttagatggatgttaaatcaatgatgtaatttaccctttccccgacagacgccagggagttgcggctttagatggatgttaaatcaatgatgtaatttaccgtggtgttggtgctatcgaaggttcgccagctttagatggatgttaaatcaatgatgcggttaacctcgttccaagctgctttagatggatattgaatcaatgatgtaataagtcggttgcgattggcagccggcttttcctttgctagtgtttgcagcaaaattatgcagaggagtatgcataaaacgtttataaaatagtgagcaagcattatgatgtttgtgataaatagtcgattcaattttaaatgtatttttaatttaaaataaaatacgattactattattgaatcatgacatcatcttataatttgataatgactgttttaaaaatgttaaaaatcaacgtcgaattttacttttatcaaagaaaaaataaaaattttgattgatataaatgctgatatcaagggacttgttatttattgtgaaaaatgttcattgaaatctacttgtaattatgcataaaagcgctatcataacctacgaggactgaagtagagagcggcctgagataaaacgtcaattgagaccgctgttgagtacaggcgggatgatttttaaagtatggaaggaagattaagatggcaaaaatgatcagtggctccgatgcagtcttaaaagtaattcggcaatggggcgttaagcacatctacggttatcctggtggttcgtttgactccacgatgaacgcaatctacaaccaacgtaacgaattggaattcatccaggtgcggcatgaagaagcaggggctttggcagcaaccgctgatgccaaattaacgggcaagatcggggtctgctttggctctgccggcccgggtgccattcacctgctcaatgggctgtacgatgccaagcatgatcatgttccggttttggcaatcattgctcaggttccctcaacgcgtatgaatctggactttttccaagcaatggatgaggaaccggcatttgaggacgtttcggtttggaacaagacggccatgacagcggaaagtctgccccgcatgattgatgaagcgattcggcaggcctacaagcatcatggtccagctacggttacgattccaaaagactttggctgggccaagattcctgacacctttgttcctaacgttgccaaccacgttaaagcacactatgtcgttgaccaggatctgttggctaaggccggtaagctgatcaaggatgccaaggcgccaatgatctactttgggattggggctaaggatgccgctgcggaattaaagcgcgtttcggaaaagtacaagatgccgctggtttcctcagttttggccaaggggattttggatgaaaagtatcccgcctacctgggctcggctggtcgggttgcgccgaaacctggtgccgagattggttttagtactgatttaatcgtttgggttggtaccgacgttccgttcagtatcttcctgtttaatccggatgccaaggttattcaaatcgatactgatccagagaagatgggcaagcgtcatcacatcgacgtgccgctgctgtgtgatgctaaaacggctttggcagcgctggccgatgttacagataaaaaagcaccatctgccttttatgatgcggcactggccgacaagcagaactggctggactggcaaaacagctttaatgacagcgaagagatgccagttcgtccagagccaatctttgacgtgatcaatcaaatggcttccagcaaggccgtctttggggttgatgtcggcaacgtcaacatcaactttgaacgtctgctgatgattcacgacgatcaaaagtggtgtacttctggccagtacgcgacgatgggctatggtctgccagcagctatctctgccaaggtcaactacccagatcgcgacgtctacagtctttctggcgatggcggctttgcgatgctgatggaagaaattctcacgcaagttaaatatcacatgcacatcgtcaacgtggtctttagcaatgaatgcctgggttacattgtcgccgaacagcttgatgactcgcatcagccattgtcaggcgttgatctgctggaaaccgactgggcaacggttgccaaggggatgggggcgatggcctttacggttcgcaccaaggctgaattcaaagccgccatggttgaggcgcaacaaaccgatctaccggtagtaattgacgttaagctcacgcatgaaatgccgctttcaaccaaccacatgttcttagacaaagagactcaagatccaaagctggttgacgaatatgttgaaaagtaccaggcccaagccttgaagccattcagttatttcttaaaggccgctaaggaagcacatggcgaagaaattgacgccttctcaggagcttcagcggccagcgtggaagatgaagccgacaatcagccacttgccgataccacgaccggcgcatcagaggacgctcctgaaccagcagacactgatgctaccagcggggcttctcagcactaaggccattaagccaagataccaatttttaagctcgccaccgcgcgggctttttttagtacaaaaaaagccactggataaccagcagcttttcttaaattaataccagaacggattagttttcgcccatcagcttagccataccgttttcggcaacttcttgcagggtcttggcagagtcagccatagccttggattcgcgttcgttcagaggaacttccagaacttgagcgacaccagaagcgttaacaacggctggcgtaccaatgtagatacccttcagaccgtattcgccatcaacaggggcaccaactggcagaacggcattttcgtcacgcaggatggcgcgggaaatccgagtcagggcagtagcaacaccgtagtaggtagcgcctttgcggttgatgatttcgtaagccttgttacgaacgtcatcttcaatcttcagcagttcttcgtcagaaacgcccttttccttggccaggtccagcagtggcttgccgccgatcgtagcagatgagtaggcagcaaattcagagtcaccgtgttcagccatgatgttggcagaaacgtcaactgggctaacgtcgaacttcttagccagggcaacccgcagacgagcggagtccagagaagtaccggaaccaacaaccttgttgcgtgggaagccggacagcttttgaacagcgtaggtcaggatgtcaactgggttagcggcaaccaggaagataccgttgaagccagacttaacgattggttcaacaacggacttgatgatcttcaggttcttgtcaaccagttgcagacgagtttcacctggcttttgtggagcaccggcagtgataactaccaggtcggcatccttgcaggtgtcgtagtcagcagagtagatagcctttggagccgtgaatggggtagcgtcttcaaggtcaagagcgtcaccttccgtacgcttcttgatgatgtcaacgatcgcgaattcttcagccaggccttgttgtgccatcgcaaatgcgtagcttgaacctaccgcgccgtcaccgacgaggacaactttttgatgattcttagacataagtaaagtctcccttaaagtagtattgcatattgcaagactcattatagcattctgatttgaaatttgttaataatgcgtaaataaagccaggcaaatgataaaaaagttgtgtttttgatcattttatgactgatttcagctaaaattgcgctagccgcgtaaaacgccccagccgataataccgccgatcagcaaaatagctggcagaatcagcgttttgacaaagaaagcggcgacggcaatgatggcgatccaaaacagcagatgcaatgaaagtttgaacagtttccaaagcagccacagaccgaccagcgttaacagcagctccatcgtgttttcctccattgataattgatgatgactgattttaccatttcaacagcggccaaagcaccaaaaaggcctggtatttatgctttcttaatctaatctgataaataagataggtgatagcagttgacaagcagcagctgctggaaacgcagatttagatttgatgatccaccctgcgcaaaccagatcaacaaaggaattccgaaacgaaaaaactgtccataatgctgcttgaaaatttccgagatttcgataatttaaaaagcaaaaaaatattctgttattattttccaacttatgatagactgttactttaattgtttgatttttgttaggcttgaaacgttcaaagtcaagctaaatatgataaaatggttagtactagttaaggaaattttttccaatctattgtaggggagggattgccatcttaaatcgaactaaaaaattcatgcgcgacaatgatctggattacaaacgtgaatatattcgaccgatgatgacaccggaacacgtttatattttccgttttgggcggcacaagctcaataaccgagtgatcgttcgctactcccatacatggacggggcgcttaaagatcaatgagattgatgttcggctgcatcatcagcatcatccgcgaatctttaagacggaaacggatttgatcttgtatctgcagcagcacatggaaaaagaagagcagaaaaagattgccaagcaggcagtcaagcatgacgatccgcaaaatcaataagtacagctgaagcgtccttgccttttagggcgcttttttgccatacaaaggaggaaaaaagatgaatgattggacggcagtaaccgtcgaaaccagtacggaggcggttgacgcggtcagctatattttgaccgataccggcgcggcgggaattcagattgaggatgccgcggattttgtcaaattgaaacctggccgctatggagatgagattattgatcccagctcgattccccatcgccaaacgggagctgcggttacgggttactatcccagcagtgtttttgttccagagcttttgcctggcatcaagcagcgggttttaaaactgaaagaatttggcttgaatccaatgcccgccacggttaaaagcgaagcaatcgaaaatcaggactggaaaaccgcttgggaaaaatactatcacccagtacgagtcacgcggactttgacggttgtgccagaatgggaggactatcagccgagctcagatgaaaagcttttgattttagacccggggatggcatttggtacgggaacgcatccaaccacgcaattgatgctgcaggccctggagcttacggtgcgcggtggcgaaagcatgttggacgttggtaccggatcaggcgtactcagcatcgcggctaaactgttaggtgtggggcagattaaggcctatgacattgatgaggtggctgtccgctctgctaaaaagaatctggcgctcaatccggctgctaaagacgttgagattggcgtaaacagtcttttggatggcattcatgatcaagatgctgatctgatcgttgccaatattttggctgagattattttgccgctgatcccacaggcttatgaaaatctcaagccaggcggtcattttctgacttctgggatcatcaatgacaaatttgatgaagtggctcaaggcttgcgtgatggcggcttcaagatcgatgagacgatgcggattaaggactggtatggcattatcgcccataagccaacgccggcagaataataggaggcccatatgcaacgctattttatcaatgaaccggtgcctgaagatcaacggctcgtcttaccaaaagacattgcccatcatctggttgacgttttgcgcgcggagcagaatgatgagctggaagttgcgcttaatgatcaaaaagtctacctggcccggcttgtcagtctgaatccagccaccgtcgagctgcaaagcgatctggggactgatgccgaattaccggtggaagtaattttggcttgcgggctgcccaagaccaaggaaaagccggaactgatcgtgcagaaggctactgaaatgggagccagccgaattgtcttttttgcggcgcagcgttccatcagccgttggaatccacaaaagcaggccaaaaaaatcgagcgcctgcaaaaaattgccaatgccgcggccgagcagtcgcatcgcaatcgccagccagaagtcgtttatggcggcaaactcagtgacgtcttaaaaaacgagccggccgactttaagatcgtggcttgggaagaatcagccaagcagggtgaagaggctaatctggccaaaacgctcaagcagctgcagccaggccaaaagctgttagcagtctttggtccagaaggcggactcagcgcggccgaagttgatcagatgaaggagcaaggcgtcgtgccggctggtttgggaccacggattctgcgtacggaaacggcaccgctgtatctgctggctgcggtttcctatcagttggaactggctcgttaagcgcgttgccaagcattgtgttacaataaatgtcaatcaatttggcatgagtgaggagattttaatggagaagttgcagcaattttggcggacgaccgatcgccggcttttaatcagcgatctggtgctatcattggtgatcaacccgctgtttttaaagcagcatctggtatcgcgcgttcagatcattatttggcttttgctgttggttaatttctgttacgttgtctgggccggcagaagagtcgccaagcagcaggatcgctcctggcagctgctggtcttttcagtcggttatctgatcggcgtccgactttttcaagtatcacgctacacttactatttcgcactggtctatttaggcatcgaatacctggctaaggccatgactcaagatgccgtcaaaaatcaatctaaagaaagcaagttgatgcaggatgtcaaaaaacaatgaactaacgcatgaagacgttaaaaagatcgtttcttcatacatgaatgaagaacatgttgaaatggttgagcgcgcctaccattttgccgcggttgcgcacgctgaccagcatcgcaagtcgggtgaggcctatatcatccatccaattcaagttgccggcatcctggccaatctgcacatggatccagaaacggtatgcgcgggctatatgcatgatatcgttgaagatactggggccactttggatgatattcgggagcttttcggaccgacgattgccatgatcgtggatggcgacaccaagatctctaagattcattacaagtccaacaaggaacagatggcggaaacgcaccgtaagcttttgctggcaatgagcaaggatatccgcgtgatgatcgttaaactggctgaccgcctgcacaatatgcggacgctgcagcatctgcgtcccgacaaacagcggcggattgccaacgaaactctggaaatctacgcgccgattgccgaccgactggggatcagcaccatcaaatgggagctggaggatctgtcgctgcgctatctcaatccgcagcagtactaccgcatcgtgcatctgatgaattcgcggcgggatcagcgagtcgaatacatcaaccgcgccattgtcgacgttaaaaaagccatcagcgatctggaattgggacccaatgtcgagatttatggccgcccgaagcacatctactcggtctaccgcaagatggtcacacagcataaacagtttgagcagatttatgacctgttggcgattcgggtcgtggttgactcaatcaaggattgctatgccgttttgggcgcggttcataccaactggaagccaatgccgggccgttttaaagactatattgccatgccgaaagcaaacggctatcagtcgctgcataccacggtgattggtccagaaggccggctgctggagattcagattcgaactcacgatatgcatgaggttgccgaatacggggttgctgcacactgggcctataaagaaggcaagaccaatggcatcaagcagacgcaggactccaaaaaactcaacgtggtcaaagaaattctggagctgcagagcgaatcgcaaggcaccgatgaatttttgcagggcattcaaagcgacgtttttgccgacaaggtctacgcgtttactccgaaaggcgatgttattgaaatgccaaagggtgcggggccgctggacatggcctaccagattcatacggaagtcggtaatcatacgactggtgccaaggttaatggccgcatcgtgcctttgaactatgagatcaaaaacggtgatatcgtcgacattttaacttcatccagttcggcggggccaagtcgcgactggctggatctggtctttacgcggcgggcccgcaacaagattcgtcagttcttcagagcccatgatcacgacaaaaacgtggaaagcggccgtcagattattgccagtcagctgcgtgatgctggctatgatcctaatgagctgatgactacggaaaagaacaaacagattgctgatcagatgcactacaagacggctgatgacatgtttgccgcggttggttttggtgacgtgccgccaattggggtgcgcaatcgctttacggccgacattcgtaaaaaagaggctgatgacaagcaacgggccgcccagaaagccgttttggaagatcaccagacttttgaaaacaagaacgttaataatcaacgcaagtttgccaagagttcagaaggcgtggtcgttgaaggcgttgataatcttttgacgcggctcagccattgctgcagtcccgtgcctggcgatgagatcgttggctacattaccaagggccgcggggtttctgttcaccgtgccgattgtcccaacgtcaaggcagccgaaaagaacggcgaacggctggtctcggtcttttgggctaatccagccggcgataagaccaactacaatgccgatattgaagttgagggctacaatcgcaatggcctgttgaatgacgtgctgcgctcgatcaacaacaacacgcgttttttaacgtcggtcaatggcaaggtcgaccacaacaagatggctacgatttcagctacgattggcgtgcgcaacagtcagcatctgcagctgatcttggacagtctgaaaaacattccagatgtctatgtcgtcaaacgggtaattcgttaagaggtgatcaaatgcgtgtcgtattgcaacgagtcaatcatgctgccgttagaatcgatggtgaaacggtcggccagattcaaaaaggctacctactgttggtgggaatggcacctgaagatactgatgagcagttggactggatggtacacaaaatcgtcaacctgcgtgtttttgaagatgaaaacggcaagctgaaccgagcactggctgatgtcaatggcgagattttgtcgatttcacagtttaccctgtatgctgacgtcaaacatggcaatcggcctggtttttcaaaagctgctaagccggaaattgccgcgcctttatatgaccgtttcaacgaaaaactgcgtcaagccggcgtgcatgttgaaaccggtcgttttggcgctgatatgaaagttgagctggaaaacgacggtccggttacgattctttatgaaaaatagtttttaaaaagcgagcagcggttagaccgttactcgctttttaattaggttcttgaatagctgatcgataatcaggcaggatactggcgccattgtcatgacaatcagtggttacagtcagttcaacgttaaaaacaacatcgctttgcaaatcatacttgaatcgatcgggactagaaaatctacacattgattaatttatcagtagcgttccaaaatgccgtcgactgctgggccatacgtttcgccaaacaagatcagatgcatgcacagatagtagaactgataccatggcagtcgctcattgacgccttttgccaatggatactcctgctgataggcttggtagaacgcaggctcaaagccgccaaaaatcgtggtcatagccagatcaaactcacgatcgccatagacggcatccggatcgatcaagactggctgaccggtatcatcaaacatgtagttgcctgcccagagatcgccatgcaaaagactggggatgacctggtgctgatcataatagtcactgaaggcttggcgcattctttgatagtgagtctcgcgccagtcattccagcgcccgtttttcttagcaacggcaatttcgggatctagccgctgcttgagataaaagtcgcgccagctgtcattccacgcattgtttttaaccagcgctctggtggtgtgattttcataaaagccaaactgtttggcgtgctgggcgtgcattctggcaactgcccgccctagatcagcctgtgagccgctgccgctttccagccattcaagcaccaggtaggcatcgccttgaatctgtccttgagcaagcggcgtcggggttttgacgagcgcgccgattacttccagaccgcgtttttcgtgattgaaatagctggccggatgatgcggctggacctttaaaaaataggttctttgatcagccttgatctgataggcggcattgatgtcgccaccagcaactggctgacaatctttaacctggcgaaacggcaattggctgagccatttttgattaagctgatatgcagacataagaccaacatcctttctgtctagtttttaaagtagttatttaatcccttggcaatatcgtgggcgatcttttgctgatagctggcgtttttgatttgattaaagtctttagttgaattgatatagcccatttcgcaaagcacggctggacgggtattatcgcgaatgaccagaaagtcgccaaattcaatgccgcgattggtcaatggcaggttgttcagctgcttgttcagtaccttggccagctttttggacgcacccttatggtaataataggtcgtaaatcccgaggcttcgttgtgagccggcgaagaatcgaaatggaagctgataaaggcatcggcatgcatgctttcggcaagggctggtcgcggtttgaggccaacgtaacggtccgagtcgcgcgtcatgattacgtgcgcgccccgcagccgcaattcctgcgcaacgcgattggccagctgcagcgtataggtcttttccatgtagcgcttgctggtgctgtttttatattcggcaccagagtcagaaccaccatggccagggtcaattacgatcgtagcttcggaaaggcttgaaacgtgcttgagattgtttttgggatgaaccagccagctggcaacccagccaaaacgctgatcgctgagccgaatcttgtaccatgagttgcgtgttttgagaatcgttacgcgctggccttttttaacggtaccgatcgtggcatagtcaagcccaggaccggtacggacgttgagcccactggtttcaatggtggtcgtccgcgaaaacgtcagcgcgaccaccatgacaattgcaattaatgccatgctgatcgcaaccaggacagctttggcaggacgatgaaacttcaagatttttgctcctttatcatgaatcattaagataagtttagaaagcatcaattggaaaatcaagactaattcggggttggcctattgactaaacagctcaagcctagtaggctaagtaggtaattaaatttagagatgccgatgaaaaagaatgttcggtctgccatagctttcagcgagcggggaattggtgcaagccctgtcgattggctaccgagtgacgctttggaggcagggtcatgaccccgtcgaagctacgttacccaagagtaaacccaaggtggtaccgtgcattcaagcacccttgcagcagcaggggtgcttttttaaatcgactgattgatcaatggaggagagatacaatgcgctatcaacgcccaaaaggcacggctgatatcttgccgggcgaatccgctcagtgggaagccgttgagaagctggctcgtgaaatctttgcgcgctatggctaccgcgaaattcgcacgccaatttttgaaaactacaatatttttgcccgctcggctggtgagacttctgatgtcgttaccaaagaaatgtatgactttaaagacaagggcgatcgtcacgtggcactgcgcccagaaggtacggccggcgtggtccgggcctatgttgaaaacaagctgtacggccctgaatacaacaagccttacaaggtctactacatggaaccaatgtttcgctatgagcggccgcagtctggtcggcagcgtgagttccaccagatcggggttgaagcattcggcagcgacaatccagccgttgacgttgaagttatgaccatggcgctgcgcctgttcaagcagctggggttaacgggtctgcgcgtagccatcaacacgcttggcgatcaagaaacgcgcgatacctaccgtcaagcactgatcgactacttaaagccgcactacgatgaactgagcgaagactctcaagaacgtctggaaaagaatccattgcgggtcttagacagcaaggatccacgcgacaagcagtttgttgacgatgcgccatcgattctggactatttgactgatgatgcccaaaagcactttgatctggtcaaggaaatgctggatgagctggacattgactacacggttgacccaaccatggtgcggggactggattactacaaccacacgatctttgaggtcatggttcaggcaaagtcgcttggtcaaggctatacgacgatctgtggcggcggccgctacagtggactggttgaagagcttggtggtccggatacgccaggggttggctttgggattggcttagaacggctgatgcttttgctcaacgaagaaggactgcttaaaaaagcggatcctgacttagacgtttatgtcgtgggcattggcgaggcaaccaacactgccagctttaaactggttgaagcggcgcgggatgccggctttgttgccgaacgcgactacttgaaccgtaagccaaaagcgcagtttaagacggcggccaaggaaaatgccaaagtcgttttgacgattggccaaaaagaactggaaagcggcacggttcactttaaagtaatggccaccggtgaagagactactttaccgctggaccgcgtttttgccgattttaaagccgtttatcaagaacagacaaaggggtaataaaaaatgaagcgtaccaattatgctggtgagaccagcgaacagcagattggccaagaagtcgtcgtaaaaggctgggttgccaagcgacgcaatctgggtggcctgatctttatcgacttgtgggatcgctctggcatcgtgcagctggtttttgatgaaaagattgatccagcggcatttgagatcgccaaccaggtacggaaccaatacgttattgaagcgcatggtctggtgcgggctcgtaaggaagtcaaccctgacatgaagacgggcaagatcgagattgaagttaaagaagccagcattttggccaagtccaagccaatgccgtttgaaatcgtggatgacgttgatgcttctgaagaactgcgtctgaaataccgctaccttgatctgcgccgtcctgagatgatgaagcgcttgatgctgcggagcaaggttacgcatgtcgttcaccgctactttgaaaagaacggcttcttagacgttgagacgccagaactgacgcgctctactccagaaggggcgcgtgactacatcgtgccttcacgggtctatccaggcagcttctatgctttgccgcaatcgccacaattgtttaagcaactgttgatggcagccggggtcgacaagtactaccagattgccaaatgcttccgtgatgaggatttgcggggcgatcggcagccagaatttacgcagatcgatactgaaatgagctttgccacgccagaagacattcaagcgatgacagaaggcctgatcaaagacgtcatgaaagaagtcttggacattgacgttaagacgcctttcccacgtatggaatggcaagaggcaatggacaagtacggtaccgacaagccggatacgcgttttgaaatgctaattcatgatatcagtgatctggtgaaggacagctcgtttaaggtattcagcagtacggtggcagctggcaactatgtccgggctattgtcgtacctggtggagctgacaaatactcccgtaaagacatcagtaagcaggaagactacatcaagcgctataatgccaaggggctggcctgggtcaaggttggcgcggatggctacaatggtcccgttgccaagttcttaaacgatcaagctgctgaattaaatgtggcgcttgatgccaaggaaggcgacttgatcttaatcgttgccggctcgttccacgttgtctgcgactcattgggatacctgcgcaaccactttgcccaagagctcggcttaactgatcccaaccaatggaactacgtctggatcgtcaactggccaatgtttgaatatgatgaaggctttggcaagtggatcgcggctcaccacccattcacgatgcttaaccctgaggatctgcactatctggaagatggcgaagacccacatcaggcgcacgcgcaaagctatgacatcgttttgaacggtcaggaaatcggtgggggttctatccgtattcacgaccctgaaattcaagaaaaggtctttaaggccctgggttacagcaaagaaaaggctcaagcacgcttcggctttttgatcaaggcattggaactgggaatgcctccagagggtggtctggcaattggcctggatcgctgggtaatgttcctgtcgcaggctgacagcattcgtgatgtgattgccttccctaagaactcaaaggccgttgaaccattgacggcggcaccagctcgcgtcagtgaacaacagttggaagagctgcgtctggaagttccagctgaagatgaagataaagaagactaaccgaatcagttattaaaaaggatccgctggcttagcggatcctttttgattaaggtgggggaatatgcaattacctgcttttgactaaaaaccggcgcaaagtaggtaaattcagagcgggcaatcgttcaaaaccggattttcttcactaagtcaagaatcttcagccagcaaagtacagcccaaagtaccttgacagaaccgcggcaagaatctggacttatgatgagctggccttaaaaagatcagccttaatcagccccgcctaaagttggctgtgatccaataattaacaagaatcagccagcaacagtggatgtaagcttatgaagctagtgcgcgccttacagccttacaatagcggatcttgactacgattattcaagcttgaagttgcggacgaccttgtccagatcctcttgctcgattccaagataatggcgggtattgcgttcagaggagtgattgaacagctgcgagatgatttcgatgttgacgccatctttatacagctgacggccaaatgtcttgcgaaacgagtgcgtccccagcttagctaccaatttttcgttgccggttttacgcgcgattcgctgcagcatttgataaaagccatgcacggagaagtgaccgtcttggcggccgggaaacagccaatcgttatcgtctttgaagtccagctcgtttaagtagttgatgatctcagccagacagttgttccagtaaagcgtcttggccttaccggttttttgctcgatgatccgcgtttgggtcttgtttttaacgtggccaactcgcagcgtcacgacatcagaggcgcgcagtccgttgtttagcgcaatcgagatcaaaagcagattgcggttgaccaattcgggacgtgaatattggcgaatggcttcttgcagttcgtgatactcggcggtcgttaaaaatttgacgttttccacccagatcttacggtcgcctttcttttcgccattggtcttgtttttgggaacgtagatgcgttttttcgccatagaaattcctccttaacagcgaacgagtcaataattttattgtagcgataaaatacgctaaaataaagagactcgcttattaaagaaaggatgcgatcaaatgctgattggctcacatgtcagtcttaaagcgcccaaaatgctgcttggttctgctcaagaagcagccagctatggggccaatacgtttatggtttatactggtgcgccacagaataccaagcgcaagccgcttgatgaaatgagaattccagaaggtcgggcctatattgaagagcatggctttagtcatctggtagttcatgcgccttatatcgttaatctgggcaacacgctcaagccgcagaactttgcttttggcgttgagttcctgcgtcaagaggttcaacgggccgcggccattggtgccacgcagattacgctgcatcccggagctcatgtcggtgctggggccaaagcagccttacatcagattgcgcaaggattaaacgagattatcacgcccgatcaagagccgcagattgcgattgaaaccatggctggtaagggaactgaggtcggtacttcatttgagcagattgccgagatcatggatcaggttgtctataacgaaaagctctcggtaacgtttgatacatgtcataccaatgatgccggctatgacgtcaaaaacgactttgatggcgtcttggaagaatttgatcatgtcttgggccttgaaaagctgcaggttattcacttaaacgattctaaaaacccgcaaggcagccataaagaccgccacgaaaatctagggatgggaacgattggctttgaggcgctcagttatattgcccatcatccgcaattggaacaggtgcccaagattatggagacgccctgggttccactggccgataatcctaaaaagaaagtcgctccttatggcgaagagatcaagatgatcacaaacaatcagtttgatccaacttttgtggaacgactaagccattctgaaaattagttgaaattttttcaaaaaagcagttgacgctcttttttggattaagtataatatcattcgtagtgataagattgaagcagtcaattagacgcttttaatcgcaacagtacggaattctaagctcggagggagggaatcaacaatgtcaaagactatcgttcgcaagaatgaatcgttagacgacgctcttcgacgctttaagcgtacggtttcacggaacggaacgctgcaagaataccgcaagcgtgaattttacgaaaagccaagcgtaaaacgtaagttgaaatctgaagcagctcggaagcgcaagaacaagcgccgtcactagaatgctgcagctcctgggcgaatgtctcattcaccaggggcttttttgtataatttagaaaaacgggaggaacttgaaatgagtctattggataagctgactaaagacatggttgccgcaatgaaggctaaggacaaggaaactctgagcacggtccggatgcttaaggcttcggttcaaaacgaaaagatcaagctggggcatgaattaagcgaagaagaagaaaattcgctgttggcgcgtgaatacaagcaacgcaaggaagctttggaagaattcgttgctgccaagcgtcaggatcttattgacaagaccaaggctgaaatgagcgttgttgaaaagtacatgccaaagcagctttctgatgacgaaatcaagcagatcgttgctgaggccgttcaagctacgggtgctgacagcatgaaggacttcggcaaggtaatgaagtcggttatgccaaaggttaagggcaaggctgatggcaaagtggtcaaccaaaccgttaaggatgctctgcaaaaataaggcattaatgtaccggattgctgatcaatcaagctattgatcaagatgataggcactgtccgatttgggcagtgcttttttttcccatgttgcggtttatgcgcattgcagccggctatgttataatttttgatggtattgattaaatcaaaagcaaaggggaaatcttcgtttgacagaaatgacttttcgcattgaaagccctgaagttgaattgggacttttgggcgcgcaggacaaattcgtggtgcttttagaagaaggcatgaacgtaaccatcaatccgtttggtaccgatctgaaaatcagcggtgaagatgaggacgttcatctgacctatgacgttttagagcagctggtagatctgctgcatcacggcatcagcttaagcagcacggatatcgtcagtgcgatgaagatggctcgtcgcggcacgctgcagtactttggcgatctgtacagtgaaacgattattaaggatcgcaaaggccggtcgattcgcgtcaaaaactttggtcagcgccaatacgtgcatgccatcaaggataatgacattacgtttgggattgggcccgccggaacagggaagacgtatctggcagttgccatggccgtagctgctttaaagcgtggcgaggttgagcgaatcatcctgacgcggccggccgtagaagccggtgagagtctaggttttttgcctggtgacttgaaggaaaaggttgatccatatctgcggccaatctatgacgcgttaaatgagatttttggcgccgaccacgtggaacgcctgatcgatcgcggcacgattgaaatcgcaccattagcctacatgcggggccggacgctggataatgcctttgtaatcttagacgaggcacaaaacaccaccaatgcgcagatgaagatgtttctgacgcggcttggctttggttctaaaatggtcgtcaatggtgacgtctcgcagattgacttgccaaggggaactcgcagcggtttgatctcggcaccccgaattctgcagaacgtaccctcaatcgaattcgttcaattcagcgcagcggatgtggttcggcatccagttgtcgcccgcatcattacggcctatgaaaatgatgagcaacagactttggagaaaaaataatggatattgaaatctacgaccaaaccggtgaccatgccgtcagccaagaccaattgcagctggcgcacaatattttggaatatgcggccaagcgccttgagttaaaggacaatacggaggtttccctaacgtttgttcacaatccgcaaatcagagaactgaatgctcaatatcgcggcgttgatcgggcgactgacgttttaagctttgccttggaagacgacagtgacgactcgccgatcttattggatccagaactggctgcccagatcccagaaaatctcggcgatctgttcatctcgattgataaagttggcgagcaggctaagtttttgggccattctaatgatcgtgagctgggctttttgatcgtgcatggctttttgcatttgaatgggtatgatcatgaagaaaaagccgatgaagaaaaaatgtttaagctgcaagaggagattttaaatggctatgggctcccaagataagcatcaggtcgaaaaaaatcgtcatttcatccaggcgctgggacatgcctgggatggagtcaaagatgtggttaaaaaagaacgcaacatgcggttccatatcatcgcggccgttttggtgattatcgtggcctttttgatgcaggtcaacgtttttgagtggctgtggctgctgtcggcaatctttgtcgtgtttgcggctgagtttgccaatacgatcgttgaggagctggttgatctggtcgtgcaccatcactatgatcttgatgctaaatatgctaaagatattgccgctggggtcgtcttgctggcggctttttacgcggttttggttgggctgctgattttttggccgcgcttcaagaatttgttaggcatttaggaaagggaaaaatatggataatccaaattttaaatctggtttcgttgctctgattggtcggcccaacgtcggcaagtcaacgcttttaaactatgtcgtcggacaaaaggttgccatcatgagcaatgttgcccaaacgacgcgtaataagattcaagggatctacactactgatgaggctcagatcgtcttcatcgacacgccgggggtccacaaaccgcagaccaagctgggcgacttcatggagcgctcaacgctttcggctttggatgaggtcgacgcggtcttgtatgtggtcgctgctgatgaaaagcgcggtcctggcgacaacttcatcatggaacggcttaagcaggtacaaaagccaatctatctggtcgtcaataagatcgataaggtgcatccaaatgagctgccggcaatcgtcaagcagtttgaggatggcacggttaagtttgccgatgtcgttccggtttcggcattgaatggcaacaacgtcaatgctttgatcaacaagttggtcgaccagctgccaaatggtccgcaatattacccaagcgatcagatcagcgaccaccctgaacgtttcgttattgccgagatgattcgtgaaaaagtctttatgctgacgcgtcaggaagtgccgcattccgttgccgtcgatgtcatgtcggtcaagcgtcaagatgatgagacggtacacatcaatgccaatatcatcgttgagcggccgggacaaaagggcatcatcatcggtaaaaaagggcagatgcttaaacaaatcgggaccatggccagaaaagacatcgagcatctgctgggtgatcgggtctatctgcagctgtgggtcaaggtggttcccggctggcgcgataaatcggcaatgctcaaagactacggctaccgcagcaacgactattaaaaggagctgagagcatggcgcgggaaaatacttcctttgccggcatcgtaatgtatcggcgcccgtataaagaacgtgatctgttggtcaagtttttgactgacaagcgcggaccgatgatgtttttcgtccgaggcggcaatcgttcgcatgccaagatcaccagcgatattctgccttttacgcatggacagtataccggctggctggctgatgatggctcgctcagctatttgagtgccgcgcgtgatacgcgtcaatacgttcatctgggcgaagatcccctgcgcagtgcctatgctacctatattctcgagttggtagacgcgacgtttgaagagggccgatcgattggcggttggtttaatcaagtggcggccgcgctcgagctgatcgataaagggcaggaccctcagatcgtggctaacgtcttagaagtgcagtttctgcctttgctaggagccgcgcagacttgggattgctgcacgatctgtgggttgaacgatcgcccgctggatttttccgaagccaatggggggatgctgtgcagtcggcactggaacctggatgagcgtcggtttcacttggatcgccggatggttggctatctgcagctgtttgcctctttgaatctggcgcaggtcaatcagattcaggttgatcaaagcgttaagaatcggctgcgctatacgctggatcgcatttatgacgatgagctcgggctgcacttaaagagcaagcggttcatcgatcaaatggcgacctgggaaaatcaattgaaaaatcttcgctctgaaaattgacaagtgtaaagtagttgtctatgataaaagagcaactaaatttaaatctaatcgacgatgacaaagaatcgctgcttactgtcgaaccaaagcgatcatgggatggtggaagccatgataacgatcaagcagcgtggcactttaacagtcgcttaattaagctgttctgcatgtctaaggtgcagaaaagcagggtggaaccgcgaattaacttcgtccctgcaatgaccagtccagctggccattgtagggactttttacgttgaaaggagtcagattatgtcaaagaaactcaccgttcaagagattatttttactcttgaaaaatattgggccgaccaaggctgtatgctgatgcaggcctacgacaacgaaaaaggtgccgggacgatgagcccatacacttttctgcgggcaattggacctgaaccatggaacgttgcctacgttgaaccttctcggcggcctgccgatgggcgctacggcgaaaaccccaaccgtctttaccagcaccaccagttccaggttttgatgaagccatcaccagacaatattcaagagctctatttgggtagtttgaagcagctgggcattgagccgctggaacacgatattcgttttgttgaagacaactgggaaaacccatcaatgggctgtgccggtgttggctgggaaatctggctcgatgggatggaagttacgcagtttacctacttccaagtcgttggtgagctgcagatggatccggtagctgccgaggttacctatggcctggaacgattggctgaatacattcaaaacgttgacagtgtctatgatctggaatgggcagacggcgtcaagtatggcgacattttcaaggaaccagaatatgagcactccaagtacagttttgaagaaagcaaccaagacatgctgcttcaagaattcaatgactatgaagccgaagccaagcgtctgatcaaactgggactggtccacccggcatatgactatgtcttgaagtgcagccacacgttcaacctgctggatgcgcgtggagcggtttcagtaacggagcgggccggctacctgcaccgcattcggatcatggccaagtcgattgccaaggcttttgtcgaagaacggcgcaaacggggcttcccattgattcatgatgaaaaggaacgccaggcaacggtcgaaaaatacaccaagctggctgaaaaagcagcggtacgggcggccaagcaagctgccaaggccaagaaggaggacaagtaaatggcacattcatatctgttggaaattgggctggaagaaatgcctgcgcatgtcgtaacgccaagcatcaagcagctgcacgaacgcgttgctcaatacttaaaggaacagcgcattgactttgcaaagattcaagaatttgccacgccgcgtcgcttggctcttctgattaccgggttagccgacaaacagcctgatatcaacgaatccgttaagggcccggctaaaaagattgctcaggatgcagatggcaactggaccaaagcagcgattggctttacgcgcggtcaaggcgtcagtgttgatgacatcgagtttaaagagatcaagggcgttgaatacgtctacgttgaaaagcacgttgacggcaagccggttgctgaggttctgcccggcttaaaggacgtcatcgaagccatgaacttcccaacgatgatgaagtggggccgtcactcattgcagttcgttcggccgattcgctggctggtatcgcttttggatgatgagatcgtgccattttcgatcctggacgtaacggctggccgcatgacacgtggtcaccgtttcctgggtcatgacgtggagatcaagcatgccgaagactacgaagctgaactgaacaacgactttgtgatcgccaatcaaaaacagcgcaagaacctgatcaagtctcagattgacgagatcttggcggaaaacgactggatcatcgattgggatgaggacctgctggaagaagtcaacaacctggttgaatggccaacctcatttgccggttcgtttgatgaaaaatatctggtcctgcctgaagaagtcctgattacctccatgaaggacaaccagcgcttcttctgtgttcgcgatcatgaaggcaagcttttgccacactttatcgcggtccgcaatggtaacagcaaatacctggaaaacgtgatcaagggtaacgaacgggtgctggtaccacgtctggaagatgccaagttcttctatgaagaggaccaaaagattacgattgaccaatacgtggctcgtttaaagaaggtcagcttccatgacaagatcagctccatgtatgacaagatgggacggacggcggtcttggccaagctgcttggtcaaaagctgaaccttagtgatgaagagctggcagaccttgatcgagctgctcacatctacaagtttgacctgacgacgcagatggtgggtgaatttgctgagctgcaagggatcatgggcgagatctacgctaagctgtttggcgaaaaagatgacgttgctgcggcaattaaggagcactatatgccaatctctgcagaaggtgagctgccagccggtaagatcggcgcgattttggcaattgccgacaagctggacagcatcatcagcttctttgccgttgatatgattccaagcggctccaatgacccatatgcactgcggcgacaggcttatgggatcgtacggattattgctgcgcgcggctggcatctgccggtaatggggatggccgatgaatttgcagaagcattggcagctcaaggactgacgccggaatttgacgtttcgcacaatgctgatcaggtacacgcattcttcttggatcggctcaagcagttcttcaacacgcaggatctgcgctatgacgtgattgatgccgttgtcgataccaaatcggctgacattgccaacgttctggcagcagccgagacgcttgacgcgcacaaagacgatgatggctttaaagaagacgttgaagccttgacgcgggtactgcggattgccaagaaggctgactttaaggatggcgtaccagcagttgatccggccaagttccaaaacccatcggaaaccgagttgtttgatctggtggcttccttagacaagaagtgggatgcgcagacgctggcacaaaactttgctgacctgcgagcaatggcaccagtaatcaccaactactttgaagaaaacatgattatggacaaagatgaaagcatccgcagcaaccggctggcccttttgcagcagctggccgatgatgtctacgcacttggtaatcttgacaagctgatcgttaaatagttacggtttatcgagcaaatgaattgtattgttccagacttgtggtatcatgttaaataggtatattaggtagtgtctaaaagcagatgctgcctgaagtcgttgaaggtcgcattccatctggaggcgaccttttgctactattcgcgggaaatggggtgaacgaatggcgcgactttcgcaagaactgatcgatcaggtgcggcagtccgttgatattgctgacgtcatcagtcaagacgttcagctgcagcggcaagggaagaacctggttgggcactgtccgtttcacgaagataacacaccatcattttcagtcagtgagcaaaagcagttcttttattgctttagctgtcatcgctcaggttcagtattcgactttttgatggagctgcatcatctatcatttccgcaggccgttgagcaggttgccaagctgggcagcgtggccttgccaactgattttcaagctggtgccgagcctaaaacggaacaggcaccggattcgcagcaggggcgcttgattaagctgcatgaaacgaccatgcgactatatcatcatattttgatgaacacgccagctggcgagcctgcccgccgctatctgcaaaagcgcggcctgactcaagagcagatcgatcagtttaatctcggctatgctcctaaagaagaggtcttaaaggccgttttggaaaaagaaggacatgactatcagctgctgcgccgatcaggactgtttaccgaggatcgctccggcagtctgcatgatcgtttccatgatcgagtcatgtttccgctcaaggatgggcagggacgaccggttgccttttcagggcggctattgcaaaaaaaaactgacgcgccgaagtatctcaacagtccagaaacgccgatttttaacaagcgttgtttgatctttaattttgatctagctagaaaagcagccagagaaaatgggaaactgctgctttttgaaggttacatggacgttatttcggcatatggcgccggcgttcataatggcattgcttccatggggaccagtctaaccgatgagcagctggcgatgatcgtcaagacgaccgctcagctgaacatttgctacgatggcgatgcaccgggacaaaacgccattgagcgggcactgaagctgattgaggccagcgcggttgccaatcagcttaagattcatgtcgtgcaactgccaaccggacaagatcctgatgaatacattcagcaaaatggtggggctaagtttcgcgattatctgaaaaataccgaagaaacaccgactgcatttcgcttgcgctatctgcggcaaggactgaatctgagcaatcaggctgagcttttgagttatttgaatgccgcgattggcgtgatcgccaaggtcggtgatccggttgccagagatctgtacgtacaggaattggccagggagtttcaggtcaatccgcaaaatctgcagcagcagctaacgactcagcttcaaacacagccggctgctcagccaggtacggcaccgtcagcatcacaatggcctgataatccgccggctacccccaagcgccggtttaatggatcgtttaatcgaacggcttacaatcaaaagcggcgcgctcaagcacaaccagcaccacaggcagtcacgctgacggcagccgagcagcagtcattggcacttgatcagactgagcgggcagagcgcttattgctgacggccgtgctccatgactatggcaccagggctcagctaaaggtaatgcctgattttgcctttgttcatgatcagtatcaggaactctatcagcaggccttgaattactttaccgagcatgatgagtatgatttagccagttttttagactacgtggacgatccggctttaaaagcgactttaacacagctggatggcttgaatgcagcagcagttccaccggctgcaattgacgactgtctgcgcatcatcatgcaaaagacacctttaacacagaagatcgctcaagccaaattggcgctgcaggaagccaaggcacggagcgatcacgaactaatcacccagctgacgattgaactcattcagctttatagtcagcagcaacgattaaaaacggaggagactagttaataatggcaaacagcaaaaagaaagacatggtaatttccaacaaagccgactttgatcagactgaatacgacaaagccgtgggcaagctgatcagaagctataagaaagccaaggaaattcaatacgatgacttgactgaccagatcgcgactccgtttggcttgaatgcccaaggaatggataatctgcttcaaaacgttgaagatgccgggatcagcgtcgttgacgaaaagggtgatccagatccgcgcgctttgaaggccacggaaaaactgtccaacaaggccttaaaggataccgttgccccaaccaacgtcaagatcaatgaccccgtacggatgtatcttaaggaaatcgggcgggtcaacctgctgacggcggacgaagaaattgcgctggctcaacggatcgaaaaaggcgatgagcaggctaagcaggaactggcggaagccaacctgcgtctggtggtttccattgccaagcgttatgttggtcgcggcatgcagtttttggacctgattcaagaaggtaacatgggtctgatgaaggccgttgaaaagtttgactaccggaagggattcaagttctcaacctacgcgacctggtggattcggcaggctattacgcgggcgattgccgatcaagcgcggacgattcgaattccagtgcacatggtcgaaaccatcaacaagctgatccggattcagcgtcaattgctgcaggatctgggccgagaaccgctgcctgaagaaatcggtgctgaaatggacatgccaaccaagaaggtccgcgaaatcctcaagattgcccaagaaccagtctctttggaaacgccaattggtgaagaggatgactcgcatctgggcgactttatcgaagaccaggatgctaccagtcctgccgatcatgctgcttatgaaatgatgaaaaagcaattggaaaacgtcttggatacgctgaccgatcgtgaagaaaacgttttgcggctgcgctttggccttgatgacgggcgaacgcgtacgctggaagaagtcggcaaggtctttggcgttacgcgagaacggattcgtcaaatcgaagctaaggctctgcgtaagctgcgccacccatcacgttccaagcaattaaaggacttcttggaataatcagcttatcttcataatcgataataaaaggtctgctcctgaattgaggagcagaccttttatcgtactaatgattcttatttcagactgtcaggcaggttaagcgtcgtctcagccggggtggtcttggccagcaccttgccacggcgaatgttgtagagaacctcaacgtgcttgtttaaagcgttgtagaagtcttcagcgttcaacaggatgcagttggcttccagaccttctttaatgccgtaacgatcagcaatgtgcagcgtcttagcggcattgtaggttacgaacttgaatgagtcctgcagctggctgtagcccatcagatgagccgcatagactcccattgagacggaatcaagcatgttgccattgccgagcgggttccatggatcctgaatatcgtcttcaccaaacgaaacgttgatgttggcagcatccaactccttaatccgggtcagaccgcgccgctttggataggtgtcaaaacggccgcccaggtgcatgttgaccagtggattggagacaaaattgatgtttgacatcttcagcagccggaacagcttgtaggtgtaagcatcattgtatgatcccatcgctgtcgtgtggctggcggtgaccatgtcggcaagaccggtcttataagccattgttgctaagacttccaggttgcgagaagccggatcgtcaatttcatcacagtggacgtcaaccagcttgtcgtatttttcggccagcttgaccaggaacttaactgatttccagccgtattcagtcgtaaactcaaagtgcggaataccaccaacgacatcagcgccttccttaacggcctgcttcatcagcttcttaccgtgcggataggagagaatgccttcttgtggaaaggcaaccaattgcagatcaaccacatcctgcatctcgtgctttaattccaaaagggcctgcagtgcgatcagatgcggatcggtaacgtcaacatggctgcgtacgtgctgaatcccatgaccaaccatattgagcagcgtctttttagcccgctgcttgacgtcttgaatggtgagatcctttttgcgttctgaccagatgcgaatcccgtcaaacagggtaccggtttcgttccattctggctggccggccgtcagcgtggcatccaggtgaacgtgagagtcgataaatggcggcagcagcaccttaccttgaccatcaatgacttcttcgccaggtttagcgatcagaccaggcttgatggctgcaaacttgccatcttcaatccgaacgtcaacggcatctttttggttatctacatgaacgttttgaatcagcatagattaagcgacctttcgattaaaaattagcattaagacatagtagatggcaccgctgatcagcatgaccaaaaacgttgccccgatcgtgttcttgagtgcagcaacgttatgcagcattaagaacagtgccgtaccgatgatccaggtaactacggctgaccagttgattccgtgcgagtaccagtagctgccgtttttcttggccagctgcgtgacgtcgtatttctggtggcagcgcagatagaagtcggtacagatgatggcgatgattggtcccagtaccatacctacataatccaagaaagcggtaaacgtgtcaaggaaactaccaacaatcattggaataaaggtaacgatggtggcgacgatggcaacgatccaaagcgagtacttcagcttaatgttggtgaagatgttggaaagtgccgagccggctgccagcaggttaacggcattggcggtcatcgaagtcaggatgataaccagcagcgcaacgacccccagccccagccgactggcaatcgtacttggatcggagttgttggcattataggcaccagaggtaatggcgatactgatggttgagatcaagccgataaaggcaaaccagattaccccgaccatggcaccgaaaaatggcgtcagcgtcgcattgtgcttctttggcgtgaaacgagtgaagtcagcccctgccgtaacccaggccagattgaaggccgctacatagtcgatggcggctccggtagccatttttgcgctggctgggacctgccattcaacgatatgcgagaatgggacggtctttaagacgactaccgattcccagatgacaaagatcaaaaccaggatgattcccaagcgctcaatcatctgaacggaacgcgagccgctggcgatactgatgatatgcaaaatgctcattaccacgatcccagccatgatgcctttccaaccgcctggcttaccccagactggccagccaagcaggtcgtttaaaagcagactgacggattgggccgcgataaacgtattgacggccgtccagccaataaactgcgtcaggttgaccaaagatggcagatagctgccgcgcaccccaaatgatgcccggctgacggccatggtcgagacaccggtctgatagccgatgtagccaatcagactcaagaagacgtaagaaagtgctgatgacagaaccagcacgttcatggcgactgaaaaaccgcaagctgccaaaaccccgccgacaaaccacgtgccgttattggcattggcaccaacccaggttgcaaacatatcccaggttgaggttttgcgttgatgcatcgcgatgctggtaatctgatcattgtcgttttgcatggtgttacccccaaagaaaaatcgtcactggccaagtgagaccagtgacgatgcaaataatgtcctccctaaaaaagggcgaagattttattttaacgaacatccttggaggcctcacgggaccagattaaaggttgaataataattgataaactaagtgtaaacaatattaatgttcgttgtcaatgcttattttccaatttgtaaatcattaacgtgcggtaaatctgcgacaaacttttcataagccgtttcttcaccagttgcgctggtttgagcatcggcaaagcttgcttgatgcagctcggcttcggcaaccgtaacatgatgcgtgaaggtggcattgccgaccagttcaatccagtagtgatcagcttggtggtgaacgatggtcttgaccatgccgccagggttgtagatggtcattggcacgtcgaaatgcgccagttcaggatgcgtcagcgcgaaggccaatgaggttgctgacatcccggtcccgcaggcattggtaaagccgacaccgcgttcaaacgtccgtacgaacagctcgttttcattcagaatctgggcaaagtttacgttgacgccatcagggaaatatgggttttgaccattcagtcgttcacctaagacgcctaaaacgttatcggacaattcagcggctgaaacaaaactgatcagatgtggattaggaaccgcgatgctggtaaaacgcagtccaggaataaactcgggaaccagcgtatcaagcagccgttcatggcccagattgtcaaacggcagtgcttctttgttaaagcggacgggtgagatctcaacggcaaaagcaggtacgcccggcgcaaaatcaggctggcgccgaacaagcaggttggcatcgcgcgtatcaacctggaactcgtcttgatcaaatttttcggccagatagcgggccacggtacgcagcccattgccgcacatggatgcttcgctgccatcggcgttgatgacacgcatttgcgccagggctccggctttagttggctgattgacaaccagaatgccatccgcgccgcctaaaaggccagtctggggattggtgattctaggagcaagtgtctgcagctcagcatcggtgagtggttgttccagcgttgtctgatccaggataaagaattggttttgcgatccatgaacctttagtagttccgtcataaaaatacctctttgtctgattaatttgcgaagaattgatgatagatgacctggacggctttatcggcatctgcccgcttggtccccagcatgattgagatctgagaggccccttggttgatcatctgcagcgagatgtgagcatcggctaatggctgcagaatgccggcagcagcgccaacgcgatcacgcattccttcaccgacgatcatggtaatggagtagtcgtcaatccattccagacgatcgggattgatcttattttgaatctcatcgcacaaaacgtcaatcaattgatcattcaaaaactttttgtcaaagataatcgaaatatcatcgatcccagatggcatgtgctcataaggaacgttgtgcttttccagaatatccagaatgcgtagggtgaagccggcttctttgtttaagagatacttgtgcagataaagtgctgaaaaatgcttgcctgaagcgacgccagtgatgatgttttctggtttgaagcccttttcgggaacgatcatggtaccaggcttttctggggcatgcgtgtttttgacgttgatgggaatctgcccttgaatagcaggaatcaaggcctcatcgtggaaaaccgaaaagccggcataggaaagctcacgcatctcacggtaggtcatcgtgcggatcggctcaggattgtcgactacgtttggattagcggagaagattgcatccacgtcggtaaagttttcatacagtcgcgcgtgaaagccccgggccaggatcgcgccggtaatgtcagagccgccccgtgagaacgttgcgatatgaccagaaggcgtgatgccaaaaaatcctggaaagaccagccgatcatagacctcatacttgaaaccggccagattacggtaggtttcaggattgacgatcgcatcgttgggagcaccggtaaccataatgccggcttcggttgggtcaacgaaccgtgccttgatgcccagatgattcataatcattgcgatgagtcgggcattgagccgttcaccgtgggccttgaaagcagccagcagatattcatcgtttggatagtctttcttaggcagattgactaacaattccttgatgatcttgattttttcatccggcagatcaaaaaagtgaccgatcgtttcgtagcgctcgaaaatttcttgaacggtcttggcggtatcttcgccattgatcgtttcattggcatagcggatcagaaggtcagtcaccttgatatcgccgtcgtgtcgtttaccaggagccgaaaccacaacgatttgacgagctggatcagccgtgatgatgttcaatgcctgtttaacggcggcacccgtagccaatgaagtgccaccgaactttacaactttcatatttacagactcctttgtgcgttgaaaataataaagaacgcaaattaaatttaataggattctaacatttattggcgtccttgcaagtctgcttttttgaaatcagatagcataaacgttttacaaatcatagtagaaaaaataaatgagaaaaattattagaattgccttgacgattatgaaacttaattatagacttactagtaaatcgaagaggcgcaatcaacattagtaccgtatgttagtcacagaccagacaatgatcgtacgggaaagggacgattgccgaagctttcagactgggtcgcggcctgattgctggggcgtggctgaacaagtcacggactgtcgcggagaaaaacttcgcggagcgctatcgaccaatcagattaaatttgacaacagccgcagtgggtggctttttgaaaatggaatccgttgtttgtgcgcgcacgaacaatggattttttcttagcgttttccccgtcagaacaacggaggttttagattatgaattctcagattgcaccggatcagatcaacgcagcaggtcatttgacgattggcggcgttgactcgctcgaactagccaaggaatacggcacgccgctggtagtctacgacgtggcccagattcgccgccagattcgtgcttttaaaaaggtgtttgagcaacgccaggttgactacgcggtcagctatgccagcaaggcgtttgccgcgattgccatgtatcaggttgtagctcatgaaggcggtcatgtcgatgtggtttcagccggtgagctctatacggcaatcaaagccgacttcccaatggaaaacgtatcttttcatggcaacaacaaatcgcgggccgaattagagatggccgttgatcaccatgtgggcatgatcgtgatcgacaacttccatgaaattgagctgcttaatgaagtactggccagtcgtgatcagtcaatcgacgttatgatgcggatcacgccggggatttccgcacatacgaataagtatattcaaactggtcaggttgacagcaaatttggctttgatttgcagtccggtcaggctgatgaagccctgcaaaagattctggccagtccacggatgcatatgaagggactgcatgctcacatcggctcgcagatttttgaattaaatggctttcagatggcggctgctaaattggttgagattgcagctcgctggcgcgacaagtttggctatgagccagaaatcgtcaatgtcggtggcggcttcgggattcgctatgtcagtgctgatcatccattgaaaccggaagattttgtagcagcaatcatcgaaactattaaggaagaaacgcaaaagctgaatctgaagatgcccgcggtttggatcgaaccaggccgctcaatcgctggcccggccggctataatctttacacggtcggttcgcgtaaagacgttcccggcttgctgccatatgtcatgatcgatggcgggatgggcgacaacattcggccagcgctttatgaggcggaatacgaaacggtgctggctgccgatccgcaggcggaaaacgctgaaacggtacggctggccggtaagtactgtgaatcaggcgatattctcagtcaacatcagccattgccaaaaaccaagccaggcgatgttttggcaatgctggatacgggagcctatggatatgcgatggcttctaattataaccgtaatccgcggccggcagtggtctttgctgaaaatggtcaggctcacctggtaattgaacgcgaatcgcttgacgatctggttcatcttgaccgttcctacccacaagcctaaatcacttttaaaataagatattaacaatatagtagaaaaaagattggagttaatctaaatggcacaattagacgcacaaagcattatcaactacatcggcaacgctcctaaaaagacgcccgtaaaggtatttgtcaagggtaatctgtcagctttaaacgttccggaatcaattcaaagctttttagaagcccgtaccggcgttttgtttggcgactgggccgacgttaagccattcttgactgccaatgctgcgcagattgaagactatcgcgtggaaaacgatgcccgcaattcagccgtgccgctgctggatctgaagggaatcaacgcgcggatcgaacctggtgccttgattcgggatcaggttttgattggcgacaatgccgttatcatgatgggggcaatcatcaacattggtgcagaagtcggtgccgactccatgattgacatgggcgcggtgctgggcggccgggcaatcgtcggcaagcattgtcacgtcggcgcgggcgcggttttagccggcgtgatcgaaccagcctcagctgaaccggtccgaatcgatgacaacgttttgattggtgccaatgccgtagtaattgaaggcgtgcatgttggcgaaggcgccgtgattgctgccggtgccgtcgtaacccaagacgttgctcctcacacggtcgtcgccggcgtgcctgctaagtttatcaagaacgttgatgacaagaccgaatcaaagacgggcctggaagaagacttgcggaagctgtgatgatcgatgacagaattaaatgaagcacaattaatcaagattcgccgcgatctgcatcagattccagaactggcgctgcaggaaaaacagacgcatgactacctattaaatacaatcagcgggtttaaccagactcatctggaaattcgccaaccggaaaaattgccaactgcattgatggtgttggtacacggtagtcagccaactagaatgatcggctatcgaaccgatatcgacgcgctgccggtagcagaacagaccgacttgccgtttgcttccaagcatcccggcgtcatgcatgcctgtggccacgatatccacatgacggttgcgctgggggttttaagctggttcagtgagcatcagccaaaagacaatctgctgtttttcttccaaccggccgaagaaagcgaaaacggcggcaagctggcctatgagcagggactgtttgatggcaagtggcgaccagatgagttctacggtctgcacgataatccggacctgccggctggcgcgattggctgtcgcatgggcacgctgtttgccggtacgactgaagtcaacattgatattaccggtaagggcggtcacgcggcctttccgcaggatgccaatgatacggtcgtggcgatggcgtctttgatcatgcaggttcagacgatcatttcacgcagcattgatccgattcaaagcggcgtgatcacgttgggtaaggttgaagccggcacgatccgcaacgtgattgccggtcatgcccatctggaaggcacgattcgcggtctgacgcaggaaatgattttgaagatcgatcagcgtttaaaagacgtctgcgaaggaattgccaaaagctttaacgttaaagttgacctgcagctgaatcaaggtggctactggcccgttgaaaacaatcccgaactgaccaaacgctttattgaatatatgaaacaggctgctggcgttgaatttatcgaaactgcgccggcaatgaccggtgaagactttggctatctgctggccaagttccccggcaccatgttttggctaggcgtggaagatgactcacagttgcattcggcgaccttaaaaccggatgaacgcgctattaaacggggcgtggatgctattaccggatttttgaactatcgtatgcaaaactagggggatttaactatgaatttacaagatgctgatttgttaactgccatcgtaacaccatttaatgaacaaaatgaattggactttgcaagtttggccaagctgaccaactatttgatcgaacagggcagcaatggttttgtcattggtggtacgaccggtgagacgccaacgctcagccatgacgaaaagctggtgctgtatcgtgagtttgctaagatcattgatggccgcgttccggtaattgccggcactggcagcaacaatactgccgaaacgattgcctttaccaatgaggtggctgagatcgaaggcattgactatgcgctggtcgtggtaccgccatacaacaagcctaatcagcgtggcatgattgcccactttacggcggtagcagatcagtccaagttgccaatcgtgatctataacattcctggccgaaccggcgttaagatggctggcgaaacgatcgtggagctttcacatcatgaaaacatcaaggccgttaagcaatgtgcctcgctggaagagatgcagtacgtgatcgatcacaaggacgaggatttccaagtctttaccggcgaagacgctcaagcattgacggcgcgcgtcttaggagctaatggcgtgatctcggttgcttcgcataattactgtgcccagatgcgggaaatgtatgatcaattgtataatggtaattggcaggcggccgcacgtctgcagcgctggctgacgccaagaatggccgcgctgttcatgtacccatcaccatcaccagtcaaggcggtcttaaacgcgcaaggctttggcgtgggtggctgccgtctgccgattgctactctgaacgacaacgaaaagcagcagctggcacaggcgctgtcattgcctgccgatgcgctggctcatgagttgccattgaatcttggaaagggtgatgttgatgactagtgtactgatcgccgggtttgctggtgcaatgggacaaaaggccgttgatctggtcaatggcatggcggattttcaaatcgttgccgctttttcgccacaagccgaccgtaacgatccggaacgctataacttaaatgacgatgtccagatctttaatgatttagcagcgattcccgatcaagcagctgatgtctggatcgactttactgttcccagtgcggtttatgaaaacgtcaaattcgcgctgaatcacgggatgcgccccgtggttggcacgactggtctgactgatgaacaggaagccgaactcaaggcccttgccaaagccaatcatttaggtggcctgatcgcgcctaactttggcatgtcggcggtcttgctgatgaagttcgcccaggaagccgccaagtatttcccagacgtcgaggttattgaaatgcaccatgccgataagaaagacgcaccatcaggaacggcattgagtacggctaagatgatggcacaaaatcgtcagccgcacgaaagcaatccagatgaggtcgaaacgctggccaacgtccgcggtggcgactatcaaggcattcgcattcactcagtccgtctgccgggctacattgcccatgagcaggtgctgtttggcggcactggcgaggcattgaccattcgccaggattcatttgatcggggctcgtttatgagcggcgttaaggtagccttgcaaaaggttgcgtcgctgaatgaactggttgtcggtttggaaaatattctttgatgtaaaggggaaatttgtttatgccaactctagcaaaagatcttaatgaaacggtcaacccacgcgtggccgcaatctcaccatctggaattcgttcttttgatgcgcacgtctctaagattccaggcatcgttaaactgacgattggcgaacctgatcttaacgttcctgaacacgttaagcaggcagccgtgcaaagtattgttgaaaatgattcgcactatacctccaaccgcggcaagattgaattgcgaaaagccatcagcggctatctggaccggacgcgcggcgtgcactatgacccagaaaccgaaatcgttgctacggttggtgcaaccgaggccctggcagcgacgatcttttctctgatcaatgaaggcgacaaggtgatcattccaacgccggccttctcgctgtacttcccgctggtttctctggcaggtgggacgccggtgcaggttgacgtttctgaggacgattttgtcttgacgcctgagctgctggaaaacgttttgaaaaaagaaggcccagcagttaaggccgttttgctgaactacccagtcaacccaaccggccgtgaatatccacgcgaagtgctggaaggcctggctaaggttattgccgatcatcatctgtacgtatttgctgatgaaatctacagtgatctggtttatggtgtggaacacacgtcaatggctacgcttttgccggaccggaccatctttatctctggcctgtccaagtcgcatgccatgactggttatcgaatgggatattttgctggtcctaaagaagcaatcgacaacatcaccaagcttcattcattcttggtaacctcaattaccgactcaacacaggcagcagccattgaagcctacaccaatggggatgaggatccggttaaggcacgggccatctaccaaaaacggcgtgactatgttttgaagtctttaaacgacatgggcatcgaaacggttccaccacaaggcgcgttctacatcttcgccaagattccagccagctatggtacggatgacatgcagtttgccttggatctggccaaggaagcccaggtcggcgttacgccaggtaatgcctttggtgctggtggtgccggctgggtacggctgtcatacgcggcttctgatgaggacctgcatactgccatggagcgcatgaagccatttattgaaaaggttaacgcaaagaactaaaggagcgattatattatgagtaagcaatacaatgtcgcaattctgggtgccacgggggcggtcggcacgcggatgattgaacaattagcccagtctacgattcccgttaagcatgttaagcttttggcatccaaaaaatcggccggtaagacgctgcagtttaagggtcagccggtaaccgttgaggaaacgacccctgaatcctttgacggtgttgacattgtattgtcgtctgctggcggatcggtttccaagaagtttctgccagaagccgttaagcgcggggcagtctgtgttgacaataccagcgcctttcggatggagccggatgtgccgttggtcgtaccagaagtcaacgaagccgctctgaaggatcatcatggcatcgtggccaatcccaactgttcgacgattcaaatggtaatggctttggaaccagttcgccgcaactttggcttaaagcagatcgtggtttccacttatcaggctgcttcgggtgctggtcaatccgctttaaacgaaatgtatcaagaagcccaagactttttggatggcaaggacatgcaggcggatgctcatattctgccaaccaagggcgacaagaagcattatccactggcctttaacctgttgccgcaaattgacgttttggaggaatcaggctactcgcatgaagaatggaagatgattcatgaaaccaagaagatcatgcttggcgacatgaattcacaagacattaaggttacggctacctgtgtccgcgtaccggtgccaatcgcgcatggcgaaagcgtctactttacggttgaggatgaatcggctacggctcaagatattatgcgcgtagtggctgacttccctggcaacgttttggaagacgatattgctcatcagatctacccacagccaatcaatgcagtcggcaagcgggagacgtttgttggccggattcgtcctgattatgaaaacaagggtgccttcaacatgtgggtcgttgctgacaatctgttgaagggcgctgcctggaatacggttgaaaatgccgagcgtctggtagcactgggtctggtctaagcgatgtcttgaaactagaatcaacttaaactgaaaatccgtctggctgattgcgggacggattttttgttatactggaaatataatttggaaccaggaaggaagatttatttatggatgccaaccatctttcattacgattggcgcgtgttgccagctatgtacctaaaggagcccgcatggccgatattggctcggatcatgcctatctgccggcacacctggcattaaacggacagattgagtatgccgttgctggggaggttgtcaaaggaccttttaaaaacgccgcgcatgagatcaagcagctgcagcttgacaacgtgattcagccgcggcttgccgatggactggcggcaattcaagctgatgatcgcattgatacgattacgattgctgggatgggcggaaccttgattgccaagattctggctgccgacacgcaaaaacttgccaaagtcaagcgcttgatcctgcagcccaacgttggtggtgagcgcgtcagagaatggctcttggctaatcaatggcagatcatggctgaagaagtgcttgaagaagatgaccatatttatgagatcatcgtggctgagccttcgatcgtgccatttacctataacgaccgtgagcttaagtttggtcctttcttattggaacaggatcagcctgcttttcgaaaagaatggctggctgagcttgagcgagagcaggttgccattgaacagatgaaaaaagcggcccagccaccagttgccaagatcaaggagtttgaacgcgagatgcagatgattaaagaggtgatcaaatgacgactggaaacgacattattcaacggtttgaaatgtttgccaatccggctttggctgaatcatgggatcatgtcggcctgcagctgggtaatcccgaacgaccggtcaaacgggtcatgacagcgttggactgccgcccagaagtcgttcaagaagcaattgaaaaaaacgttgactttatcttcaatcaccatccagccatgtttcatgccgttaagaccctggatgtgcgcgacccgcagattgccatgtatcaaacgcttttggagcatggcattacggtttatgcggcacataccaaccttgacaatgccaatggcgggatgaacgattggctggcggcccaattagagctgaccaacgttgagccgttgcagattacggggattgatccgatctcgggacgcgactatggaatgggacggctgggcgacttattgcagccaatgagtccaacggcgtttggtcaatggtgtctggaaaagtttcagcttaatggggcccgtttgatcgttaatccagccgatcaaaagcagctgatcaagcgagtggcgattttgggcggctccggacaggatttttggcagctggcgaaaaagcgcggggctgatgcgtatgtaactggagatgtgagctatcactttgctcatgacatgattgccagccatttaacggtggttgatgccggtcatcatatcgaagccgtctgtcaggatcagctggccagtctgcttaaaaaatggcgccaggaaaacgactgggattttgagatcataacctctgagatcaatacggagccgtttaagtttatcgtcaaataggctgactttgcctgctctgtttattgaaaaagtgataaagttgacgtattggtagtaatgactaattcataaagaaaaggtgatcgatttgactgaagaaaaatatcctgaactgctgccgcgttttttgaaatacgttcaggttgagacgcgctcggatccgcaatcagccacggtgccttccagtcctaaagaaacggcctttttaaaacagctggcgcaagagctgcaagacctgggactgagcaacgtgcgcattcatccgcaaaactcatatctgttggcaacgatccctagcaatcttgatcatgatgtgccggttgttggcttgattgcccatattgatacggcggactttaatgccgaccatgtccggccgcaggtgattgacgattatgatggccaatctgacattgccttgtcggacagcggctaccagctttctccggctgagttcccatcattgaaaaaatatgcgcatcagacgctgattacgacggatggccacacgcttttaggcgctgatgacaaatcaggcgtggctgagatcgtaacgatggcatcatatctgctgaagcatcctgaaatcaagcatggcacgattcagatcggtctggggccggatgaggagattggtactggtgccgatcattttgacgttaaggattttggtgcggactttgcctatacggttgatggcgggcctctgggtgaattggaatacgaaacctttaatgctgcccaagccgagattacgattactggtaaggacgttcacactggggttgccaaagggacgatggtcaatgctattcaagtcggcattgatctgcacgaccgcctgccagaacacgatcgcgctgagaaaacgtccggtcgcgaaggcttttaccatctttataaatttaacggcggcgttgatcatgccgaaatgacctatctgattcgggatcatgatcggcaaaaattcgaagagcgcaagcagaatcttacgcagatcgtttcacagctaaacgaacagctgggtgaagagcggattcaaatgaagctttacgatcaatactataatttaaaagacgcgctcaaagaccacatggaagtcgttgcaattgccaagcaggcgatggagaatctggatattcagccagtgatctatccagtgcggggcggtacggatggttccacgatctcgtatctggggctgccaacgcccaacctgtttgcaggcggcgagaacatgcactcgcgctttgagtacgtttctttgcagaccatggaaaaagccctggacgttttgctggagatcgttaaactgacggcccagtcgtcgattaaatagctttgccgtttaaagagtatatagtataaaatccctgccgcagctgagtggtagggatttttaagttgaaatgtttgaaaacgctgtaatgattgattagttggtgatatgcttaaaaaaacggcttgaaattggaaaggatgatgagtcatgcaaaccgttacgatcaatcagcgcgtgctggcggcagtcggtctgggcacctggcacatgggagatgatcctgctaagcgtacgatggagattcaagcgctgcaggcaggcattaaagccggtgcgcaggtcatcgatacggccgagatgtatggcaatggcagggccgagcgtctggttgccgaagccatcaagccgtttgatcggcaagacctgtttatcattgacaaggtcttgccacagcacgcgagccacgcgcagctggagcagagtctggatcgcagtctaagaaacgttggcacggattattttgatttatatcttttgcattggcgcggacaggtcccattggctgaaaccgtggccgaactggagcgggtcaagcaggctggcaagattcgagcctggggcgtctctaattttgacgtggctgatctaaaagaactgtatgccctgccaaacggcgataactgcgcggcgaacgaagatctttataatcttgatcggcgggggattgaatatgatctgctggcctggcaaaaagatcaaggactgccgttgattgcctattcgccggttgcacaaggcgatactttgagtggtcggctgactgctgatccaacgctgcgaaaactggctgctcggcatcaggccacggtttatcagatcatgctggcctggaccattcgctgcggcaatacgctgacgattcctcagaccggcaaccctgagcatgcccggcagaacgtagcggctggcgagctggaatttagtgacgcggagttgttggagctggaacaagccttcccatcaccgcgccaaaaacagccgctggccacgatttagtcactgcaatcggaagcagctcaagaaaagtttagctgactttatactttgaaaatgatgtaaaaggcgtcgcgtcactaattaaaacgtgttactatggttttaaggatggagcggttgaatgaaatcgctccttttattattgggggagtagttaatgaaacaaaaaatactaaagctgctgctgatgccgctgctggcactgggaatcggcattcagacgccactaatgccgactggatcgcatccggtgcagtcaacagtcgttaaggcagccaaaaaacatcagtcgcagcgcgtaaaaaagcaggccgctgcgtcttccagccagtctgatgagcagctggctcagcttaactatcaaggaacgcagaccatcagcgtcaataatggtcagccggattttaccagtgaggatctggataccagtcatggcgcctggcagcaatacggcaatctggatcgcttaaatcgcgcaacgcaagccaacgcgctgctgaatcgttctttgatgcccaaagccaagcgcgagccgttaaacgtcacgcccactggctggcacaacaaaaagatcaagggcggctatctgtataaccgctcgcatctgatcggctatcagctgacgggtcaaaacaacaactggaaaaatctgattactggaacgcgctcgctcaatgatcctgagatggttcgctatgaagatgaggttgccgactatctgcggacgcatcctaacgactatgtccgctatcaggtgacgccgatttttcggggcgatgagctgctggcgcggggcgtgcacatgcaggctcagtcagtcaacagtcaggccatcaaattcaacgtctatatctttaacgtgcaggatggcgtaacgctcaactatgctgatgggaccagtacggttgacaatagtgcccagaacgtcagctcaacgccggccgtttctaaaaccgcaaacagtcaagcacccagccaaggcaataatgaccagaccaccgtctatgtcacgcctaatggcaccaaatatcatctgaaccgcaactgccgcgccctggcccgttccaaaaccgttgattcaatgacgcagggacaggcaattgctgatggctatacgctttgcggctttgagcgctaagcagaaaacaaaaagagcactgaagactttcagtgctctttttataattgctgagtaaaattatttagcagccttttctgggttagcctgctttgaaatcaggaaaatgcagttggttgccaataatgctacaacaacggcaacaataccagtagttacgtaattaaccgtgcagctttccagttgaccggcgatgtagcccaaaacgtcacccagaataaagctccagataatgatcataatttctttgccaattgtacgcattttagttcaccccttagttggatacaaaactattctaacataaaaaatctgacttgagtattgataatctaaggcattattaagcaactgactcaggggccaaactgcctggcaagaaaagaaaaagctttcccaggtcggttgattgattcatggttccaggactgactgagcctgcggaattcagatcagatttggcggaacgcttttaagccgaataaattcataaaatggcgctttgaatgtgaaaatgatgttataattccaataattttctaattaagggaggaagaaactatgtcagcatcgctcggtgactcgcagctgctgttagagactatcgatggtcaacagctgttcgttcgccaaaacctacccgtggcgccggctgccgtattggttatcgttcatggtctgggagggcatcaaggtcgttatgactatatgaccaattatttcgttcgtcaccatgttgccgtctatcgctatgatcatcgtggtcacggtcagacacctgggccgcatggcgtttatggcgatttcaatcattttcctgatgatcttaaaaccgtcgttgactgggccaagaaaaacacgcctcatctgccgatctttgtggttggacacagtctgggcggcggtacggcgatggcatttggcgccaaatatccccagacggtcaatggcattatttcggtaggagccttgacgcgctatcaccatcaggtttttggtccggttcgtcattttggcgatgatgaaacgatcagtggtagctttggtgatcgcagcaacagcagtgcctggatgcggcaagactatcaagacgatccattgaacctgactgagattaaaggctcgctgccgaatgcggcgatggatctggtgacttttaatcgaacacatgcggccgattttgtcgatccggtcttgattctgcatggtgccgaagatggcgttgtcagcgtcacggattcaatggacagctaccgtgagatttcgtcgcgcgacaaagagcttcacatctatccatttttaagacatcaggtattaaatgagccatcgcggcggctggcagtttatcaagaaattttggactggatgaaaaaacatggctaaatcaatgaaaagtcagctgattgggtacacaccagtcaactggctttttattaatgctgcagcgcgcttttcggcattggcttctgctataatttttaaggaaaggatggatgccaaatggaaattgtgccgctcaacgtgatcagcacatacagtctcttgcagagtccgctgcgcccgactgaattggttcgaggagccaaaagcaggggctatcgggcggttgccttggctgactggaacgtgatgtatggggcaattgatttttataatgctgccaaagcggcgggcattaagcctttgctggggttgcggctgcatttgaaaaccatggtaatgaccacgcagggcttggaagttttgtttttggcccgtacgcaggctggctacgttaacctgatgcagctgtcgaccttaaagcagacgcaagcacagggacgttttttgacgcagcaggagatcgagccgtttttaacggacctggatctgattttgcctgctcagccgctgacgcttgatcaaacgatgattgaccaatggctgccggcactgattgagaagacggcagggcattgctggctgggggttgatctggagcttgatgccattcagcgcgaacagatcaaacaaacggcgcgacaatatgccgtttcactggtagcagcccctaaaatcgagtatctggaaaatgatgatgcctttgcgaccgatgttttaagacatattgatgagggtgccaaaatgaccaacccgtttttccaggctcagaatacgatcagtcacgccttgccaaccagagaacagctgcagcaggcctttttggattctgaatttgaaggtgcggctgctcaaacagcgatcatcgcgcaggaatgcaatgttgagatcaagtttcaaatgcctatcctgcctaagtttcctacgccaaaccagcaaagcgcggccgattatctaaagcagctttgtttggcaggtctgaaaaagcgtccattggcagctggctattcgccaaccgattatgagaagcgcctgcagcgtgaactgaccacgattcatgaaatgggctttgatgattattttctgattgtctgggacgttatgcgctttgcccaccaaaaaaagctggcgactgatccagggcgtgggtcggcagctggctcgctagtggcctacgtgctggagattactgaagtcgatcccctaaaataccagctgcttttcgaacggttcttaaatccagaacgagctcagatgccggatatcgacttggacctgccagataatcggcgtgatgaggttttgcaatacgttcatcaaaaatatggtcatgccagagttgctcagatcattacctttgggacgttcggtgctaagcaggccgtcagagacgtgggccgcgttttcggtatgccggtctatgccatcgacgaactagccagagcgattcccaacctgcctaagattacgctgcagcaggcattgaacgaatcacgggctcttaataatctgctcagtgattctgcgcagaacgcacttttgatgaagacggcactccgtattgagggactgcccagacactactcgacgcatgcggctggagtcgtcttgtcgcaagcaccattgaatcagctggttccgctgcaaaacggcagtgatggccttttaatgacgcagtttcctaaagacacggttgaggcactgggacttttgaagatggatttcttgggcctgcgcaatctgtcaatcatggattcagccctgcagctgattgaaaaaagccagcctgactttgacctgcatcagatcaatctcaacgatccgctgactttaaagctgtttcaaaaaggagcgacgggagggatctttcagtttgagtcaagcgggattcgtcaggtcttgattcggctgcatccagaaaactttgagatgattgtagcggtcaatgccttatatcggcccggtccaatggataacattgcccattttattgcacggaaagaagggcgtgaaaaggtcactttgcctgatccttcattggcatcgattctggcaccgacttatggcattctagtttatcaagaacaggtaatgcagctggctgctaaaatggcaggcttcactttaggacaggccgatctgctgcgccgtgccatgagtaagaaaaaagccgacgtgatggaacggatgcagggacgctttattaacggggcagttgccaatggttattccaggccggttgctgaacaggtttttgaatatattgatcggtttgccaattacggtttcaaccgttcacatgccgtggcctactcaatgatggcttttgaaatggcctatcttaaatgtcactttgcgccggctttttttgccgcgcttttgaatgctcacgcgggatcagaaaagatgcggacctattttgaggatgccaaatcatttggcgttgtcattgccggccccagcatcaactttagtcaggctgattttagtctgtaccaaggacgcgtcttgtttggtctgtccatgatcaagggcgtgcgtcgtgatctgatcagcgagattctcctaaaaagaaaggatggtcagtttgccagcctggctgattttatcggccgcattgacgtcagatttagaaagcctgagctaattgcaccgctgatctatgccggtgcgtttgatcgtttgggcagcaatcgtgctgaaatgattgatgctttggctgatttaattgaaggtgccgagttcaaccaggcgcttttaggcagcgacacctttcaaacgatgattccggctcgtcctgagtatccgttggcccagcgattggaaaaagagcatgagtatctgggcgtgtatctgtcaggacacccggtcagtcaatatcgatcgttggctggtcagctgcacgcggttacggtcgcccagctaaaagaagggatgaacgcgaccttgattctctacgtcagccgcgttaaaacgatcaataccaaaaaaacgcgtcagccgatggcattcgtcagcgcctcagatgaaacgggcagcattgaggtaacggtttttcccaaacagtttcagcgttaccaggaactgatcgctgcacgtaatgttttgattatcagcggccgggtagaaaatcgtaacggcagtctgcagctgttggccagtcgcattcagctggcctctgctgctggtgagcgcgggtcggcgccagccaagacccgctggtttctacagctgcgaaagggtgtgctgacgccgcgcttgaccgctcagctgcaggaatttatcagcagtcaccatggcaacgtgccggtgatggtctactatcccgaaacgcggcagacgcgtttgcttccgcgcagtcagtggctcagtggggatgaggcgactaaaaaagggctgattgatcttttgggagtcagcaacgtggtctatcaatccacgctgtaaaacaatttgtcgccagcgtcaaaaataattatagtgttagcgttttcttgatgtaattagtaaagacaacgaatttaaaaagtgctatgataagtgttgtgcaaatgaggtgcgcaatggcgcagtttctgcattaatgcaaaggagagatgtcacttatgaagaaaaccaagattgtaagtacccttggtcctgcaagtactgatgttgacacgattgtaaagctgatcaatgctggtgccaacattttccgtttcaacttctcacacggtgatcacccagaacacctgggccggatgaacaatgttaagaaggctcaagaaatcaccggtaagcacgttggtctgatgttggacactaagggtgctgaaattcgtactactgttgaaaaagacggtaagatcgaattcaatgctggtgacaaggttcgtatctcaatggacgactctattgaaggtacgcacgaaaagattgctgttacctacccaggtctgtacgacgatgttcacgttggcggccatgttctgtttgatgacggtctgatcgacatgatcatcgacgaaaaggacgaagccaaccatgaactggtctgcacagttcaaaaccatggtctgttgggttcacgcaagggtgtcaacgcacctggcgtttccatcaacctgccaggtatcacggaaaaggactccagcgacattcgctttggtctggaacaaggtatcaactacattgccgcttccttcgttcgtaagccagaagatatcgaagacattcgtgcactgctgaaggaaaagaacatggaagacgttcaaatcttccctaagatcgaatctcaagaaggtatcgacaactttgaagcaatcatggaagttgctgatggtctgatggttccacgtggtgacatgggtgttgaaatcccagctgaaaacgtgccattggtacaaaagaagatgattcgtcgctgcaacgaaatgggcaagccagttatcacggctacccaaatgctggactccatggaagaaaacccacgtccaacgcgtgccgaagtttctgacgttgccaacgctgtctttgatggtactgacgcaacgatgctgtctggtgaaagtgccaacggtgactggccagtagaagctgtttctacgatggcgcgcatcgacgttaaggctgaaaacaacctggacctgtttggtacggaaacgttcaactttgacaagagcgacgttacggaaacgattggttctgcagttgcccaagctgctaaggaccttgacatcaaggttatcgtagccgctacttcttcaggctacacggcccgcatgatctccaagtaccgtccaaacgccgacattctggctttgacgtttgatgaacggactgaacgcggtctgatgatcaactggggtgttcaaccatacgttgttgacaagccagctgacactgatgaaatgtttgctctggctgctaagaaggcagttgaacttggttttgccaagtcgggcgacaagattctcgtagttgccggtgttcctatgggtacgccaggtgcaaccaacctgatgcgggttgaaacgatcaagtaatcttgattatttcatcctcaaaaaccgtctgtcatttgacagacggtttttttactcctttgcttttattttgtcctgatattatgtaaaataagctagatacccaactgagaaaattaaggatgataaaatgataaattcagcacttggcaaagtcgtcgatgccgtaatgatcgacgaaaacgaccatgattatttcgtacagccagcccgcaacggccaaacctatcgcctgccaaaggatgaaagcccccaggttctgcatattggcggttccgttcgcggctttgtctatgaaaatgaaaaccaccagctgcagatgacctgccagcatattccaacgattcaagtcgatcattatgactttggaacggttgtcggtgttcgccgcgacttaggcgtttttgtcgatattggtctgcccaataaagatatcgtcgtgtcactggatgatctgccaagtctcaagcatctatggccgcaaaaaggcgaccgcttgatgatggcgcttaaggttgacgaaaaaaatcgaatctggggccagctggcagatgaaggcgttttcgaagccattgccaaccgtccggatcctcggatgaaaaacaaggacgttaaggcaacggtctaccgcttgaagatggcggggacgtttgctattaccgatgactattgcctgggctttattcacccaagcgagcgggatcaagaaccgcggctgggtcagcaggtctcggcacgagtaatcggtctatccagtcatggcagtcttaacctttcactaaagccgcgtgcctaccaggcaattggcgaagatgcccagatgcttttggaaatgctgcgccggacgccagaccacacgctgccatttaccgacaagagcgatcctgaggcaattcgtcaagagtttggcatcagcaagggccagttcaagcgtgcggtcggccatcttttgaaagctcggctggtcagcatggtcaatggcaagctgatattaatcaaggatccagatgatgaataatgaataaagcaccgctgcagcaagctgctgctgaatatatcgaacagctgcgtattgaacggcgactggcccaaaacaccattgccagctatcagcgtgatcttcaggatgccatccgctatctgcgagataagcatgcagattggcaggaagttgatcaaaccgcgattttggcttttttggatcaactaaaaaaacaaggcgtggctcaagaaactattaatcgtcatatcgttagtctgcgtcagctttataagtttttacgtcagacgggtcaggtcgacagtaatccgttggcacagctgacgactgcggcagctccggctaagccaacgccggttttatctgctgctcaggctgccagtcttttaagcatccccaatgtcaaaaatcggacgggactgcgtgatcgggcaatctttgagctattgtacgcaaccggaatgcgcgtcaatgagctgctgagtttaaaaatggctgacattgatcttaatgctcagctggtcatgccgcatgatcgcgctggacgcaggcgagtcgtgccaatcagtgatacctgcggcaattggctgaagcgttatgtaagcgaggcacggctggaattgatacgtgatgataccgatgtcttctttttgaataatcgtggccgagcattgacgcggcaggcaatctggcaaaaactgcgggcggctggtagtcaggcggggattgacttagacgtgacgccagatgtcttgcgggctacgtttgcccatgagatgctggccaatggtgccgacctaagagccgtacgagtgatgcttggtcatcagtcgctaaatacaacggaacgctatgcaccagctgccgatgttcatttggctgcccaataccgtcagtatcatccgcgatcagctgacaaggaggaatagatgatgctggtaccgtatcgtaaagattatcgtaaaatcattctgggtattctgtcatttattccaggattgcatgactatgaccgcgtggctgaagaagtcgactggtcgttaggcgttggtaatccaatctatctatggcaaaatgatgagaatggcgattttagcggcgcggcgattgttgaattagggccagagtatgtcttgattcggcggatttcttttctgccaagtgcgcgttctggcaaaaacgtttatgcttttttgacggccctgcatcagaaatatgccaatcgtcgcttgatgggaaccatggcaacgcagcctttgattacgaactgggagaagatgcatgaaaaacaatgaaaatcagctgccgcagcatccttatcagcccaacatcaaactggctgactttgaaggcccgctggatctgctgctgcacttgattcggcagtcagagatggatatttatgatattccgattgctgagatcacaggccaatacatgcagtatctgcggcagatgcagcgccatcagctggaagttgcaggggaatatttcgttatggcggcaactttgatggccatcaagagtcagatgcttttgcccaaaccaccagtgtcagaagatgaggagccgattgaagaggatccgcgtgaggaactggttgagcagctgctggagtatcagcgctataagcaggcagcagaaaagcttaaggataaagaggcctttcgtcaaaaagagtttacgcgcacggcaatggcggtcccgtcagaattcatccatccgcatacggcgccaggaactacgattgaacagcttaaggaagcctttgagcaggttctaaaaaaacatcagtcgcttgaaccagaaacggctaccgttgcaccggaaaaaaccaccgttgagcaacgaattcgctttgtcatgcagcgtgtcagccagggggcagttgcttttgaagagctgtttgccgacttaaagacgcgtgataatctggtaacgacttttctggcagtcttggaactggccaagcatcgtcgcatcgtcttgcatcaggcagcgcgttttgctccattgattctgacgccaggaaaactaagtgaggaagattaagcttgaatccattagctgaaattgaagggctgctgtttatcagtggcgatgaaggaatctcactgggcgatctggccaaggtaacgggatatctaaaacccgcgattttggaaatgatcgctcagctcaaagaaaaatatcaacaagacgaaaactgtgccttgacgcttttggacagcgactcggtttatcgtttggcaaccaaggcccagcttgcagacgtcatgcagcattattttgaggaaccgctgacgacgccattgacgcagacgctgttagaggtcctggccattgttgcctataagcagccattgacgcggcttgagattgacgagatccgtggcgtgcagagctctggttcgctgcagaaacttacggctcgcggcttggttgagacgcatggtcggctggcagttccgggacgaccgtttttatacgttacgacgccggcctttttggactactttgggctgacgactttagacgagttgccagaacttgataagaatctacagccagaagatctagatggcgatatctttttaagagctctgcagtcacgacaaatgagaaaggaatcgttagaaaatgaagatggaaagactccaaaaagcaatggctgaagctggagtagccagtcggcgggcttcggaaaaactgatcgtcgaaggtcacgtcaaggtcaacggcaagctggtcactgaactgggcaccaaggtcagctccagtgatcaggtaacggttgatggggtaccgttggagcgcgagcagccggaatattatctgcttaacaagccccgcggcgtaatcacgtcggcccatgatgagcacggccgcaagacggtggtcgatatcttaaaagaaggtggcgtaactgcacgcatctatccggttggccgcttggactatgatacgaccggtgttttgcttttaaccaatgatggtgccttggcaaacaagctgatgcatcccagcttcgagattgagaaaacgtacgttgccaaggtcaagggcttgatttccaaccacgatctggaacagctgcgtcatggcgttgtgattgacggtaaaaagaccaaggaagccaagcccaagcttttgagcgttgacaagcagcatcgcgtctcaatcgtgcgcttgacgattcatgaaggtcgttatcatcaagtcaaaaagatgttcaaggcagttggtcatccagttgaaaaacttacgcgagaaagcgatggcattctaaatcttaaggggctgcctggcggtcagtggcgtgagctgaagatggatgagatcaatgccttaaaaaaactgtaaacttttgattgaagacgcagaatgattatgctatagtttagtcgatcatgaaattaatttaatcataggtttatcttcaaggcagggtgcgattcccgaccggcggtaaaagcccgcaacccgatgacgtccttcgttatcggtggaacctggcgcaattccaggtgccgacagtatagtctggtatatagaagattttcgctcaaacgaaagtagtgtttgccgcagatgaaccgttttcatctgcggatttttttgttgggcgatcagccccggagatgaccttcaattattaggaggttttaatcatgacagtttctagcattcgtattcagcgcctggccgggattgcctgcttgagtgcattggcatttgttttgatgatgctggagtttccaattattccagttgccgcatacttaaagctggacttttctgacgtgccggtattattgggaacgctgatctatggaccggtcagcggcatcattattgcagccgttaagtgcctgatccatgccttggtctatggcttttcaattggcgagcttttgggcgtgggcagcgactttatttcatctttggcgctgctgctgccatttacgtgggcggccaagagaacgtcgcttaagccggcacagcgctatttattgggaaccggcgcgggaatgctgactttgacggtggtcatgtcgcttttgaatttgtgggtcttgacgccgctttacatgaaaatctggggctggaagccaacgatgccgattgcttccttggtggcaatcggggttgttccgttcaatattatcaagggtctgttagttggcggggtctcctcgctgttggcaatgcggcttgccaattggctggctaagcatcaaatgtaagattgatcaataaaacgactgttaatgatgatccgcgaactgattgtaattggcttgcggggatcgatcagcggcagtcgttttttattttggtgaaatttcgtataatttgcatatagtatttcaagggggtgaaaaattgaagagctattttattgagatgttgaccgatcagcccaggagaacggcggttttgcgcaataccgtcaaaaacaagcgaaccgttgcaactttgttttgggctcgcgaatatggcgtcttaaagtggctggggtccaatccaagactcacggtcaacgaatttgagcaatggctcgttcaaatgcgacaggctggcctgatcaaaataaatgatcagacggcatggcttactcccagtggcattgctgaaaaagaaaaatttctaaaaacgcattatcagccgtggtttggaaactggtcttggctggcgcgacctgatcagctggcgccacgcgtcttgctggcaacacaggcggtcagtcagtatgcccaccgacaaaagcattacgttcccttaaatctggccccggctgagctatattttgtccgtcagtggttttatggaaatcgaaatcggatcgttgacgaatgggcatcagaactgcagcaggccgccgctgcgctggctaaaatggatgaaagactggccaagctgctggtgttttctttgcctggctatcaaacgaccggctggacgattgatcaggcagcacgggctttaaaaatctcagtcgatgaagtcatgatcatggagcgggatgtatggctgggaatcggctatctggcagccagtcagccagcaggtttgttaagaagtctgctgtacgatcatctgcatgatacaccgcttaatcacagtgccacgattactctaagaatgtttgaacaggggctttcgcttgaacggatcagtcaaagaaggcgtttgaagctggggaccattcgtgaacatattctggaagcagcaatctttatgccagaggcgctgccgcttgaccgcctgctgactccagcacaaattgaccggctggccgcgcagtatcatggcaaaccagctacctgggaatttctgccgccgatcctcgagccgcaatcaccagccgacaaattgcaaaatgaacagagcttctttgaataccggctctttcagattattaagggaggtgagcacaatggatgagcagcggctgtatcaaacactgaagcagcagtttggttttgatgaatttcggccaggccaaaaggaaacgattcaagctgtcttgaatcaaaatgacgtcttggcggttctgccaacgggggccggcaagacgctgctgtatcagctgccagcctatctgatgccaggcagtgtcttgatcgtttcgccactgatctctttaatgcaggatcaagtcgaccgcctgcgtcagcatggtgagcgccaagtcgtaatgctgaacgctactttaacgggtcgctcgcgtcagcaggtcttaaatcggctggcggcctatcgctttatcttcgcctcgccggaaatcctggctcagccttcaatcaagcatgcattaagaaagtgtcggatcagtctgttggtaattgatgaagcacattgtatctcgcagtggggtcctgattttcgccccgagtatctgctgctaaaagaagttgaaaacgatttgaggcggccgccgatcctgttattgacggccactgccacaccgcgggttcaaaatgatattctccaaaaaatggggcttgatgaaaaaaacgtcaagcgggtgattcgttcggtcaatcgtcccaatatctttttggcagtcgatcaggttgaaaatgatcagcaaaagcggcagcggctggctaaatggctgcatgagctgggtggcggcgggattatatatttttccagccgcaagctggccaatgagctggcagactggctgggtgaaatgactggacttgagatcgcggcatatcacgctgggatttcggcaattgatcgctttcgcattcagcagcagttcatgcagggacaattgcaggtcgtttgtgctaccagtgcttttggcatgggcattgataaagacgatattcgctatgtgattcactatcatttgcctggcagtctggaaagctacgtacaagagatcgggcgggcgggtcgcaatcaaaaaccagccctcgcgctgttgatgtattcaccaggtgatgaacagattcaaagacagctcagtcagattgaactgccaagtcaaacagtcgtggaaaaagtccagcaaaaaaagctgccgggaaatgcgctggggccgcaagccgaattgattgagttttatcttagccatggctggaactatgcacgattaaccgcgatgctcaaaaaaagaggccgcctggtcaatcagcagctggcagccatgctgagctacgttagtgaaaaaaagtgccgtcgtgccaatatcatgcgttattttggtgaattgccggttgattgtcccaactgctgcgactgtcatcaaaacgactggcgattgagtgatcttaagctgccggccgcggtgaatccggtcgtcaacgatcagctggattggcaaaagcggctgcagtttctgtttgccaaggaatcgaaaactggctagacaggcatggcttttttgcgctacaatcgattcaatcactgaaatataaaggagcgttcgttaatgagtgaacgacgtgaagaccatcgccaagaggccggcaaactttgggacaagacctttgaagacaatcaagaccttgatgattccggtcacctgtcgcgaacggcccatcgcaaacaaagctcgcataattcacgcatcacgacgatactgatcgtcttgatcgtgattttagcagcaaccccaattatttattgggttcatcatgagcagtcattcaatcatccgcagcagacggaaaaggttgctcagtctgtatcgagcaaggcaaaaaaagcatccagccacgcgaagtctaaaaccaagtccaagtcaagcgctgctgagactgccaaaaccaagacggctaaagccaaaagcagcagtcaagcggattcaaccagtattaccagtgcccagagcagctcatcttcaagtgcggctgccagtacctcatcaaccagtgagagtagggcaaagtatacgacggttggctcagggcagggcatctatcgcgtggcaaccaataatgggctgacagttgcggagctggccagccttaacaatatatcacccaatacgccgctgtacccaggtcagcgactgcgggtcaaataaggggagaatttgaaaacttatggaaaaaggattgcaagtggccattgatggtccagcctcatcaggaaaaagcacggtcgcaaaaattattgccaagcagtttggctacgtctactgcgataccggcgccatgtatcgttcggtaacgtgggcagcattggaaaatggaattgatgtcagcgataccaagcgagtaatcgatctggctcgccgaatcaagatcacgtttgagcccggtcagccagatcagcgtgttttcgttgatggtcatgaggtcactaaagatattcgcacagaaaagatcgcggccaacgtttcagcagttgccgccattccagaagtccgcgctcaaatggttgaacagcagcgacagattgctcaggctggcgggatcgtgatggatggtcgcgatattggcacgacggttttgccagacgctcaggttaaggtgtttttggttgccagtgctcatgagcgagcccggcgccgctatgaggaaaatctgcaaaaaggtctggcaacgcaatcactggacgagctggaagcagctatcaaactgcgtgatcaaaaagattcaacgcgcaaggtctcgccgctgacccaggctaaagatgcgattttaattgatacgacgagcttaacgattgatcaggtagttgatgaaatcagcgcactgattaaaaaaaaccaggacaattaattctaaacactggtaaacttggttcaactctagtaaaatagtggctagagttgattgttgcaaggaggattttttttaatggctgaaaacgaaaacaaagacgcgatgttagaagcgctcgacagcatcaaagaagttaaggttggcgatgttgttaagggcaaggtactgcaaattgatgatcgtcaagcgatcgttggtattgaagactcaggtgttgaaggggttgtcccggctaaccaactgtcttccaagcccgttgaagacatcaacacggttgtgaaggtcggcgacgaactggacctggttgtcatctccaagattggcagcgacaaggaaaacggcagctacctgctttcacaccggcgcttggaagccatgaaggtatgggacgatctggaaaagaaattcgaagctggtgaaacgatcacggctaaggttacccaagctgttaagggtggtctggttgtagatgctggcgttcgtggtttcgtacctgcctcaatgattactgaccactacgttgaagacttgaaccaattcaagggtcaagaacttgaattcaagattgttgaaattgaaccaagcgacaaccgcctgatcctttctcacaaggaaatcgttcaagctcaacacgaagaagctgctaagaaggtcttctctgaactgcaacctggcgacgttgtcgaaggtaaggtagctcggatgactaactttggtgccttcatcgaccttggcggcgtagacggtctggttcacgtttccgaaatttcctacgaccacgttgacaagccatctgacgtactggaagttggccaagacgttaaggttaaggttctgagcgttgacccagaacgcgaacggatttctctgtccatcaagcaaacgctgcctggaccatgggatgacattcaagacaaggctccagttggtgctgtcttgactggtactgttaagcgcctgaccagctttggtgcttttgttgaagtattccctggcgttgaaggtttggtacacatttcccaaatctcccacaagcacatcgctacgccagctgatgttctgaagccaggtgaagaagtcaaggttaaggttctgaacgttgaccctgaacaccaacgtcttggcttgtccatcaaggcattggaagaaaagccagctggttctgacaacaacgaaggccaccgtggcggcaaccgtcgtcctcgtcgtcgtaacaacgactacaaggccaacatgccagaagaagaaaacggctttacgctgggcgatctgatcggtgatgaactgaagaacgctcgcaagtaatttaacattgcgttaagagcaaagctgggatttttcccagctttgttttttcatcaagactttttaggcgcaagtcggaaagttttatttaagaacagattaaatctaattagaaagaaggtgccgctttatggcaaatccaatcgttgccatcgttggacgccccaatgttggcaagtccacgctgttcaaccgggttgccggcgaacgaatctcaattgttgaagatacgccaggcgttacgcgtgaccgtatctatgcccacggcgaatggctgggcaagcattttagcttgattgatactggtgggattgaaatgtctgatcagccactgtcaactcagattcgtgaacaggctgaagtagccattgatgaagccgacgtaatcgtaatggtcgttgacgtgcgcagtggggttactgatgccgatgagcaggttgcgcagattctgtatcgttccgataagccggtcgttttggcggtcaataaggttgacaatccagaacgacgctcggatgtctatgacttctactcgctgggtctgggcgaaccataccctgtttccagtgtccatggcgtcggggtcggggatcttttggatgccgtcatcaaaaacttccctgaaaatgccgccaatgaagaagatgacacgattcatttcagcttgattggccggcccaacgttggcaagtcctcaatcgtcaatgccatgctgggtgaagaccgggtaatcgtatccaatattgccgggacgacgcgtgatgcgattgatactcattttaaggctgatggtcgtgagtttacgatggttgacacggctgggatcaagaaaaaaggcaagctttatgaaaataccgaacgctatgctctgatgcgctcgatgcgggcgattgatggcagtgacgtggtattggtcgttttaaacgccgaagagggcattcgcgagctggacaagcatattgccggctatgcgcatgaggctggtaaagggatcattatcgtagtcaacaaatgggatacgattccagatcgcgaccagcgcacgatgactgactttaccaatctgattcgccaagagttccagtatctcagctacgcgccgattatctttgtttcagctaaaactcgccagcggctgatcaagttgccaaagatgattgaagaggtctatgatcactgtcgtcgtcggattcaatcatccgtgctcaacgacgtcattatggatgcgattgcggctaatccaacgccaagcacgaatggtcgccgtctgcgcgtctattatgcaactcaggtggcaattgagccgccaacgttcgttatttttgtaaacgatcccgacctgatgcacttctcttatgcccgttatttagaaaatcagattcggcaggcgtttgatttttcaggtacaccgattcatctgatcaaacggaagcggaagtaggctgtgccataagatcgacagcggtttttgttcctaaaaccaaaccggactaatcttagatgatgttggcttttatcagcttttggcaattggaaacggctaaatcagctaaattttaatgataacgttcgcaaatcggcgtttaattgaaatttcatttaaaaagtccgttaaaccgcttgtcagcgcggtttcactatgctaatctagtttttgaaatgatgcgtgagcacgttattgtttcgttaattttggaccactcaaaattaactgatcctatgacgagggaatttccatcgtcaatggtgggaggtgaaacacatggcaaacaaagcacaactggttagcgacgttgctacggcaactggtctgacgaagaaggatgctacggctgctgtagacgctgtcttcagttccatccaagcatctctggccaagggtgaaaaggttcaattaatcggttttggtaactttgaagtacggcaacgcgccgcacgtaaaggtcgcaacccacaaactggacaagaaattgaaatccctgcaagcaaggttccagcattcaagccgggcaaagctttgaaggacgccgttaagtaattaacgacgataaaaaaatgaagcgacgatcgttttttcgatcgtcgttttttattggcttgataatctttgccagtgcagcttatgagagtttatcaacagttttaaggttgttttatgttaaactaaaaaagcatgattaaattaagggggaaaatagcgtgaccttttccgaaaaatgtctgcaggcaattgaagatggcaacatggaagaagcccaaaaagaatttgcctgggcgttgcgcaaagatgatgatgagattctgttcaatctggcggaacagctatacgcgctgggcctgatgccgcaagcccgccgcgcctatctgaagctgctggagcgttatccggatgaagatgagctgcgaaccgcgctggctgagattgcgatcgataatggtcataacgatgaggcattggcctatctgacgcagattgcgcccgattcaccagcttatgtccaggcgctgctggtggcggcagacctttaccaaaccgaggggcagtttgaggtaacggaagccaagctcaaacaagcctatcaagcagccccagaagagccggccgttttgtttgccatgggtgagttctactatctggtgggtcaatttgacaaagcagtgccgttttattttgcactgattcaaaccggtgccgtagagtttgccaaggttgatattgcggcgcgcttaggaatggcctacgcacaaagcggtcattatgagcaggcactgggctatctcaagcaggtggcgccagcatatcaaaccagcgacgttcgttttcaaaccggactgacgcagctggaattgggtgaattcaaggatgccattgaaacgctgactgatctgatcaaagacgatgaccagtacgcctcggcttatcctgccttggcgcgggcctatgagcagacgcaacagtatgaggccggtctgaaagccgttcaagaaggtctgggcgttgatcagtacaatgagaatctttttgcattggcggcaagaatggccagccacgttggcgattttaaactgatgcaaaaatatctgcagcaggctcatgagctggatccggacaatttgacgattactttggaatacagcaatctgctgatcaagctgggcgagcaccaggtcaatgtcaagctgctggccccattggtcaaggcagatgaagtcgatccccagctggattggaatctggcagtctcctatcaggcattggaaaaatacgacctggccgagcggttctatcaggcagcgatgccaagctataatgaaaacgttgattttttaaagagtctgatcagcttttaccaagaaaccgggcagcgtgacttgatgatcgatgaaatggagcattacgtacggcttaatcccgctgatactgaaatgcaggagcgcctggatcaagaaatattctaaataaaaaaaggttccgcaccgagcggaacctttttatttaagctgcagcaagagacgctgataatagagcagggactgtggattcagtctcagccgtgtctgcagttcttggggcgtggcgtcacgatgctgagcaatctcataaagaatatagctttggtgcagatacttgggagccagcttaaagcccaggtagtcctcatcggctttgaggtatttaaacaaaccggcgttgctgatccaaggatgctcgcgattcagccgctgctttaaaaagatatcctggcagttctgcagctgctgaataggtgcgatataggcagtaaaggtcttcatgaaattctgttcaacggtgtttttgggttgcaggctgcgccatacgtcgccaaatcctggctgcaggaactcagcaactgtatagccgcggctgctcaagaacaaaacggcacgggtatagagctgaagatgatcatcagcgagaatatcatccagcttgagcagccatttagtggaaagatgctgattaggcttagttgccttgccatgaatagtcagcgtaggatagttgtcgatcagctgatgcgtaaacaaaaagcggaaatagcggctgagctgagaaagcaccttgttaaaagttgccagagtaatgtcttgttcatcacgcagccagtttaggtaggcccggacgtcggtttccgttacgttgttggcgcttgggtcatgagcatagatcggacgctgatcttcaagatagttaaataattggcgcagcgtggcatcataggcatcaatggtcatttgcgcgcgaccaatggttttaagctcccgatgaaaggcggtctggtaaggatattggtccataaaaaagctcctttctgatttatttttccgtagtaatgatttaccttaacaataacgcgaaaagcaaccaaaagcaagcataaccaaattgctgatgtcttcgtcaactaattcgagcgctggtgctttttttagttgataaagcccaatcagtgtccttttatgatgatcactgagttagaattataaagtttgctaaattgcagatcgcgttttcgagtcctggaaagtttgctaaaatagttaggactggttataaaaaccaaatccacgaaacaaggaaatgatatccgtgaaaatcgaaaaactgccggccgtctttgaaccagcgcggccgattctgcaacgtattgagcaggcaggctttgaagcttattttgttggcggctgcgtgcgcgatacgattttaggcgatccgattcatgacatcgacattgccaccagcgcctatccggccgaaatcaagcagatctttaatcgtacggttgataccggtattgagcatgggacggtcatgattttagatcatggtattggctacgaaacgaccacttttcgaactgaatctggctaccaggactttcgccgtccagattcggtaacgtttgtccgctcactggcagaagacttaaagcggcgcgactttacgatcaatgccttggcgctgaaggaaaacggcgaggtcatcgatttgtttgatgggctgggcgacttaaagcggcacttgatcaaggcggtgggtgaaccggctgaacgttttcatgaagacgcgctgcggatgatgcgggccgttcgttttgccagcaagctgaactttaagattgacgaaccaaccaaacagggcatcaaagacaacgcgccactgctggaaaagattgccgtggaacggattcgggttgaatttgaaaaactgctgttaggacagaaccccgtggccggattgaccgatctgattgagactgatctttaccgttattgtccgaaactggcggatcaaaaggcggcccttgatcagctgctggacctaaagccatggcagctgaaaacagaagctgaggcctgggcggtgctgatgctggtcatgcagttggatcatgcccagcgcaatgcctttttaaaagcttggaagacttccaatgatttgatcggcgccgtgcagaaaatcgttttggcagccgatgcgattttaaatgatcagctgacgccagcaattctgtttgctactggagaaaagcttttgatcagtgccaatcgagtcgcggcattatttggtcagtcgcaagaagaacttgacctgcgtgatcgctaccaggcactgccgatcaaaagcgccaaggaactggcagtcaatggcggccaattgattaagctggcgcacgtcaaaccggggccgaagatgggctggattctacatcagcttcagcagcaggtcttggatcggaagctgcccaacgatcaaaacgcgttattagcggcagcggcacaattagcaaaagaggatggcaatgaaaacattaagagctgaaaatttaaccagtacgtatggtgaaaagacactgtttaaagacgtttcgttcattatcaacgaacaggaccgcattggcttgatcggcaccaacggcagcggtaagacctcgcttttaaacgttatcagtggtgcggtcagtcctgaggccggcgagatcatcaaacccagcgactattcgattggctttttgaaacagcagccggacctggatgaagaaaaaacgatcatggatgccgtgtttgctggcgggcagccagtctttcaaacgattcggcaatatgaaaaagcgctgctggattatagcgcgcatcctgaagattccagattaagcgatcgatttatcaagatgcaggctgctatggatcaagaggacgcctgggaagccgatagccgcgtcaagacgattttaacgcaactgaaaatcaatgacgccaaccaaaaaatcaaggagctttccggtggtcagcgcaagcgggttggcctggcccaggttttgattcaagaacctgatctgctgatgctggatgagccaaccaatcatttggacatcgactcgatcatgtggctgcaggactatctggccagttatcgcggggccgtgctggtcgttacgcatgaccgctactttttggatcaggttgccaatcatatctgggagctgtcgtttggcaagctttatcattatgacggcaactatcaggacttcgtagcccaaaaagcgacccgggttgaactggcacaggaaggcgagcgcaagcggcaggccctttacaaaaaagagctggcctggatgcggcatggagctaaggcgcgctcaaccaaacaaaagggccggatcaatcgttttaatgaactcaaggacaacctgggcaagcttaaagttgatgaggacatctcgattgaactgggctcgcagcgactgggcaaagacgtcattgaaatgcagcatgccaatcttaagtatggcgatcatgaaattttagacgacttcaactggctggtgcaggccggcgatcgaatcggcattaccggcgaaaacggtgccggcaagacttcgcttttaaatgtgattgctggccgcaccaagcttgattcgggcgttttgaagattggcgagaccgttaagctgggatactacacgcaacagacggaaggcattgatgacgacaagcgtatgatcagctatctgactgaagtcgctgacaacgtggtcgataaaaacggcaatcgggtcaacgttacgcagctgctggagcgtttcttgtttccgcgatttatgcatggaacgctgattcggaagctttctggtggtgaaaagcggcggctgtatctgttaaaaatcttgatgcagcagccaaacgtcctgcttttggatgagccaaccaacgatttggacattggcacactgacggtattggaagactatttggacgatttcgctggaacggtcattacggtttcgcatgaccgctactttttggacaaggtggctgataatctgctgatcttccgtggtcaaggcaagattgagcgctaccgcggctactacactgaatatctcaaaaaggcccaagctgatgcacaggcggctcaggcagctaaatccgcggccaaggcagccgccaagaaaacggccgcccctgctaaaacggccaacactgccaaggtaaagaccaagctgacctatgccgaaaaactggaatgggatcatattgacgaagaaatcgatcagctggacacacgccaaaagcagattgaagaagaaatggcagctaatggcgataactacgccaaactggcggaactgcaaaaagaactggatggggttcaaaaagccttggcagaaaaaaccgcacgctgggaatacctcagcgagtttgtggatgaataggcggttctaatcaagagccagtcagccgacgatatgttagaatggaacttatttgaacagcgaaaggaagattagacatggcaatcaatgacaatgaacagcagtatctggatctggcccgctacgtattagagcatgggcacgaaaagagcgatcggacggggacgggaacgcgctcggttttcggctatcagatgcattttgatctcaacgccggttttccgattctaaccaccaaatttgttccgtttggtctgatcaaaagcgagctgctgtggtttttgcgcggcgataccaacattcgcttcctgctgcagcacaagaatcatatctgggatgaatgggcctttaaaaaatgggtggaaagtccagaataccaaggcccagacatgacggattttggtcaccgctggcttaaggatcccgaatttaaaaaggtctatctggcagaaaaaaaggccttttgcgatcgcatcttgaatgatgatgagtttgcgcaaaaatatggcgatctggggctggtttatggctcacaatggcggcactggaaaaccagcgatggccactacattgatcagattgccaaagtcatcgaacagatcaagaccacgccggattcacgccggatgatcgtttcggcctggaatccagaagacgtggacagcatggcactgccgccttgccacacgatgtttcaattctacgtcaatgatggcaagctgagctgtcagctgtatcagcgcagtgccgatattttcttaggcgtgccgttcaacatcgccagctatgcgcttttgacgcacatgattgccaaggagtgcggcctgggcgtgggcgagttcgtgcatactttaggagatgcgcacatctacagcaatcacattgagcagattaaagaacagctttcacggacgccgcatccagcgcccaaactgattttgccggctgatccaaaaccagttgatcagtatgaaatggaagacattaagctggaaaactatgagcacgaggccgggatcaaggccccagttgccgtttaaggggtgtttttatgaatcagctggactttatctgggcgcaggatccagacggctatatcggcaaaaacggcaccatgccatggcatctgcctgccgatttgaagcattttaaagccgtgacgcttaatcatccggtaattatgggtgccaatacgttcaagtcgatcggccgaccgctgccgaagcgcgaaaatatcgtcttgacgcatcaaaaactggacgatgccaagattacggtggtacacagtgttgaagagctaaaggagctgctggcggatcgcttggctggccagcgctgttttgttattggcggagcacagatctatcaaacgctgctgccattagctggcgatctttatcgaacggtggttgaacggcgctttggcggcgataccaaaatgccggccattgactatcagggatggcgtttggcagatgtggagaaaataaaaagcgatcagccggacgttcccgactgccgctttgagcattggattaaaaactagacgtaaaataggatcgaaaagtagatgaatgccgtgccgaccatgacaaaaagatgccagatcagatgcgtgtaacgggttggcatgctgtagagcagggcgcccagcgtataggtgatgcctcccgctagtagcatgccaaagccaactggtcccaaggcgtgccaaagcggccaaaatgccagcacgcacatccagcccatgatcacgtagaaaatcgtcgaccatttgccctttttttgaaaccagatgcttttatagatgatgccagcagtcgccatggcccagataatgccaaacagcgtccagccctgccagcctttaatggccaccagacagtatggcgtgtagctggcggcaatgaccaggtagatcatgtcgtggtccagaatctgaaagacccgtctagcacgagtaaagatcagcgagtgaaacagtgttgaggctaaaaagaacaggactaaagccgcgccatagattgaaaaagtaacgatgcgcatggggctgccggtatgtaccgcccgcacgatcaagatcaccaatccggcaatggccagggccgcaccaacaccgtgagtaatggcattggcgatttcaattaaaagggtttggcgatgtgatgttgagtttttcatctgcaagttgaatactcctttcataaaagtgctcggcaatgaaatcagtcgttatttatgctatactaaagttaattatcaaggcagtttgcatgcccggcagactaagtttataatgtatttagtctttaaaataatgtatctagtttacgatactagatacattatatcaaacttgatcaggaagtgggtaatttccatgtcaaagattaaaattgtggctgactcttcagctggccttaccgatgaagaaattaaaaaatatgatattacgatcgtaccactgtcagtaatgattgacgggacggtttatgttgaacgcgaaactattaccaacgatcagttcccaacgatgatgaaaaatgccaagtcgctgccgaaaacctcgcagccgccaattggcaagttcgttgatgcctttgatcagacgggggcagacggcagcgaggttctgtgcgtgacgatgatggcatcgatcagtggcacggttcatgctgctgagcaggctgccaacctaaccaagaccaaggtaacggtatacgactgtcagtcaaccgaccgcggtatggcctttcaaatcatcgaagccgccaaggtgattgcagacggcggaacggttgatgatgcaattgccaagatgaaggacgttttgcaaaagagcaagctgtatctggcaatcgataatctcgataatctggtagcgggtggtcgaatcagcaagtttgccggtgcgttgtctcggtttatgaacatcaagattatgctgcaggtttatgatggcgagatccacgtagcttccaagggtcgcggcatgaaagcgatccataagaaatgggataagatcttagatgagatggccagtggtcctaaagttttgggtgttggcatctcgcatgttgaaggcatgagtgaagttgagcggcttaaagaaagagttcaggctatctgtccagagctgccgatcgtcattcgcgaaacagtgccgattattgcaacgcatacgggcttgggtgcctgctgcctgctttactatactgaatagtcagaaagtctgatgccagatcgcatcggacttttttattgctgaatatgtataaaaaatgaataaaaattattaaaccattaaggtaaaatgatttaatttatttaaataaaagggaatatcggcagtgataaacgttaaaatagccgaaatccagtagttttaaccttaaaaacagcatttctttgattaatatgtaaacgcttgattttgaaacaataaacagaaatttcgaaaatatgcttgacaaacgtatagctatccattaaattaaataacaatctatatgtcctttaaatttagtcccgtgaggctagcaaggcagcatcgtttaaatttggtcgacgttttggtcgcgcttttaaacaatatgttggagcactggttcacgagtcgtggagcagtgctttttattggacaaattttgtaaggagtttggcgaaatgaaagaattttatgatgcgatggccatgaaacgcgccttaacgcgaatcacctacgaaattgtcgaaagcaacaaaggaacccaggatttggtcctgatcggtattaagacgcgcggagtctatctggcgcgtcgcattgctgatcagctgcagaaactggaaaacgttgcggtaccagttggtgagctggacgttaccaactatcgcgacgatcgacgaccagacaccgctaaggaaaatctaaggctgggcgttgacatcaatgataagcgcgtggtgctggtcgatgacgtgttctttactggccggacgatccgggcagccatggatgcaattatggatcaagggcggcccaagcgcgtccaggttgcggttttggttgatcgtggtcatcgtgagctgccgattcggcctgattttgtcggcaaaaacattccaacgtccatgcaggaacgagtaaaggtcaacgtcagcgagactgatggacaagacagcgtcgttttgatcaagcagggtgaactggcacaggcctgattgagtgagattgtttagaaaagggagattgcaatgaaacgttatttgattatggaggatggctcgatctatgagggcgagggctttggtgccgctgtgcagaccactggcgaagtcgtctttactacggggatgaccggctatcaagaggccattaccgaccagtcgtatgccaatcagatcctggtgtttaccaacccgctgatcggcaattacggtgtcacgctggatgattttgaatcactgcagccgcagatcaaaggcgtcatctgtcgacaggtggcgcggattcctagcaactggcgcatgcaggatacactgcccggttttttggaaaagatgaacattccgggcctgcagggaatcgatacgcgtgagctggttcgcaagctgcgtcattttggcacgctgcgcggacgaattgccgattcaatcaccgatgctgacagtgtggttaaagaattaaagcgtcaaaatccaaccaaaggcatcatcagtcaggtctcaaccaagacgctctatcctaatcctggtaccaagcgcaatatcgtagtagttgattttggtgccaagcacagtattctgcgggaactggccaaacgagactgcaatacgatcgtggtgccatattcaacaacagctcaagaaatcttgaatctgcatccagatggtgttttgctttccaatggtcccggcaatcccgaagaaatgacggccgcagctgaaatggtggctgagattgagaaacacctgccagtatttggcatctgcatgggtcatcagatttttgccttagctaacggggccagcacctacaagatgaaatttggtcatcgtggatttaatcatccggtcagagacattgcatccggtcagatcgtctttacctcacaaaatcatggctacgcggttgatcccgcttcagttgataaagaaaaactgatgatcacacatgtcgagatcaatgatgggacggttgaaggtttgcgtcatcgtcaatatccggccttttcggttcagttccacccagatgccgcgccgggtccgcatgatgccgatggtttgtttgatgactttatcagcatggtagatcaacgaaaggaagcacgcaccaatgcctaaacggacagatattcataaaattttggtaatcggctcggggccaattattattggtcaggccgcggaattcgattattcaggaactcaagcctgcatggccctgcgcgaggaaggctatgaaacggtgctggtcaattccaatcccgccacgatcatgacggacacggaaattgccgatcacgtctatattgagccattaacggtcgaatcggtatcacgaattattcgccaggaatatccagatgcaattctgccgacgctgggtgggcagattggcttaaacctggccgtagcacttggtaagaccggtatcttagatgaacttaacatccagatgctgggtactaagctggcttcaattgatgaggctgaggaccgtgaaaaattcaaagagctgatgcagcgcttaaacgaaccggtacctgcttccaagacagtaggcacggttgtagaagcgcttgagtttgctcatgagatcggctatccggtgatcgtgcggccggcctttacaatgggtggtactggcggcggcatgtgtcataatgatgacgagctaaaggctattgctgctaatggtctggatctttcgccggcaactcagtgtctgatcgaaaaatcaattgctggctataaggagattgagtttgaggtgatgcgtgacgcagcggacaacgccatggtagtctgctgtatggaaaactttgatccagttggtattcatactggtgactcaatcgtttttgctccatgccagacgctttctgatcgtgaatatcagatgcttcgtgactgcgcgctcaaactgattcgggcgctcaagatcgaaggcggctgcaacgttcaattagcccttgatcctaacagctatcaatataacgtgatcgaagtcaatccgcgggtttcgcgttcttcagcattggcttccaaggcaacgggttatccaatcgccaagatggcagccaagatcgcggtggggctgaccttagatgagatcaagaacccggttactgggacgacgtttgccgaatttgaaccggcactggactatgtagtctgcaagattccgcgttggccatttgacaagttcacgcatgctgatcgtcgtctgggcagtcaaatgaaggcaaccggtgaagttatggcaatcggccgcaactgtgaggaagccgttcaaaaagccgttcgctccctggaaatcgatcaaaaggacctgttttcacaagaggcacaggcagcatctgatactgagctggaagataagctggtgcacgttcaagacgatcgaatcttttatctggctgaggcgctgcggcgtggctacagcctagaagacctgcatgagctgactaagattaccgtttactttttggatatcttaaaacatatcgtggaactggaagatcagatcaaggccagccctaaagatgccgccgtgttaaaactggctaaacagtacggcttttctgatccaacgattgccgacctctggcagactgatgccgacagcgtccgtcagctgcgtcggcaaaacggcatcgtaccagtctataagatggttgatacctgcgcggctgaatttgagtcgcagacgccatatttctacagtacgtatgatcatgaaaatgaaagcatcaaaagcgcgcggccgtccgtcttggttatcggctcaggtccgattcgaattggtcagggggtagagtttgactatgccaccgttcacagcgttaaggcgattcaacgactgggctatgaggcgatcgtcatgaattccaatcccgaaacggtttcaactgacttttcggtttctgacaagctttattttgaaccgttgacactggaagacgtgctgaatgtgatcgatctggaaaagccaatgggagtgatcgttcaatttggcgggcagacggcgattaatctggcagcgggcttggctgagcatggcgtcaagattctggggaccacggttaaggatctggatgcggccgaggaccgagaagtctttgatcaagtcatcaaggatctgcagctcaagcagccgattgggttaacggccacgactggagtaggcgtcttaaaagcggccaaggagatcggctacccagtcctggtacggccaagctacgtcttaggcggtaaggcaatggagatcgtctacaatgaaaaagaactgcacgaatatctcagccaaaacgcgccagccgctgaagatcatccaattttagtcgatgcctatctggaagggcgtgaatgtgaggttgatgccatctgtgacggcaaagaggttcttttgccggggatcatggagcatatcgaacgcgccggcgtgcactctggcgactcaatggccgtctatccgccacaaagctttgatgacgatattaagcagcagatcgtggccgctaccaagaagctttgcgtagctttgaagtgcgtgggcatcatgaatattcaatttattattcataaccacgaggcctatgtcttggaagtcaatccacgggccagccggacggtaccgtttttgagcaagattacgggaatcgaaatggctcaggtagcaacccgcgtgattttgggcgagtcattggccagtcaagaatatcaagatggtctctacccagagtcaaagaccattcatgttaaggcgccagtctttagcttcaataagctggatgacgttgacagctacttgggacctgagatgaaatctaccggtgaggtcatgggcagcgactacacgtttgaaaaggcactctataaagcatttgaaggtgccaagatgcatctgccggactatggcaatgttttactgacgattgaggaccgtgataaagagacgattttgccactggccaagcgctttgccaagatcggctaccgaattttggctacggatggcacggcagacttcttgaagcaaaacggcctgcacgttacgacggttggcaagctgcatgaagaggataccaagcgggccaacattttggacgtcttaaagaacaatgacgtggatctggttatcaataccatggaacatgactatgaaaaggcttcggatggctttgtgattcggcagacggcaattgagcacaatatcccgcttttgacggcgcttgatacggtcaatgccctgttgaaggctttggagagtcgttcatttgctacgcaggcactttaggctcaatcattaaatttattaagcagaatcgactgcccgtggtggtggtcggtttttattttgaaaaattttcgagctgatattaaaaacgatccagcgtaacgggacgctatcaatagcctaagattaaagtcagatggttcggatcgtgctgtttttaacgactgaacgggttgacttaaagtacgctttaaggattaagctatacctaagtcgatgtgtccggctgataaaatcgtaaggaggaattttggatgaaaacagcaatttttgctgaacccggtaaaatggtgattaaagagactgccaagccaaccttgcaagccgatgatgacgtaattattcgtgtgattcggacctgcgtctgcggttcagatctatgggcctattcagcaggtgatcaaaaggccaacgactcagttaacagcggtcacgaagcgctgaggatcgttgaagaggtcggcagtgcgattacaacggtcaagccaggtgattttgttattgctccattcacgcatggctgtggacattgtgctgcctgtctggctggttatgatggcacctgtgatgagcgcgttctttatgataactggagcgaaggttttcaatcagaatatatttgctttaagcatggcaactgggctttgattaagattcctggtcagccagaagactatagcgaaggcatgatgaagtcgtttatgacgttggccgacgtgatggcaaccggctatcatgccgcacgaacggctgaggttaagcatggcgatcgtgttgttgtcgttggtgacggcgcggttggtcaatgtgccgtaattgctgctaaaatgatgggagcctcgcaagtcgttatcatgagtcgtcatgaggatcggcaaaaactggcccaggaatttggcgcgacggcgtatgttgctgaacgtggcgatgaaggagtaaaaaaggtcaaggagctgcttggcggtggtgctgacgcggcattagactgtgtcggtacagaagcttcaatcaatcagtgtctggcagtagttcacaatggcgctcacgtcagtcgaatcggcgtgccgcacagcaatgtcgatccattcacgctgtttgcccacaatattgcaatggctggtggttcggcaagtgtgacgacctatgataaaaacgtgcttttaaaggcggttttggatgggcagatcaatccaggcaaagtgtttaccaaaacctatatgctggatcagatcaatgaagcctatcgtgatatggctgactgtaagacgatcaaatcctacattgtaattgagtaacccaaatagtcgcaaaaaaatcgtcctgtctgaagcaaggcagggcgattttttgactaaaaataatgcatgaatgcttaatttacatatagtaagatgagggcatttaagaaatttttgcgactgacggattgttgatcagaccgtaagaaagtttgatatactggttactgatggtcagactgattgattagttcgtgcagagcctgattggccagctggtgggcgccttgattttctttttcggggacccactggactacaacggttttaaaatcgtccatactggtcaacagctcgttcagcacgttttcataatgacgcgcatgctctttgcccacagcgtcgctcagcaggcggctgtcggtataaaacagcacggtctcttgattggaaaaatgtttttttaaataggcaaagccttcaatcgccgcggcaaattcgccttgatgattggaagcccgcggcaaaaaagctttaagctgctgctgctggccgtctttgacaaccagcattcccagtccggtggggccaggattgcctttggtggcagcatcggtatatagtttgatcatttgattacctcattgacattaggaagtgatattttggaagaagaaaaacgctacttttaccagccggatctaacctcggcaatcattcaatggtgctggatgcttttgattggcattgccagtgtcgtggtctggctggagattacccattttaactggattacggcattgcttttagcgctttttattattttagcagttttggcgattggccggcgcacggttttggtaacgccgaccaaaatggtatttgatcgtatgctgcagaatcgttttttggtcattccgcttaaagacattcgccagcctcgctttaccaagcataccatgacgatcacggttaatggcgaggtcatgaccttttcattttccgcgcgctcaatcgactctttaaagattacgctgggtaatgcagtaaaaaatgaacatgaataaaacagaaaagaatcaattgaaaaaacaatcgctgttgccatggtctttgattttaatcgttggtctgatcattgtcgatcaaatcgtcaagcactgggtaaccagcaatatcccgttaaatggcagccgaacgttcattccgggactgctggatctggataatctgcataataccggggcagcttggagcatgttggaagggcggcagtggttttttgcggtcataacggtaattgcaattatcgtggtagcttatctgatgtggaaaaatcgtcgctctgcctggataatgacaggactttcgctgattatggctggtgcagtcggtaattttatcgaccggctcagtcaaagatacgtggtcgatatgtttgccctaaaaaacgtcaatttcccagtatttaacgttgccgatgcctgtttaacggttggcgtgtttatcatgctgatcgtagttttgaaagaggatgatcaaaaatgaactcagaacgccaaatcaagattgatgctgatctgaccggccgcattgacaaggttttgggccattttctaagtgatgtttcccgctcgcagctgcagaaatggattgaggatggtcacgtcaccgttaatgggcagtccgttaaaaccaagtacaagcttcaagtgggcgatatggtgcgcatcatacctgaagaaccgcaaaccattgatctggaaccagaaaacattcccttggatatcgtttatgaggatgatgatgtgatcgtcgtcaataaaccggccggaatggtagtgcatcctgcgcctgggcatcctagtcatacgctggtcaacgcactgttgtatcattcgccgctgtcgacgatcaatggtgagtttcggccaggaatcgtccaccgcatcgataaggatacctcgggcctgttgatggtggccaaaaatgatctggcacaccgcagtctggccgcgcagctgaagtccaagaccaaccagcgcgagtacgttgccttggtgcatggcgtgatcaaagaggaacagggaacgattgatgcgccactgggtcgttccaaaaaagatcgcaagaaacgggcagtcgtcttggatggccgtcatgccgtaacgcattttaaggtactgaagcgttatcagcactatacgctggtcaaatgtcggctggagactgggcgaacgcatcagattcgcgttcatatggcctatatcgggcatcccttggctggcgatccactgtatgggccacgcaaaaccctggctggaccgggacagtatctgcatgctggtctgttgggctttcgacacccccgcagcggtcaagagatgacgtttaccgcgccgctgccggactactttaccaagatgcttgaacatttggacaaaaccgaccgccgtgatgaatagttttgaggcggcttaaaaagtgagatgagattggatgacagcaagatatttgatatttgaggatggctccatctttgagggtgagggatttggctcgcctgccgtaacttttggcgagatggtttttaataccagtatgacgggatatcaagaaatcattaccaaccaaatctaccataatcaaattgtcgtttttaccaaccccaatattggcaattatggaattcagcgcaatatctatgaatcgatcgtaccttcaatcaaaggcgtcgtctgccgtaatctggcgcccttaaaggaacggcgtcatggaacgactctggatcagtatttaaagcagatgaatattcctggggttaccaacgttgatacgcgggctatcgtgcggcatctgcgaaaggttggccagccgatgaagggcagtatcgtcccagtccctgatgatcatgcgtttgatcagctgcatgctaccgttttgaccaatcagcaggttgctcaggttgccacgccaaagccatttcccaatccagatattggccgcagcgtggtcgtgattgactttggccttaaaaacggaatcttaagggagctttcgcggcgcaagtgcaatgttaccgtgctgccatatacggccagcgttgatgatattttacgattggatccggatggcgtagtgctttccagcggcccaggaaaccctgaatcattgaaacgatcagtcttggaaatgattcggcaagttgaggctaaggtccccatgtttgccattggactgggtcacgagctgtttgccttagcgaatgggtgtaaggttgagcgtttggcaaccgagcatcatggcatgaatcatccaatccgagagatcatcaccgatcacattgtttttgcctttcaaggtgagggttatgtaattcggcgcaactcagtcgatcgttcgcagctttttattacctatgtcgatatgcttgatggcacggttcaagggttgcggcatcgtcactatccggctttttcggtgcagttcttccctgatggcgcgcctggtccggatgaaaccaacaatctttttgatgagtttatggacattatgaagcagcgcgaggagggatggcgatgaaaaaggttcttctgattggagccggcgccgacagcattgaacatggcgatgagctcgatgccgcggcttttcaagttgccagcgtcttaaaagagcaggggtgggagacgatcctcattgatgacaatccattttcttttaccttggattgtccggatgccatcgatcatgcctgcatcaagtcactgacggttgaaaatgtcgttgccacgatcaagcagtatcatcctgatgcaatcctgccaacgttgggcggccggcgtgcgtttgagctgattcaggcagtcagcgagaccggcattctgcaggccgatgacattgagcttttgggagtacctgaagctacgattcgtcagatcaacaacccaatgctgcttggcaagacgctgcataatctcaacgtgcctaccaaggccatctctaaagtcgataattacgttgacgcactggagatggtccaacgggtcggctatccgattatcgtgcgctctgtattacccaaaggagcgggctggcgttcgctggtacatgatcaagatgagcttaagcgagctgtggcaactggtctcagacagtcacgctcgggtcagattacagttcagcagagtctggctgggtttaaggaaatcgaaattgttgttttaagagacggctttgggacgatgatgcagctggcctgcgtcgaagatatcgatccgattggcattcatgctggcgattcaattgcagtacttccggcccagacgctgcttgaccgcgagattcaagacatgcgcgatacggcatttgccataacgcgcaaactgcggattgttggcgtcaatcacgttcaatttgcgcttgatcaagctaatggaaaattctacgtgatcaaaaataatccttactttgatcgcttgacggcttttgcggcaacagcaaccggctatgctctgcaggtcgtctgtggcgaattatatgccggcaagacgctgcgtgacatccatcttgatcacggctactataagcacgcggccgtgacggaaccggttatggatcacgttgccgtccggatgccggtctggccgtttgctgaattgcccgacgcagatcggcagcttggcacgcgcaagaagtcaacagggacgatgattggcgttgggcgcagtctgactgaggctatgtttaaggcaatcagtgactttccaagaattgagcaggattcacgcctggcaaaacaggatcagctttccgatgatgagctggtgcagcttttgatccatccgcatgccggtcgtctgtttacgctgttggcggctttgcggcgcggctacactgatgatgagctgaccgagctgactaagatcgatgcctattactttgcctgtctgcgtcagatgcaggtgattgaagatgcgctcaagggccatcctggcgatgcaaagctgttggtcaaggccaaatactgcggcatgagcgatgaaagcattgctaagatctggcagtggccaacgaccaaggtggtggcaatgcgagacgagcatgtcattcaccgaacctttaaggagctggagccttctgcgggcgaatttgatcagcacaccaacgttttttactctacgtatgaaatggaggatgaggccaatccaagcccttcgccaaccgcagtcgttgtaggcacgggaccattgcggctgggcaacggaacttcctgtgactattttgttgccaacacgctgcgtgaattgcgcgaccatggctaccagaccgtcatcatcaatgacaatcccagctcggtaaccttggcgccgatgctggctcgcaagcgctatctggagccgctgcagtcagaaaacattcgtgcggttttggacgtcgagcatccggaagtcgtattgattccggctagtcgtcatgaattgatcgaccagctgggaccaattgccaaaaacatccagattgccgagattcctgaagatcagcgcccaacttcattaacggtcggtgagccgctggacagttttaacgcactgtttgacggtcagctcatctatccgctgggcattacggcagatctgcagtcaaccgatgatctgagctatcagccgactgcgcagcgttttccggcccgcttgacgccgcatgattttgctttgctggaaaagcaaggtggtcaggctattagtgagcagaaggcaccaggactttaccaggttgtttttgtacatcgtttcgatggtacctttaagcagcttttggttcagcatatgccattgccggaaattgcctttttgtcgaaggtcttaaagttgaatctgccgggaatcacggtacgcatggcattgggccggctggatggcgatgccttaaatgaagcgctggttcctaaaggtgaaaccaaaatggcagtctatcgggcagtctttccgttcaagtcgctgcatcttgttcatgaaaagccaaccatcaaccgggttttgggcggtcagatgcagtttttgagtgatgatgattttgaatagcaattaaaagaaccaggcaggtcaggatgtctggttcttttaattttgcaagcatttttaaatttgtaaaaaatacaaaaatatttgatatttattaatgaaagcgcttaaatttaggcggaaaatatgttatgatttaatcatgttaagtcgtgaagcgttttacaaacagaaagaagcttgcaaaatgaatgaaaataaagtcgtaaaattttcctacgaacagcttgatcgtctttgcatggatgcctttcaaaagtttggttttaacgcgaaacaggcttccatcattaccgatgttttattaactgccgatatgtatggtattcaaagtcatggcatgcagcgaatggtccgctactataagggaattcaaaaagggacgatgaaagttgatgccaagccagaaatcgtttttgaaactccagtctcggcggtagttgacggccatgatggcatgggacagcttaatgggcatttcgcgatggaactggcgattgccaaagccaagaaagcgggcatcgggatcgtttcggttcgtaattccaatcattacggtattgccgggtactatgccaaaatggccgctaaagaaggcatgctcggtttttcctgcaccaacagcgaggccatcatggtcccaacgtttggcagacaggcaatgatcggttccaatccacaagcctggtgcgtgccagcacggccctatgactttttgtttgatgcctcaacgacggtcgttacccgaggcaagctggagatgtacaacaagttggatcagccattgccagatggttgggccttggatgcacaaggcgagccaaccaacgatgcggcgatggtcttggacaatatcgttcacaaaaacggcggcggcatcatgcctttgggtggcaatacggaaacgctggggtcgcataagggctatggcaatgggatggtcgccgagatcttctcatcgattctttcaatgggtacgacctctgaatcaaccatgcaaaatggcaagtcaggaatctgccacggctttatggtcatcaatctcaacgcatttggtgatggtgaggcaatcagtcagcacctttctgaatatctgcaaaagctgcgcgattctgctaaggcaaatggtcacgacaaaatctatacgcatggtgaaaaagagatcctggccatggctgatcgtaaggcaaacgggattccggtcattgataagacaatgactgaggtcaaggatttatgcgattacctggatctggattttgccgactactttggcgaatatcaaccaccaaaagctgagggtatgtttgtcggcaattattaaaataaaaggactttggtggcaatgcatcaaagtccttttatttagttcggcagcttttttggcgttaccgacagcgttttttggccacggaaggttacaaaaccaggcttggcaccgcttggcttatgcaggttctttaccggcagatagtcaaccggtacgtgggcagagtcgcgccccttagagaaccaggctgccaactgagccgcctgcaggatcgtttcttcgctagggttggtatcgcgaatcacgacatgcgagccaggcatatccttgacgtgcagccagatttcgtttttattggccgttttaaaactcagccggtcgttttgcagattgtttttgccgaccaaaatgaccgtaccatcagtggcatggaagacttcaggtttggaaacgggaatcttgcgctgctttttaccttttttatgcttagtcttgatgtatccctgttgctggagctcaagccgaatctcttgaacgtcgctgggattggccaggtcgatctggctgagaatcgtttcaaaataatcgatttctttttgcgtaatcgccatctgctcgttgacgtatttaactgaggccttgagcttgttatagcgcgtgaagtatttctgagcgttgcgagaaggcgacagatcaggctgcagcgtgatcttaagcggtcgattctcatcataaaaattaggcagctcaactgactgagagccacggggaacctgatgcagccaggtagtgagcagttcgcctcggattcgatagcggtcggcgtcagcagcatcagccagctctttttgaaacttcttcatcttgcgctggtcttttttgagttcgctatgcaccacttttaatacctgaccggctaattccttggtacgatcagactgtgccttgttgacatagtaggcatcgagcagctcagaaagcgtggcaaacgactgtagtcttagcttctgggtatcaattggggcgaacgcggcaaaaccggtcttgtttttttcattggtaatcaagaccggtgtcggtgactcaaaatggctcaaaaaggcttggtaggcgcttggcagactgtcgctggccacaagctcggccgccagttcgctagcagtttccggtgccagtccctgatagctggcctgcagttttttggcaagctgagccggatcatcttttagctcgcgaaccaggtcagaataaatctggttgggcaggtaaggattgaaccgcggctgtttaggcggcatgatgaagactgctcccggtaaaagcaggcggacgcggttgacgtcgctgccgacatgcttgatggcatcaatgatcttgccggtcttggcattaaccagcgtaacgttgctgtggcgcgccatgatttcgaccatcatcaccagttccaatgggtcgcccagctcatctaaagtcgagaaggtcagcttaacgatccggtcgttttcaatctgggcgacttctttcaccagcgctccttccagatatttacgcatggtcatggcgaaattgctgggaacagcgggattttgataaggaatctgcgtgatctgaatgcgtggataggatggattggccgagatcagcagggagtagttatggcgattggcgcggattaccatcaccatttcggcaggatagggctggttgaccttggagacgcggccgccctgcagcgtttgattcagctcgtgaaccatagcatgagtaaagaaaccgtcaaatggcatttttgcgttcctcctttgttttgcataactagtctattataacgttgattgccatctaaaaccaaatcagaccaacgatttatgaaattaaggcaactggaattactggataattggttttgtgagttgaatgtgctatcctattaaaatgcagaccttattttgaggccggcagtttttaacatgctattatttttctaaaatattattttaaatctgcaatcatactggaggaaaactaaatgaaaatcgcggttgtaaccgacagtaccgcttatttaaccccacaagaagctgcggagaatcagattacggtagtgccgattccactggtgatcgacggccagagctatcaagaaggcgtcgacattacgactgaagaattttacgacaaactggctcattcaaagtcatttccaagcacctcgcagccatcgatcggtcttttgatggaaacctatcaaaagctggctgatgaaggctacgatgccgtcatcagcattcacctgaccaaggcaatctcaggcctgctcaacacgattacgcagattgcccaagacatgcaggatacgatcaagatcatcccgtttgactcgcacttgacggtcaagatgatgggctatctggccttggaagccgctcaattagctcaggcaggcgatgatctggatgatatcttaaaaaagctgcgcgaatatcaggatacgttcaataatgtctttgtcgttgacgatctgcagaacttggtgcggggcggccggctttccaatgcgtcggcttttatcggctcaattctaaagatcaagccgcttttgacaatgcacacgcaaaactatgccattgaagcatttgaaaaggtgcgctcaatgaaaaaggccaaggcgcgctgtgaacagatctttgacgaagacgtggccaagctcgactatccggtacgggcaatggtgctgcatgccaactgtcctgaagaagggcaaaaatggctggacaagctgcaggctgatcaccccaacattcgctttgaattgagctattttggcccagtaatcggcgttcacctggggcagggcgcgctggcactggcttggatgcaggatacggctaaaaagccactggactaagcctatgcagcagcgaacaaaagactgtctctgggcacttggactaacggctttaatggtgatcgttggtctgctacgtctgtcaacgccactgccgagcggacaggttgccattgagctggccggagtcattgggctgagtgcaatggttggcttgaatctgcgctggggtgccggcattacgacgatgggaacggtcattctgctcttgcttggcaaggccgattggatgacggttctggatatggccgttgacatggtgatggtcagtgccttgattggctggcagctgccacgcgacgttaaggtaacccatcggcaggcgattggagtcggcgtggcagccggcatctcacaatggattacggccgaggtgctttgcggcattgcaggggatgcatttgctcatggaacgggcatcatgccttttatgcggctggccctgcctgcgacgctgctgacggccctgttgtacatgctgctgattccgccgctttcgctggtgattcggcattttaactggcagccgccgcaagatagcaatcagtcgaaaaaaacgcgttccatggtaatcgacctgagcgatcatcagggaatgccgaaagaacaagatgatcatcatgataaggactaacctgatttgaattgacaaacgcttctggttaggatattcttagattattaaaaaataatgaggtgaactgatggctattcaaatgatgatgcaaaaaacgtgctgtccatgctgcatgcattgccgcgtgttttttgctctgccatcagattgcatgaccaaatgatgcagccgtgacaggttgctgatcgagtcaagggattactggcggtgagctggtagtcccttttattttgtaaaggagaaaaattatgaaaaagccgataattggcatttcaggcagcgaactgaccaaaaatgtcggtcctttcgttggctatcgccgcagctacgtcaacaaggactatagcgaggcggtcatcaaaaatggcggtgttccgatgattattccattcaatgaggatgccgatgtaaccgagtctcagctggaactggttgatgccttgattctttcgggcggttaagatattgattcggaaagttatggcgaagagccgcagcctgaacaaggcacggtctggcaggcgcgcgatcagtttgacatgcggctgttaaagctggctgaaaagcgcagcatcccggtgctgggcatctgccggggcgctcagctgatcaacgtctttcacggcggctcgctctatcaggatcttaagtactatccggtgcagacgctcaagcattggcagggcgatacgccatggtggcaggcgacgcatcaagtcgagctggttaaggatacgcatttggcggtgatttttgaccaagtgcctcgcctgcgggttaattcctaccatcatcagctgattaaaaaagttggcaagggactataggtagaccaaaatatacaggtacctactttcgattcaaagtcagcgaatagtaggtagttatagatccgcagccagttaaaaactgattttcttcacaaagtcagcaggcagatagtcgtaaaaaacgctgtcggacttatgatttgtgagtaaacggatattgcgataactcagtaacaaaagcagtcgatatcgctaggcagccaatgtctaagctcagaaaaatcattaaaaacgcagcgcgatgatgagcaaaatggggatgtccgatacccttgaaaattgatttggatcctgtctacaggcaaacaaaacaggaatatccggtgccataaaatcgtgactagcaaaaaaggccatctttaaacagctgaagatggcctttgtcgttcgtggtttaggatggaaaacagggtagggtggattactttttgatcagttcagggtcgtttttaccgggattcaattcaacgatcttgccggtttgagcatagacgatccattcagcaatgttgacgatatggtcgccgacgcgttccaactgacgactaataatcaagtagacgtcagaggcctttagctgctgcttgtctttgacctgctgactcaaaaccagttgccgcagctgcagatagagccggtcaaccttgatgtcttcgctggcaacggcataggcagcgtcactgtcatcattgacataggcctcatcaaccttgtccagcatctgacgcacttggtaggtcagttgttgaatcagcttttcagcggcagtaaaggttggcttgtcagacatgcgcagcgtttgacgggcaatgcggatcgcggcatcgccaattcgctccacgtcagaactggcctttagaattgacatggtttcacgaaaatcagaggccatgggatttttgcgaatcaagacgtcaaaaacgttcttttccagttcgacctcagtttgattgacctgctgatccttggaaattacctgtttggctaggatcgtatcatgttccaaaaaggatttggttgcttggtgaatctgcgagctgaccagtgtccccatggcaacgaactgcttttttacctttaagatttctgctagattttgatctcccattataaactccttttagccgaagcgcccattcaagtagtcatcagtcagctgattgtctggcttttcaaacatctgcttggttgagttgaactcaatcaaagaaccattgagcataaatgccgtgtagtcagagattcgggcagcctgctgcatattatgcgtaacgatgacgatcgtgtattcatcttttagcttcatcaatgtctcttcaatcaaaccgctggaaatcgggtccaaggcactggttggctcgtccagtaagattacctgcggcttgacggccagcgtgcgggcgatgcagagtcgctgctgctgaccaccggaaagacccagaccgctttttttcagatcatctttgacttcatcccataaggcagcctgtttgagactttcttcgacgatctgatccagctgttccttatccttgatgccgccgatgcgtggtccataggcgacattatcatagatggaaagcgggaagggaactggctgttggaagaccatgccaatccgtcgccgcagctcaaccatatcttcttttggatcataaatgtcttgatcattaaacagaatctgtccttcaaccgtggcattatcatcaaggtgcatgcggttaaagcattttaacagtgtcgacttgccacagccagacggaccaatcaaagccgtgatcttgtcttgctcaatctccatgttgatgccatgcagtgcttctttagtgccgtatttgagcaccacgtttttacatttaagaattttttccatgatgccctcctagccgaagttaccggatacgtaatcattggttgccttgatcttagggttgctgaagatgtctttagtggagttgaattctaagacatgtcctaagtagaagaaggcacagtaatcagaacagcgcgcggcctgctgcatgttgtgcgtaacgatgatgatcgtgtggtcctttttcagagtttgcatcgtttcttccagtttagaagtcgagatagggtccaaggcactggccggctcgtccatcaagatgattttaggatccatggccagtgagcgggcaatgcaaagccgctgctgctgaccaccagaaagggaaagcgcactgcggtcaagcgaatctttgacctcatcccagagggccacgctctttaaggattcttcgaccatctgatcaagcttttgctggtctttgatgccataaagcttgggcgcgaaggtgatgttttcgcgaatcgacttggcaaatggattaggatgttggaaaaccatgccgatttcacgccgggtttcgtaaacgttaacttgtggggagttcagattgattccccgatatagaatctcaccatcaatgcggcccagctcatcattcattcggttaaggcagcgcagataagtagacttcccagaaccggatggaccaatcaaagccgtgatcttgttttcggcaaagtccatactgacctggtgaagtgaaggcgttgtctgcttaccgtagtatacgctgacgtttttagtctgcattgccagcggttccttgacgggcagcgtgtaggtatcatcaaaagaatattcagccatctgttttcacctctagtttatttgcgagccgacatctttttgtaaatatggttgcctaagaagcgagcacccaggttaaacaataagatgacgatgatcagtacggccgaagccccacttgagattgcatgggcattggaaaccagcccctcagtattcagcttccaaatgtggacggccagcgtttcggcaggacgagtcggatttaagaagctggttgcggaaaatggattccagttgctgtaatcgacgcttggtgcgctttgaccagaagtgtagatcaaagcagcggcttcaccaaagactcggccggcccccagaatcaccccggttaaaatgccaggcaaggcttctggcagcatgatcttagtcatggtcttccagcgggaaagccccaatgaaaggccggcctgacgctgcagcggtgagacgtcgtttaaggcgttttcgcagttccgcgttaacagcggcaggttgaaaaacgttaaggcaatggcacctgagataaccgaaaagcccaggtgcagcttgattacgaaaaacagatagccgaacagaccaactaccacgctgggcagcgagctcaaaatttcgatcgcggtcttaaagacttccgtaacgccatttttaggcgcgtattcggctaagaagatcccagcgccaattgaaagcggcgtggagatcaaaagcgtcagaaccaacagatacagcgagttgaacagctggtcgcgaattccgccgccttcaccaacgctttgggcagctgagctcaaaaactgccagctgatgtgcggcagaccgcttaagatgatatagcccagcagaccaaacagaatcaagaccaccagaccgactaagccataaatgatgcccattgccagctgattgacttttttggcattaagcattgcgtgagactcctttcttgttgaccagttttaccaacaggttgaaggccaaagacatcagcatcaagaccagcgccaaagaccagagtgcgtcgtttggcaaggtacccataacggtgttgccgatgccgaccgttaaagtactggtcagagttgaggctggtgaaatcaggttttctggcatcaaaggcgcgttaccgataaccatttgaacggccagggcctcaccaaatgctcgtgccatcccgaagataacggcggtcaagatcccaggaatggccgagcgcagaattaccttgtagatcgtctgccaaagcgtggcccctaatgcgattgaagcttcacgatagtttttaggcacgtttttaagactgtcgattgacatggaagtgatcgttggcagcaccatgacgaacagcaccgtaacggctgccaagatcccactcccggtaccgccgaaaagatggcggataaagggaacgacgacgactaagccgacgaacccgtaaacgacggatggaatccccaccaaaagctcaatgaccgactgcatgaatgaggctgcctttttaggggccagctcagtcatgaagatggcaacggccaaagcgagcggcgttgcgaccagcgtggccagaatcgtaacggcaaatgaggtaaagatcattggccaggcgccgacttctggcttgccgtgagcgtcagtaacggttggatcccaggtcataccggttaggaagtccttgaggctgacgccatctttaataaacatgttcaagcctcgtgcggcgatgaagtaaataattgaaatgaccaacagtccaattaccgtaatgcagaaatagctgaccaatttgccccaatggtcctgcctggtttgaaaactgcttttcatcagttgatcttgttcattcatcttgcttcctccggtttctctcctttattgattgacgcggtggttatttcttggtaacttgaccgtcagcgttcttggtaaccttcatgtcgtgaatgctgatgtagccaaggttcttaacgtccttgctttgaacttccttagagttcatgtagttcaagaatttcttggtttgacccttggcagctcccttagtgtacatgtgttcataggaccagatcttccaagagttgttttcaacgttcttgtcagttggcgcaacgttgtcaatcttcaaagccttgatcttgttagacttggtgtatgagaaggccaggtagctgatggcaccaggcgtgttggcaactagtttttgtaccgtaccgttagagtcttgttcttgggtcttcatggccgtcttgcccttcaaaacggctgattcaaacgttgcccgcgtaccagaacccttagcacggttgataacggtgatcttttcatttggtccgccgacttgtttccagttggtgatcttgccagtgaagatcttttgcagttggctcattgacaggttgttgaccttcaagctcttgttgacaactggtgccatcccaacaacggctaccttgtgatcctgcagcttcttggcatcgatgccgctttgctgttctgcgaagatatctgagttaccaattgaaacggcaccagattgaacctggctcaaaccggtaccggagccaccaccctggacgtcgatgttaacgccagaatttttgctcatgtagctgtgagccgccgtttcggcaagtggctgcagagccgttgagccgacaatcgtaatcttgttactgtcagttgcagcgtggactgtaccagccgtgccgccaaacaggctaaaacctaaagtagcgacggcagctaaagagataagtgacttcttgttcatgttatttgcttcctttctcaatatcccatgaataaagcatgtacctgagtacggtttataatttaaggcagaaacgtaaagaaaaaagacggttttccgtaaaaaacacgtaatggttaaatttacaaaaacgatacaaaacaaacaattaactaattaaaaatggctaaccaactttgttttgcattatttgatgaactattatcggggataaaactataattgttcgtgttatcgctaaacgttggtaggtaaatagttttaattaatgccaaaaagcttaaaataacctaaaaattacaaagcaaactgcttaataaaattaaccatggcaatcaggcgcaacagaccaatgattgaatggcgattgcttggatgttggtcgtggcagtttacagaatttaaaacaaaacatcgccgacccgaaacaatccgagtcgacgatgctgataaattatttgatgattattggacgtttaagatcaaaaggtcattggtaattggacgcgcgggatgggacagatgccgccagcagcgttgccaccattttggccgccaaggtgcaacgaccagctcatagccgcttttttgaatcaactggctgacaaccaaatattgatcgccaactgccaattgatgctcaatctggtgggcaccgacactttgaagcaagcgttcaatttgcgtcagttggtgcgcggccaggcttatcattaagtctggatcaagatttggcaatccggcggccagcctgcggcagtcgcgtggctcaaaaatatacaaaagcataaagcaggcattgggatgagcctggatcagatgtttgagctgattggcaaatgatggatcgatttcgcggctaaaagaacgtgtggtaacaggaattagaattcgatcgtacataaaatgaccccctaaaatggggaagcagtcatgaatgaactactgatgcggcaagatcattggagcactttcattttagcatcaaaaaaagactttgacccgccttcacgagtaaagtctttgtaaattttagctagtcttcattgtcgcttttttgttcatctttgcggtcacgcttgagacgacgcttgcgatccgatgagctgtcgtcagaatcttcgatcgctttctttttaggcttgatctgaaccaccttgaactggctgacataagcattcttcagatccagtggcgtaaagctgaaatcttcgactctaacgggttgtcccaccttcaagtcgtattgacgttccaagaaaaagccggtcaaagtcgagacgtcggtctgatcaaactgtggaatccggacgttgaagtaacgttcaaagtcgtcaagcggcatcttgccggataccaggtaggttgagttaccttttgaatccggctcctttttttcaatcatgtcggaagaaacgtgatcaatttcttcgccaaccgtaccaaacaattcttcgtaaatgtccttatcggtaataatcccggccgtgccaccatattcatcttggacgacaacgattggcacctgctttttcatcatgatctgtaagacatccgtcaattcctcgctttggtagacgattggaatcttacgcatgatggagcgaatggcctgcttaggattgatctgattttgccgcatgatgtcgtagctgaagatatagcctaagatgtggtccttatcgttattggcaacgactggaaaacgcgtgtacttcttttgaaagtaaagttgggcggcatcagctaccgtagcagtaatatcgatcacgcttaattgagtccggtcgaccatgacgtcatcagcaaccttgtcgttcattcgaaaggctcgttccataaatacgacgtcttctttatccatctcaccagcccgttcggattcctgtgataaggtcacgatttcgttttgggtgtagatgtcttcgtctgggttgaccgagaagccaagcatcttggtaatcagcttagccgtccagtcaaacagccagatcagcgggtagaagataatgtggaagaacgtcattgggtgggcaattgccagcagaatcttaaccggttgatcaatcgccatgtttttgggaaccaagtcggtaaagaccgcgtgtaggaacgtaaacagcagaatcccaatgattgagctgaagttattggcaattgccggtgggaagatgtgtgacttttccagcagttcggtaatatacgtttcaccaatccaacctaagatcagtgacgtcatcgtaaccccgacttgcgccgtagacaggtattccgtcaggtgctcaatcatattttcggcacgtcgtacgctggatgtttgtttgagctcttttaactcggttggacgaaccttgatcaaggaatattccaacagggtaaacagcgctgctaaaagcagaatgaatataattgtaaaaagtgttatgggactggtactaacttccatattttgcaattttcctttcaaaattagctttgcaatcattatagcaaataaaaaggtcagcattcagcaaaatcgctttttgttatgtaagaaatggtccataatagaataaaagcatttattcaaaaggaagatggtgaaaaaatgacggctagattgattgatgatgcgcactggcagatcttggtcacggcagcgcgccagctgaagcaaagtgcgcgctatcaaaatgccagccaaaaagcgccattcgatgccgcctatgcacagctgcaggatctggagcagaaccgcgacgtgacgctcaagcagtttttaaaagtacaggaaagtctggcgcatgccgttacaaggctcgatggtcaagagacgacgacttttgttttgcggcaggcagtcagtgacgctgagctgttgatggagacggcccgctatgtcaatgccagtccactggcaaaagaagagctgaacaaagcgttggcggccgcgcgaaaaatcattcagaccgatgaattcgtgctgcagtcgcaggtggatcaaaccgttgaaaagctgcagcattcagcaacggcactcagtgggattgaaagcgactttagtcaattagtattggttttcaaaaacgctcaaaacgatctgaccacgctgcggtatctgaacgcggatgccaaacaccggcaggcctttaaagccagctttgatcaggctaagcagctgctgagtcaagccgcggccaaccaagaattgaacgccacggtggccgatctgtcgaagctggcgcctgattttcagtcggcagcccaagaaacgattgacctgacaaccagtgaactgttgaaagcgcgcaaggcccttaatggcaagaccagtgatttgacgcagctgaaaaaagcagtcgctaaaatgaccggtgttgatcaaaccaagcgctatcaagcggcctatgactccagacaggctgcgtttgatctggcatttaaggaggctcagactgccttggctgatccgcagacgacgcagatgctggctgatcgcctggtcagtcagcttgatgtaacctatgaaacgttaaatggcgaagaaatcgagacgttcgtgtcgatgtctgagggttcaactgcttcgccgatcacagctgaatcaagggatgacgatgccgggatgcttcaaaatgatgacgatcaaaacgataccgaagctgaaactaagccggctcaaaacagtcatgatgatgcgtcccatactcaaggccaatcaggagtggtccagacggcgacattagcaaaaccagattcaaccaaaaaaagcaagccggctactgcggcgttgagcagcatgctgggctttaaacgcaattcaaagtagagaaaggaagatctttttggaaaattcgataacgccggcagaatggcaggtaatgcgggtagcttggacgctcaagcatgttacaagtacgcagatgatcgaaattctgcagggcaaggtagcttggaaaccggccacggtcaaaacgctgctgcgccggctggttcaaaaaggcgccttaaaaactacgcgggttgggcgagcgtttgtctatgagccatgcgttgaagaacagccgacgatgaacgaagctgcggatgatctgttcgataatctgtgcgatatgcacgttggcaagacgctggcacatgtgattgaaagggccacgctcagccaagcagacatcaggcagctacaggaactgctgacccaaaaagccgcagtggcaccggttgaggttccctgcgactgtgttccgggaatgcgctgtgaggatatgaactgataccgtcaattcttgtctaaacaatgatgctatcggcaagacgcgctgaaaggaagtgtcgctggtgatcgtgcccccagagctggatcagtcattgttcgttgaccagcaccatgatcaagatcagctgctggtagttcttggcaatggctttgatctttttcatggctttaagagccgctatcaggatttttggcagcacgtgggaacgacgccgctggatgagatcgttcattttaatcgccgcgcccgcagtcagcaggtccgctggtcggatgtcgaggcccagattcgcgtggcggctgaaaatgcctatcagctaagtgcgacgcgtaagatgccaggagcgggcgtgatggttcagcagcgcagcacgcgggcgattcgccgctttgagcatgaattctcccgttatctgcggacggagcgagaacgcgtcttagtcagcgaccctacgcgttcacaaaccgcgcgggaatttttaagtcaggctggcgcggttttaaactttaactataccgatacggcacagcagctgtatgatgtctggccagagaatatctactatctgcatgggtcgcttttggaaggtcagaccattcttggggttgacaatgatgacgtattagcacgcgaaccttatgaatatgccagtacaaccaagggctaccggcgcgacattcttgattttaaacgctgggcctggcagcagaatggctggcagccgcttaccgaaaaaacactggctgcctttagaaactatgatgcctattattatggctggcggcgcttgtatccagtctttggcgatcaagagattatctcgctgctctatacgcttgacagcgatatgcccgttaccagccgctattttgcaacccgcttttttgagcagtggcaaacgcggcgccagtggctgattgatgcgattgccagccgctgtgctaaaaaacgcattgatcctcaggtgctggcctataccgcggcaaatgcatttcggccgtttaagatcaaactgcccaatgacgtctatccagaagacattgccacgattgttatcatgggccattctttgcgggctgatcacggcatcttaagcgatctgttcaagacggctcgtcagctcaagcaggttattttgtttgtttttcaaggcgagccgcctgaagaactggccatgcagaagcgaatgctgacctggcttttgggtgagggcagtcaggtcaagattttgacgcttgaatactgaaaggagaatttttatgaccagaattgcgatggccggcaagtttgcaatcgaaacgcgtaaaatcgtctatatgtcaggtgattcgctggctcccagagaaggaatcgccaatttaagcgagctgccgccagaaaccagatttagctggcagaaaaagccggtgctagaaacgccgggactgacgcaggcaacgatcatggttgagtatccagatgcctcacaagcagcggtcaaggtgccaatcgaggtgctgccgcgaccggtaaagcaaaaaggacccagtcaaaacgtctcgattcaatttgatcatcaaaacaagcgcacgccgggaaccattctgtcaggcaatcagcgcggtacgatggtcgatgcgtttgcgggaatcggactgttggtcaaggcggtcaagaagggactgtccaggcatcagcaataagacgactggaggggatggcgtggaaaacagcaaaaccagcctaagcgaactgattagtttggaacggcccaattggcagcaccagccgaaaaacgccttgtcagctgccaacgcggtcacgacgctcaaacaggttcacgaaatcgttaatggtccagccaggctgctcagtcttgatctggagttctattgcgatggccagccccagatgccgggaaccacgcggctgggccagattgccggccgtgtctatggtcaggatgacgcattcaactattatgtattcagcagcaaaatgacgcctaaagatcagctgagtctgttgaaacgccttgatctgcgctattcagaagcagaacggcttacggtggccagcgttttgaaaaaggtgctaaggtttatcgaccgcgtgcagccagactacctggtcagctgggacaatcgcctggatcttagcgtgctcaatcaagaggccaatcgcctgcagctggcggaaaccagtcgttcttggaccagaattcagccattggatctagagaagatcatcagcagcgacgtatttgagaaaagctcaggcatcagtctggccaggatgtgcgatctcttgcagctgcagcatcctaagcctcatttggccgatcatgacgtcttgatgattgataagattctccagttttacgcgctggatttaaataaaattctgcattaaaaaattcccgttcgatctgagcgggaatttttcgttagaagcgttttttatgatgtttcttaagatagcggtacagctcgcctaaaaaaaggccaatgatgataatgatggcaatcgtgtagccggccgtccccagcttgaagatggcgggatgaccagcactgccttcaaccagaattgaagagcccaagatgattgccgctaagacgatgacgatcaaaagccgattcagcatgcgctccagatttcgtaagacacgagcctgatctttgtactggaagttgatcttagcctgaccagtacttaaaacctccagcagatcattgatgcgcgaaggaatagctatcgaatcgagggcggtttgccgggcctgccaaatgctgctttctagtgaatctctccagttgaagtgcttgagcagatattttttggcaaatggcttggcaacctccatcaatgacatttcaggatcaagcgcggctacgatgccttcaattgagctgaatgccttgattaaaagcgtgacttcaggcttgacctgcagattgttctgtcggcacagcgagatgatctgaaacaacattgccggcagatcgataccgcctaagcccgtgttgagataaggagccaaaaaaacggtcagctgactatagaattcctgctcatcaacctcgccagtccgattacagatgccgagaattgcttgaccaacctggcgggcgcttttggtgttaagggcgattacaacctgagcaatgccgtccgttaaactaggtgaaaggcgtcccatcatgccaaaatcaaggtagaccaagcgatagggcggcaagggatgatccttttgaatttcgatttcgtgacggcccagctgtttttggtaattgagatcctttgccattgcattgcgcttgggatcatctttgggcaggtcgtaaaacaaaacattgcctgggtgcggatcggcatgaaaaaaatgatcctcgaaaacctgcttgataaaattttcgaccagaacatgcgccagataatgattgcgttctttaagcctggccgcgctggtttcatcaagcggcattttttcgttcatcaaatgcttgatgctttttcccggcatggcttcattgaccagaattttttgcgtgcagtactgaggatagactttgggcacttcgatgatatcaaagccgttgttgagccggtaaaattcctggccgttttgaacctcagtcgtcgtatcgatctcatgaaacaaagatgtactcagctcgtctaaaactcgtttaggatcaattaccgaaaaatcaattggaacgtgcttggccatgcctaacgcgcgtttaaacaatgccagatcggtctgcactaattgagtaacggcagggtgctggaccttgacgacgactttcgtaccatcaaagagcgtggcatgatgcgtttgtccaattgaagctgaggcaaaaggcgtctgatcgaatgtctgaaaaacatcttcaatccgcttgccggtctgttcttcaaaagtctgttcaacggtcgcatatgagtcaacgtcaacctgatcctgcagctgacgcagttccttgatgtagtctggtgagaccagatcggggcgagtcgacagcagctgaccgatcttaataaaggttggccccagctcctctaaagcctgccggatctcttctgggtgtttttgccgataaaagttggttagaaacgaatgttgatttaagactttaatgatctgcttgagacgagtcttttggctgatcgttgtattttcttcattcagaaaaatcacgtccttatttgataaatcattagcttcattatagcaaaacaagcactccccgcgttgacgaagagtacttgtttttagtcgagattcagttcatagacgttgcgcaggtcgcgatcagtcgggccagtgtagacttgtccccgcttgacgaagccgaagttttgcaccaggttgtgaacgcggtcgtttttatcgtgagtagcaatgcggaagttgcggaccccagcgtcataagccagcgtgatcatatggctcataatgtagttggcaaaatgcttaccgcggtatttgccagagattgcaacgcggtgaatcgtggcaaacgggtgaccaggacgattccatttaccattgacgatatgcatgtaatgagcatcgccttgcgtcatcagagttgccgtcccaacgatttcgttgccatacatcaaaagccagcagcagccgccttcgatatccatttgaaaggtcaagcgcgtcgggtagccgtcttctccccgccattgttcgctaccgtcagccttcaaaagcgcgcgggcattttcaacgatttccattaccgtatccagatcgtttaaagtggccttacgcatgtaaatagcttcactcacttttcttcacctcttgaaatttaagataagctttaaaagtttaagcctatttttttaatttgccaagtagaaattatttattttcataaactgcaatttcaatcaggttttggtcgggatcgtgcaggtagatcgactgcatgggaccttctgcgccaagccgatcaactgggccgacaattacatcgacatagtagctttttaagtggtgcaaaatagcatcaatcgggtcattggcaaccaagcagagatccgcactgccaacggttggcttgcgggctaccagggcatcacgatcggctttttgaaggcgaatcagctgatgcccacagcgcagggtaacaacaccaggcttggtctgctggtcgattaccggcatgtcaaagacttcatgatagaaacggcgggactgttcaagatcactgacggttaggacgacgtgatcgatacgacgcattttcataggttgagacctcatttcaatttattgatcgaattaattatagaactcatgatctggcttgaacagtctatgataagcttaaaaagactgtttgaattcaaaaggaagtgagtaatcttgactaaaaatctgcttagcgtgatgctgtttgcatttgtcggcggctgtctgcgcgcaggctgcggtcagctctggggcagcttttgggggacgattctggttaatctggctggtagttttctactggcttttctgacctatcatgccgtcttgaaagagcagctgaccggctggctgaatctgggaatcggtaccggtttagtcggttcgtttacgacgtttggcacgttttcgctgcagtccgttcagctgctgcagcattcttttttggctggagtcggctttttgacgattaacctgctaggtggctttttgatggcactaggcggctttaaactggcactgcgtttaaatcaggagcgaaacaatgactgaaatgcttttaattggtttgggggccagcttaggggcagccttgcgctggatcttgacgctgacttggaaaaaatggggccgatctggctggccaatcgcaactttattcattaatctgaccggctcttttttgattgggtggatgtcaaacattgcaatgacggatagtttgcgcctttttttaacgactggattattgggtggctatacgactttttcaacctttaatacagagctgctggcgatgcttgatgaaggcaaaaccgcgcgctggtggggatacatgctgatcagcgtactgggtgggctgggatttgcctggctgggaatgtgcgtataaaatacattttatattcgttttatctaagatatttttgttgatttgaacaaaaagctggatttattttctgcttttgcccctaaaatcaaataaaagtagtataattatgcatataagcttaactggtttaggcagcaattattcattaagttaggggttattttgcaatggagcaagataaaaagaaaatcgggctggctaatttgaccatgatgattttcacgtgcgtatttggtttcgccaatacgaccgttgcttatgatcaaatgggctatgcctcgattatttggtatattctggcagctttgttctttttcctgccatcgtctttgatgtttgctgaatacggctcggctttgaagagtgccaaagggggcatctattcatggctgaaggtttcaattggcgaaaagatggcctttatcgggacctttatctggctgtgttcgtgggtcgtctggatggtctcgacggctgccaaggtttggattccgatgtcggccttcttctttggttcagacaaaacgcagagctggaatttctttggcttgacctccacgcagtttgtcggcattttggcaatcttgtggatgattttcgttacctacatgggcagccgcggggtcgacaagattgccaaggttggggccgtgggcggaacgttcgtcatgatcttaagcggcgtctttatcgtcgccagtctaatcatctggatctgcaatcatggcgcgatgatgcagccgattcatggtctgcactcgtttgtcgcttcgcctaatccacagtttcaatctggcgtcgccgtcgtttcgttcatggtctatgccgtctttgcctatggtggcatggagtcaatggggggcgtgatggattcggttgaaaaaccagaaaagacgttcccaagagctttgatgatcggcatgatcgtaattacggttctgtatgcgttgatgatctttatgtgggggatgtcaaccaactgggagcgcgttttaggtaaagaaaacgtcaaccttggcaacatctcctacgccctgatgaacaacgtcggattggtcttgggcagttctttggggctgtcgcatgtcacggcggtactgctgggcaatctcctcacgcggtttaccggtctggcaatgtggctggcttatattggctcattcttcgtgatggtctactcaccgatcaagtcattcatcatgggctctgatccaagactttggccagctaagatgactaagctcaacaagcatgatatgcccgcttttgccatgtggatgcaggcaatcgtcatctgcgtgatcatctttgccgtcagctttggtggctcggccgctcaacagttctatctgattttgacggatatgtccaacgtggcaacctcggcaccttacctgttcttagtcggagccttcccattctttaagaagatcaaggacctggatcggccgttcgtgttctttaagacgcaacggattgccaactgggtttcggtgatcgtctggctggtcgtggcggtcggaatcgtctttacctgcctgcagccaatcttggatcatgactatcaaaccgcattttggacggtatttggaccaatcttctttggcctggttgcctgggccttttatgccaatgcacaaaagcatggtttcaaggtagaaaaacagcaaaactaagaaaaacaacaaaggactcctcgtatcaaacgagcgagtccttttactttgcgacgacctgggttaagatggtaatgaatcataattgagaggatatttgttgatgggaaaaatcaaagccaatctggccgaatatactggtcattggctgagttatggtggctttttattgataatcgtgctgattgatcaagtaatcgtcgggccgctttttaaactgatcatgactagtctgatgcagcaagggcaggtaccaatcgtctccaagctgacggccatggagatgttttcaatgcatccgttggctttgcttggcagccttatctgcctgtatctatggctggtctggctaagcatcgtctgggggctggctatttacggcatcactctgcttagtcagcgccgttttgtctggtcggtactgctgaaaaacatgtccttttggctaaggcctgactgggtaatgatggtcttgatcaatttcttatggctgatgccgctgggccagggattattctgtgcgttgcgctgggggcacttgaattatccagccttgatgcttgattttttgacgcgaaaaacctggctgctgatcatagcaatgctgctctatctggtggtgttggtgattggctttttaacgctgcctgacttggttgcaatggcagccgatcagatcacgcttaaacaggcacggcaaaacccaaacgccggctggcaaagattagcaaacgcgctgagtacgttgggtggggtgctgattttgagcctgcttggctggggacttaatcatttgctgctgctgattttaagcgggttggaaatatttcctgggaaatgggtgtggggaatcgcgatcatttttcgctcgttgatgcttggcggcggtttttggctgttggccggcgcgctggtggtcatggtgcttagccggcaatcatcagatgaaaggcctaaaaatctaccggcagctgattttcccatctggctgggcaaaggaagctggctgatgattacagtgttgatcttaatgaccagtgtcgtcagtctgccggccgcctggcatcagcccgtggccatctcgcatcggggcgtcacgcaaaaagatggcgtgcagaacactttaccggctgcggaaaaaacgcggcggctgcatcctgattatattgagattgatgttcacgaaacggccgatcagaaatttgtagtgatgcatgacgagaatctgcgccagttgacggggatcaatcgcaagccgcgtcaattaacccttcagcagctgcaggagctggcggctgctgaaaacgggcaccgcgcacacctggtcagtttcgatcagtacttggaatttgcccaaagacaccggcaaaaacttttggttgagatcaaaacgaccccggctgattcgccgcggatgctgcagcatttcaaccaacgctatggtagacagctgcagcagaatcatgcctggctgcactcaatggatctttacgcggtccaaaagctgcatcgattgaatcccaagcttgcagtcatggcgattcagccctacgttttaggctggccagcaagacatgtcggctggaacgttgagtattcgatgctcaatccactgctgattgcgcagctgcattttaagcaccagccaatctgcgtctggacggttgatgatcctgataccatgcgtcaggctgccttaatgggagtcgatggcattgttacggataatctaaaggacttagacatcgcgctaaaagatactgagcgtcatcacgactacgcggcacggctggcagctcagctcaacgttgcgtataactggcataacctgatcgatggtcgccgttagcaaaatgcggctttggtttaaaaatgaaaatggcactggatctgcagccagtgccattttttagtatgattttagccaaactgatggcgagcaatcagtctgctcaaagcaaaactgatcaaaaaggcaactgctaaaaacattaccacgaccaggtatgggtattggtagttgatatccagcagtgcccctgagatcaaggggccgatgatgttaccgacactggtcagtgacatgttgatgccgtttaaaagaccttgattctgctcgctcatcttggtcaaaagcgttgtgatcgctggccgcagtaagtcgaaggcctcaaatacgaccaaggtggcgatgataatctgccaatgcgaatgatcataaataactacgaccgttccgactgcgctcagcaaaaaggcccagcgtaccagcttgacctcgcctagccagagtaccatgcgttcaaagaagaagacctgcagaatcaaggagatgatcccgtttagcgtcagaacggtagcaatcgcgcccagcccgaattggtgaacctcattgacgtaaagactgtagatgctttcaaagccggccagtccaaatgccgcgacaaaaatcattaaaaacgcggtcgtcattgccggactgagcagcgacttaacttgcgtccaagtgctgtcttgcagatccttttgaacgtcttcggtatgcgatttgaattcctcattttgatcgcttggcagtaaaagccaggccaccagagtactgatcagtccaagaataccggcaatccaaaatggcaccttatagccgaagttggctaagatgccgccaagaccgggtccaagaatcagtccgccgctaaaggaagccgacagccagccgattaccttggcgcggtctttcagcgaggtcagatcggcagccaatgccattgaagtcggcacgaccatggctgctgacagtccgtcaaaagcccgtgaaagattaaaccagaaaaggtgaccagccaaggcaaaaacaaactcggccaggccgaaaaccaacagtccccagacgatcaatggcttacgaccgattttgtcagagatgcgcccgacgattggggagccaatgaattgaactagggcaaacaaagaggacatcagccccatttcaaaggccgaaaagtgatattcttttttgataaatggcatgacgggaaagatcaggctcatgccaagacagattagaaactgacagaccaacaaaatccagatggtccgttttgattgcgaactcataaaaaactccttattttaagataatttggcaaaaagaaagcgggaatggacgctgggtcgcatttccgttttattcgctcagctgtttttgtttgatttgactgctggcgcgtttatgatgctggtgggcaccaactgaaatcagcgccaaaatgatgattaagattgcgaaagtcaccagctgagtaaggttctcgctaaaaattgcattgccgccaaatgcatagataaatgagcatggcagcatccccagggcaatcagcggcagcatctgcgtcagtgagaccttaagccggactcccgagtagttgaccagtgcgttgggaatggctggaatcatatagccgataatcaggccaaggcgggggtggggctgattaagcagtttttgcagcagctgatgcttcttgagtttttgtgacagatgcacgcggctaaacagcaaggcaactgccagatttcccaggatgttgccgctccagctgatcaaaagaccgatccatggcccatagcagacgccggctaaaatacataccgcagcaatcgacatgcctgggattgcgttgaatagcgcgatgaccagcattaaaagcagaaagtccttggccccgtgatcacgaatcatcgcagtaagcatgacgcggtgttcgcgggtgggatgcatcagcagcttgatttctggccagtagtcaaaaccaaccttaatcaggacgatcaaggcaaagatgccggccagaatcgtcagccagcgactgttaagatgtagtttttgaggcatcggggcatcttctttctatcggttaggcgttcagtgcctggctcagctcaaaaagcgtttggcgcagcagcggatcatgagcatacagataggtacctttaacgccgcgttttaagattacgtttaaggcgtttaggatcatttgcttctcataatgaatgatctggtcgggatccgtcaagtcagcacgctttttaaaggcctcggtatcggtaaagcgatccagattgacctgcagctgattggtaccaggcttttggctgattactggcccaatgatgatgccggcataattgagatcaaaaccctggcaggtatagattgagccgacctcgtcaatggtttgcggcagctcagcccatggtgtggcggtaaagttgtactggtcccaaggcattttaaagtcgccttcacagatgtagtgcttgccgccatcaagggttgaaggatagccagatgttgaaagaattctggacaggccgacttcttggttgcgcttgacgatcagctgccgcatcttttccgcgtcgtcaaaaatacgaaaatcatagtgatcacaagcgtttttaggcaggggctcaatcaagccgttggtcagctggttgaaccaggcaatcagatcgtcagaagccgtcatgcgaaactggtgcttgagctgatagctttggtgtggataaggcgtgatcagctcatttaagcgatccaaagtccaaaagctcttcatgcgcagaacctgatactgatcaaataccaaaacaacgaccttagcgcgcttaatgatctcaagcagctgattttcatggtagaaattattatagtgatcaggcttgcttaacaatagatgcgcctcgtcaataactacaatgtcggcactggcgttgtttttgtccagctgattgataaacgaggttggccgctgatagtctttttttaacaaagttttgatcggtccggcaatctgtttgtagactttgaggacttcgggatggttgaccaaaaaatagttgtgcgtcccgtaaaaaggactgtctgactgaacccgggcggcctgctgcagacgagcaaacaggtgcgacaagacgacgctcttaccggtgccggcatcacccaggatcgtatagacagcgggaaaatcctgcgttaagtgctgcttggcaaacaaaatcacctcatcgaccagctgagcctgttcgtcagtcaggtttttaaatggtgacagcttttcgatggcttggtttgacatcctgctcctcctttctaaaacaatgcttacttaatgttacgaatctttttggttgccgtcaaattaaaggaattatcaaccgttttctttatttcatgaagtgttgtaaaatagatagctaagaagatcgtttgtaaatttgagaggtggaagaaatgaatcaacatccggatttcctgctgaatgaagtcaacgagccccaagacatcaaatcgatgaacctggatcagctcaaggaattggctcaagaaatgcggcagctggtacttgaacgtgacagtgcagtcggcgggcatgtcggtcccaacctgggcgtgatggagctgacgattgcatttcattatgtgtttgactccccgcacgataaggtgatctgggacgtctcgcaccaatgctacgcgcacaagatgctgactggccgcaaactgggatttttggattctgatcattatgaggacgtcagcggctttactgatccaagcgaaagcccgcatgacttctttaaggtggggcatacttccacttcaatcgctttggcagtcgggatggcacaggctcgtgatctggtaagtcctgccagtcatgaaaacgtgatggccgtcattggcgatggctcgctttccggcggcttagcatttgaaggcctaaataacgctgccaagctcaagagcaatctaattattctggttaatgacaatcagatgtcgattgatgaggatcaaggcggcttgtaccgcggcttaaaggaactgcgcgatacgcagggacaatcagccaacaacatctttaagttcatgggactggattatcgctacgtggcagacggcaacgatctaaagacgatgattgatgtctttaaagaggtcaaaaacatcgaccatccaatcgttttgcacgttaatacgcaaaaaggcaagggctatcagccagccatcgatgatcaaaagaaataccactggcgggcaccatttgacctgcagaccggtgaaagcaagcagtcggcaccaaaagaaagctacagtgcggccgtgattgatgagcttaacgtccagattgaagctggcaagccggttgtggccatcaatgctgcaattccaggcatgtttgacctggaacgctttaaagctgcccatgccgagcgctattttgatgttggcattgctgaacaagattccgtaacgacagcggtggctatggcagctggcggcgcgcggccggttctgtttgagagcagtactttcctgcagcgcgcctatgatcaattagtacatgacgtggccttaaacgaatatcctattgtcatgatcgttcgtggcggcacgatttcttcgggatcggccacacatcaaggcacgtttgacatctcatacatcagtagtctgccaaatattgaatatctggcgccaaccaacgtcgaagaaatgatctccatgctgcgctgggccttaaagcaaaacgatacgccagtggttatccggcagccggaacatgaactgctgcatggcacgccttcccaagacagctatgctacgattgactatgacattgctcatcatggcagtgaggttgccattatggccgtgggcggtttctggcagctgggtgaagaggtctgtcgtcagctgaaggaaaagctcaatatcgatgctactttgattaatcctaagtcagttaccaacattgaccagcgtgatctgcactatctgcaagaggatcatgacatcgtcgttacgattgaagacggtaatttaagcggcggctttggcgaaacgatcgaccgctactatggaccaaccaacatgaaagtcttaaactttggcgcgccgcgtgagtttgctgacaacgtgccgctggaagtactctatgaatggtatcatctgacgccagaacagatcgttgatgatatcgaacgcgtcgtccactcggcaatttactaagccgtctgcttgacaattggcaaaaagcattttatagttcagataatatcatcgcgaatcaattaaggatcgttcagagaatcgccggtagctgcaaaggcgagcaagcatccgaaatcctgtcgcgagctgactacattgaaatatttttttaaaagggtaaagcacgtctttaaacgagaatggtaccgccgtcactggtgtctcgattaagggcgtgttttttgtcttaacgaggtaagcatatggaagcaaaaatgattcggcggctggtcgtcaaagtagggaccagcagtctggtaatgaaaaacgggcggatcaatctgccttcaattgatcgcttggcctattcgctgtctgcactgaacaatgccggctaccaggtcgtcttggtatcttcgggggccatgggggcggggctggccagtctgaataaaacgcagcggccggcagctattgctgagcagcaggcgttggcatctttaggccaagtcgaattgatgcgcatctattctcagcgcttcttggactatcagacgcgaatcgcgcagcttttgttgacgcgcgacaatctggaatatccgcttaatcgcaccaacgtcttgaatacgattgaggtcctgctgcagcaaaagatcgttcccattattaatgaaaacgaccccgtcagtgtcgacgagctggatcatcacacgaccttcagcgacaatgatgagctttcggctttagtagccacgcggatcggggccgacctgctgatcgttttgtcggatattgatggtctgtttgataaggatccgcacaaaaatgccgatgccaagctgattgaaaacgttgcagaactcaccccggcaatcagattgagcgcgaccggttcgtcaacgcgctttggcacgggcggaatggtgaccaagcttaaagctgccgaaacgattttaaacgcggatcggcaaatggttctgtgtaatggtcaggatccgcgggtaatcttaaaggtggtcaatggtcagccaattggcacgcattttggccgtcattcaatcaagccgttagcaattgacaaggaggaattttaaatgaacgagacattgattaaaatgggccagcgtgctcaggcagccgaacaggaactgatgctgctggatacggctgccaaaaaccaggcacttttgcagatggcccaggaccttttagctgctaaagaaacaatcatcgcggccaatcagcttgatatgcagcaggccgttgatatgcccaagaaatttaccgatcggctgctgatcaatgaaaagcgcattgaagacatggcagccggcttaaagaccgtcgcgcagctgccagatcccgttgccaagattgataagggctggtatacggctgatggactgcagattctgcaaaaacgcgttcctttaggcgtaatcggtattatctttgaggcgcggccaaacgttaccgttgatgccgcggccttgacgtttaagagcggcaatgccgtaattctgcggggcggtaaggaagcactgcataccaatgccgctttggccaatgtcttgcggcaatcactgtcagaccaggatctgccaaaagacagcgtacagttgataacggataccagtcatgaaacggctggcgatttgatgcaccttgacgattatctggacgttttgattccccggggcggccgcggcttgattcagcgcgtagttaagacggcaaccgttccggtaatcgaaaccggcgccggcaactgccacatctatgtcgataaggacgcgcagctgaaaatggcgcaggcaatcgtggtcaatgccaaggtgcagcggccatccgtctgcaacgcggccgaaaagctgttgatccaccaagacgtggccgctgcttatctgccggtcctggccaagagtctgcgggctcatggcgttgagctgcgcggtgatgagcgagcccaggcgatcgttgacatgcagccagccagtgcagccgattgggatactgaatataatgacttgatcatggcagtgaaggtcgttgattcgtttgatgatgccgtcaagcatatcaatgcccacagtacccaccactcagaagccattattactgataatctggcaagcggacaggcctttttgaaccggatcaattcagcctgcgtttatatcaacgcctcaacgcgctttacggatggcagtcagtttggctttggggctgagatcggcatcagtacgcaaaagctgcatgccagagggccaatggggctggagcagttgacgacgatcaagtaccagatcatcggcaacggtcaggttcgtcattagttgcttaaaattgacaaacgagttgcataaattgttttctaatgctattctaatagcgtactaagttttaaggaggaagttgaaatgctaaacatgcaatgtgaaatgtacctaattcagctaacctccacctcaaccacaacaatttaaagtggttgagttcttcaatctggatatcaataatgcagccaacagctgatcgaatccgctcaaccacttgctaaatcttaagtgggattgagataggtggattcgatcggctttttgtttggttaaaaataaaggagttttattatggaagagcagaacaacaatcatctgcgacggtcaatgacgactggacagatggaaatgattgctatcggtgggacgatcggcagtggtttgtttatgggggccacctcaaccattaaatgggccggtccatccgttctgttggcctatgccgtagttggtctggttttatatgccatgatgcgggctttgggggaaatgatctatttaaatccaggtacgggatcgtttgccgattatggtaccaaatacatcaatccattgtcgggatatctggttaaatggagcaacgtttttcagttcattattgtcgggatctcggacgtcattgcgatgtcgcagtatttgaactattggtggcccaatctgccagactggctttccggcattattctgatcgttatcttgacgctggctaatctggtttcggcaaaggcctatggatcattggaattttggtttgccatggttaaggtcgttacgattatcttgatgatcgtggtcggcttgatggtgatcgtctttggtttgggcaacaactggcatccagtcggtctgtccaatctttggtcgcacggcggctttttcccgaatggttggaaaggcttcttcttctcactggcagtgattgctggttcttatcaagggatcgagctgctggggatcgcggcaggggaaacggcctcaccgcaaaaagccatcgttaactcggttaaatccgtgatctggcgaatcttgatcttctacattggagctattttcgtgatcgtttccatctatccttggaatcagctgagcgcggttggctccccatttgttgaaacgtttgaaaaagtcggcatcacgggagcagctggtctgatcaactttgtcgtgttgacggcagcaatgtcgggtgccaactcgggaatctacagtgccagccggatgctgtttaagctgtcggttgatcatgaggtttcgccattcttctctaagctgtccaagcgcgtggtgccaaacgtcgcgattttgacgattgccggctggattttggttggttttatccttaacaccattttgacgcagatgagcaaaacggcttccaacctgttcgttatcgtctacagtgcctcggttctgcccgggatggtgccttggttcgttatcctgctttctgaattgcagtttagaaaacaaaatgccgatctaatgaagaaccacccatttaagatgccgctgtatccgttctacaactattttgccacggcagccctgctgattattctggcattcatgtttatcaatccagatacgcgggtttcagtttcggtcggggtagtcttcttggtaatcatgtcgctgatctactttattcgggtccgcaagcatgaagaacctaaggccagcgaagaagctgattttgaaaatgagcatcatttaaagaaacgttaatggaaattaaattagcgtctggtcaattggccaggcgctttttagcagggacagtatgctataatttttaataattatgaaattaaggaagggatcgcagtgaaacatacctgtacgacttttttggctggaaaggcggccacgattgatggatcgactttgatctgtcgtcaagaagactatggcaacgcgtttgatccacagcgctttgttgtcgtcaagccagaggagcagccgcgccactatgcctctaagacgaccagctttacgcttgagctgccggaaaatccgctcaagtatacggccgtgcccgatgctgacgatagtgctggtgtttttgcggccggtggcatcaatgtcgccaacgttgccatgaccgcaaccgaaaccgctacgaccaatgcccgtgtactgggagccgacccgtacaattcggacagcgggattggcgaagaggattttgtcaccttggtactgccttatatcaaatcggctcgcgaaggcgtcaaaaggctgggccatcttttggaaaaatatggcacttatgaatccaatggcattgcgtttagtgatcaagatgaggtctggtattttgaaacgattggcggtcatcattgggcggctttaaagattcccgatgatgcctatgtgatcgcgcccaatcagttcaacattaccgattatgactttgaaagcgatgcgactatgtatgccgctgatctgccggcttttatcaatcgttatcacttgaatcctgaacatggcctgaacctgcgcgagatctttggcagtcgtacagccagcgatgcccgctataattatccgcgcgcctggtacgtgcaaaagctgctgagcgatgaggaacaaaaacttccgactgaccaggatctgccgttcgtctgtcatccaaagcgcaaactggcgattgaagacatcaagcaggcaatgagcatgcattttcagcataccgactttgatccatatggtcagggatgtgcaaacgatcagcacaaatatcgaccgatcgcgttaaaccgcaatcttgaaattcatatgctgcagatcagaaaccatgtaccggcctcgatagctggagtgcactggctggcattcggtcccaatacgtttaatgccgtggtgccgttttatgccaacgttgaagacacgccggcaccatataagaatacgaccagcgactttgatctgcagaatatgtattggctgacgcatacgctggcggcgctgggcgatcagaactatcagcgctatgaaatgatggaagaaggctttgagcagacggttatggcagcctgtcgtcaactgcagtcccaaaccgacgcgcgcgtgcagacagtcgatgagatcagtgccgaactgacgcaagtcaatgatcagatggcgcagatttcgctgaccgagagcaccaagctgttgggcaggatggtcaaagaagcctttaaacacgagaaactgcaatattaataatcatttgatagtcaaggagaaataaatgaaaaagaaaacgcgtcgagtcctgcattggctgacggctttcgtagttttgtttgcccttagtagcctgatcaagccggggacgcagactggcaattcagccacggctaccagcaccgccagcagttcagccgttttagccagtcagttaaaagaaaagctgaatggcctggttaacaagaccagcagctcaactggcagtcggcagggttccagtacgctgatcacgcccagtcagagcaaggccgcctcggttttgtcagaaggcgtgaaacagcagctgggcggcagtctgacctggaatgggcatggtgcatacatcgtcaacaataaccagacccagctgaatgccagcgtcagcagcgcgccatatgccgtcaactatactgacagccgcgggcgagcctggcgaggcgaggcctggctgaacaagacgacgcgtcagtatcgcagtcgtgaccagaccggcaacggcgctaccagttggaaaccagcgggctttttacaggcaacgaatcttaccaatggtccatcgcatgcctatgaccgcggccacctgctgggttacgcgctggttggcggaatttcaggatttgatgcctcagagtcgaatccgaaaaacatcgccacgcagacggcttgggccaatgaggcagccagcgagagctcaaccgggcagaactactatgaaggactggttagaaaggcactggaccaaaacaagaaggtgcgctatcgggtaaccgatatttatgatggtgccaatctggttccatcaggcgcacatattgaagctaagtccagtgacggcagtcttgagtttaatgtcttcgtgcccaacgttcaaaataatattgtagtcaattacgcaactggcgccgtaacggcaagcaattaataaaaaacagtcgacgaaaattacgtcgactgcttttttactgtgtgtctttaatcgcgtcaatcaactgtaaaatcgcataggctgctttatcagcctgctgtggatccatcgattttagctggtagattaactgattaactgaaagagaggtttcgcggtcacgctgactgtcctcgaccaattgtgcagttgagatttgcatggcgtgggcaatcttgttaagcgttttgatgctgacgttttgatcacttgttctctctaatcgtgagatgaaattgacagacaaaccgctttcttcagcaagtttttcttgtgttatcccgaggcttctacggaaggctctgatattctcgcctatatttaaaatttccggcaccccctctttttaaatctaactaaaaaatttgaaatttttaacgttacgaataaacggtttcacgaaacaatttttacaattaatgcacatattatagaattcacagaatttttgagtaatttgttttttgaataaaataaaatcctggtgagtgcacacaaatttgcttgtcattctttagggccaaaacttgcaaacgttataaaaatacagcaaaatggaacatagtataaaacgatgacgaagaaggaaccagtttatgagtacgacgacgcaaaattcggccagtcaaagacgacgggtccactacgtttttaataatcaagaggtgccacgcttgacgattcgtcagctgtttgacacccgccgcttcagtcgcttgacggcggttaccggggagctggatgccgacttttttaatcagcatctcagcgactttatccaagttgagattgccttgggtgctccagaacagacagcgccgcagactgcagatgaaacagcgaccaaaggagcattgacaacggctttgatggctgccgccaataagcagccggctcgtttgtttgaggccttgagcgggcagaatcaattgaacgtgctgaatggtttgtacacggttgagcaggctcccgtgcaggctattcattcacgcttttatctgcttagcgatgataccggcgctcagacgcgggtaatcctgggcagcatcaacctgaccgcggcttcttttgatgagcatcataatcagcttgaagaagtactggtgtttgataatagtcccttatatgctaattttatgcaacggtttaagaacgatcttaaaccagttttaaaaaattatttttccactgagttgcttagtgccgcgcaaaaacagctggatgccatgaaaaaggatcaaaaagctggtaaagacgtcggcaacgtgatcattcttggcaatgagacgactgaccagatcgcgattgccgatatgaccgagctgatctcacatgacgtccagcagcagatcgatcggggaatcgttggccaggaaatcactaaggccatgcgcgacattacgactgatcgggccttggtaaaagatgagctggagcgttcgattcatcaacaggatgccatcttcaacctgcaaaaggactcggtttcgccacgagctgccaagccaacgctcaagacgcgcgaaaagatctataaacgagtgcggcagacgctgatgactgatatgacgccgcaggaacgctccgccgagaaaaaatacaccacgtttttgtatgatcggccaatggagcggaatctggccaatgacaacagcggcctgtacgtgccaaacgatgcgggaacctatccaattccatttggtaagctggccaccatcagcgagatccgcgacggcttaaagagcattgatgccgttatgcagggctatgccaagtacgtggtggactacacgcctgattatggccggcgcttttatgaggctattttatacagctttacggcgccatttttatgggagattcgctctaaggccagtctcaatccggaagacggcaatgacgttcccaactttttggtgttgggagctacggcaggctcaggcaagtcaacgctgcttagaattatcaatcagctgacctggaatacggaccgctcactgattgactttggtacgatttatccaaccgagacgccgcaaaagaagctgaagacggttcaggcgttagagcactatatgaagaccggcagtacctacccagtcttggtcgatgagatcgagccctatttcttccagcaggatcaatacagtcggcatctgatcgttgacaccatgaatgatctggtcaaccatccacatgccgtggcgcctttgattggtacgaccaattatgactccgggttcaccatgctgcgagaaacggcgcgccggacctactacctgcagatcgacaaggtgattgacgaggcgcaaaaaggcgaggccaacaaatatatctacaacgtccggcagaccctaaacaacacgctcttcaaggattttgtcgttcggatggccacgctgctcagtgacgacgagacgccatggcggacttttgataaacagacggggcggttggactttttggccaatacgcgcaagcttttcaaagaatattatgagatggcggatctgccattgcctgacttctttgccgatgccatctgcgacgattttcgcgaaagcgcgcggagtcggtgggccaagctgtatctgacgcagactgaggactttaagcactatgccgataagcacagtctgctgtttgacatctctaagctcaatacctttaacggcttcagtgctgatagtattgaagaatatcgtaacgcgctgccggttgagatctgtgtcgatggcatcaacggcaaacgcggcaagtttatggagatcaaagaggatgcctttttcaagtggattggcgagcccgatccctatcttgaagacgccgactttgccaaggaagcagcagcggagccggaacgttcagcagctgccgaaccgccaagaaaaaagaagggcttttgggcacgactgtttggctaggcaatcatctttgaacagccgcttttagttttgaattgaaattagcggtcgaaagggtttacaatatcttctagagatagtttaattaaacaattaactcaaggaaggtttgtcagatgcgttttaatcgagaattttataaggacgttttcttctggggcggagtactgatctttttgtcagcgattttatatcaaggcagctggtcaacctggtttggctattttgatgtcttcttgatcgttttcggtctggcattggcagcgatgaccatggttagcaatgacgtccctaaaaacaaacagtcaagataaaaaggattttagcatgaggctaaaatcctttttgtttgatcagcttgcttagtcttgttccgctttgatcagtacgtgctttttggtttggcgcttggtatggaatttttccaatactggaacgaccatgcgctgataccagtggcgactcgtgagccagcgatggaagcggggcgacagcttagagagtgcaaacagcgccagcaggaaaaatggtacttgagggattacgggcagtgccaacccaataatgccaccgacaaaaccagtcagtgccagcattccccagccgattttctccaaaatgatcagcatacggtcatctcctttataaacgtgacttgattttgttggcaagattatagcacgttcggcttcaaaacgcattgaaaacgaatcggccttgagttttttttaatctttgctcaaccagtggtgcgttataattaggctaggttgatgataagggatgatggcaatgctgaataaaaaacagctggtgatcaagatagtcttaaaacgggtgtggtacctggtttttggcattatcataattgcgatggccgttcagctttatttattgaagggaacgcccagccagcccttgaacatgcatcagctacgctccgatgtcagctataccgatacgccgacgcttttgatcccaggacagggcggcaacacgattaccttcaatacgtttatcaagcgtgctcaaaatgaaaatatcgcgcaaagtgccatggtcgtgcgcgtctcgccgactggtcaggtgcgcgtcaagggcagtctcaagggtaagaaaaatccgctgatccagattctgtatgactggaattataacgtttcgttcaaaccgcagatgcatcagctgacgcaggttctgatcgttttgcatcagcgctatcacgtcaagcgtttgaatatcgtcgcgcattcttatggtgggacggaatttctccacgcctatctaagcaatcagagactacaaaaagaaatcgcgtttcaaaaaatcgtactgttgggcgtgccggtagaagaaagctttggcaccaatactaagtatacggcctggctgtttaaaaagtcgcgggacgcggaattcaagcagctgctgcggcaggtaaaaaaagcacggtttgctaaaaatgaggccgtctacaatattatgggtaaagaggctgatcaaaagacggatggcgaggttcccaacatccagtcgcaaatgatggcaacgctgtttaaaaataccccggtcaaatacgtacagcgctggtatcccaaaaccactcattgtcagctgcatgaaaaaaaggcgatcctggattacgtcatgcagacactttgggggaaatagcattgctgacaaaaaaagagcacggtaaaacgcgctcttttttgtaattagttaaagtgacagtacttatgctgaaagtcggcaatggcattgtattcctgctgcagatcgctgctgagctgaacatagattggtaccagcgcttgatagatatcataggtaaccggatcaggctgacaggttgcggcctttttaaggtgttctttaatgacatcgattttcttgatcattcccagactcttcatacccatgactacggcggccaaggttcggctgtcctgttcttgcggaatggccacgggactttgaaagacatcggccaagatctgccgccacaggccaaaccgggcaaaattaccagttgccatgatctgccgtggttcgccgacgaccgtttccagagttagactgatcgcgtaaagctcatagacggttccctccaaaacggcccgtgccatgtgtgcccgagtgtggtgcggcgtcagaccaaagaatgatccccgggcgttggcattccacatgggggcccgctcgccatttaagaaggggtgaaagatcagaccgtctgaaccagcaggaatcgttttagcaatcttggccacaacatccagactttcttcatgcatcatgttggccagctgcttttctggggcaaacaatttgtcgccagcccaactgaataccgtattgccggcattgatgggaccgccaacgacccagtgctcctcatccagggcatagcagaacaagcgcccttcgatgtcaaagcgcggctgatcagtaattacccggaccgctccggaagtatcgccaatcgtaatagccgtggttccttgatccaaagcgccaacccctagattatccatcggtccgtcagctgcgcccaggataaatggcgtatccattggcagaccaatcttagcggcaatctggctgcgcagtccccgtacctgttcgtatggactggccagctgcggcagttggtcgaccgaaatgccaatcagcttgagggtttccttgtcccagtcaagctcttttagatttaacagacctgaagcactggctgatgagatatcggttttcaaaacgccaaacagccgccagaaaacatagtctttgatgcccagccagcaggtcgtgcgctcaaaaatctcgggatgctcatttttaagccagatcagtttatagggcagggccattggatgagttggcatgcccgtacgctgatagatctttagtcctgcgccgttttgcttcatttcggccgcgtacttggctgcacgattgtcgccccaggtcaatacgcgcgtcagtggcttattgacgcggtttaggccaatcagactgtgcatcatgcttgagaaagagacgccccgcaacgtgccgttgtttagatctgccttaccaacgacctcgtgcagcgtgtcaacgaccgtgtcgaagatttcgtctgggtcttcttctaacatttccggctcatcgcggaatagatgatgtgaacgagacgcgcttgccaacgcattgaagtcctggtcatataaaactgccttggtgcaggtggtgccaatgtttacgccgatcaagtaatccatttgatcccctcatttctagtttctaaatacaagtataaaaaaagccaggcagtggttcaagcatttcaaaagattttgtgaaactactcacgataatttttgagccataaaaatgttaaaatagacaaaaaccaacagaaggtgaaaaaatgcaaaaagaacatggccaggtaacgggaatcatttggaaaacaccggaagaaatggctgcctatcagaaactgcagcagtatgcccaaaagcatggcatcacggtttcagcggctgccaaacaactgctgatgcagagtctgcgccgtcatgtcaactgatggatcgctacgacttaattttttttggcaaaaggacttgcagaattaaaaaaatgcgactattataatagccatattaaaatttaatgagattcattaataatttgtttctaagaatgaataggagtgatcggaatggttcaattttcaaaacgggttccagcagatggtacggacgcagttggtgcaatcctggcggcagcggctgatccatcagtaatttcatttgctgggggcctgccagcgccagaactgttccccgtcgcagaaatgaaaaaagcggtcgatacggtttttgacgaacacggccgcgaagccatgcaatatggtgcatcgcgcggggtaacggaactgcgcgaactgattaccaagcgcgttaaagaacgtgaaggcattgattcaaaggtagaaaacgtcatggtaacgactggttctgaacaagtgctggatctggtcggcaaggcctttattgatgaaggcgatgaagtcttggtagaggatccaacctacctttgtgcgctggatgtctaccgttcctatggcgccaagtttgtctccgttcctcaagatgaccaggggctgcgtgtcgatgccctggaagaagcgctgaagaaccacccaaaggccaagctgctctacacggtttccaacttccaaaacccgactggcaagacgatgccggttgatcgccgcaagaaggttgccgaactggcagctaaatacgacgtcatggtgctggaagacaacccatacggcgacattcgctttgaaggtgaacacgtaccagccatcaaggcatttgacaccaccaatcatgtactgtacatgagcacgttctccaagatcctggccccaggtttccgtttaggttgggttctgggtgatccgaaagttatcgacaagctgacggttctgaagcagtcaaccgacctgcacactgatcaactggcacaatgggcggttgttgaattctttgcgcaaaacgacatcaacaagcacgttgaccaaatcagtgctctgtatggcaagcgcaaggacctgatgattgaaggcatgaagaagtacttcccagaaggtgtcaagtacacgaatccagaaggcgggatgttcctttgggttaaggttcctggggttacggatacggttgagctgttcaagaagtgcttgaaggaaaaggttgccttcgtgcccggtgatccattctttgccggtaagccagaaccaggtactttccgtctgaactactccaacatgcaggaagacaagatcgaagaaggtctgaagcgtctgggtaaggccttgtctgatgctgttaatgaaaacaagtaatgcgaacgattattgagtttagtttcattgatttttcagccaacgttttataattaatgaaatacggactgtcagctgcttagctggcagtttttttgattgattaaggtccgcgacagatatcgctaatgccggtcaggcccagtgagccatatttacgtaatcgataaaaccggataagaattcggaaacacaataaaatcaagccattgcttacagcttgcttaatcaaaaatttatttataaaaataattataggaataaggccgtttaaatttcatcagatcgttgctatcacttatagttagcttctgatcattaggtataccgattgtaacttttagtaaaaataattatattagtggtacgttttatctttatcaatcaaaaactaggatggagggatgacaatgtttcgccgacattcgattctgttttttcaattggcgattatgatggtaatcattgcttcgatggccttgatcatctagtcatcgctttaccagaccaatatgatgattgccatggccgttatgattggattgggcgttttggtagggatgatgattcccagcatcttaatcagttggctgatcattgcattaacgacgctgggcagtgcgattctgctgcttggctatgtagtgatcgcggcaccgatcaagctggccttgctgttcacttttcccgtgattgcttcgttaactttagtcgccagagaactgatcactggctggggctggctggacaaaaaccgcagcgagattcagtcatacgcggcccactatgatcccgtcactaagctgctgactcgctataatgcggtcaagctgtatgaaaagtgcatgctgtatattcatgatcgcgacgacgtcaacctctggaccaacgtatcagccattcattgggcacacagcactcagtttcaacagtttcatgagcaggaatataatcagatgcttcaagagatcgcccgggttttaaaaatcgcccggctgccttctgaatcgctttactatcttgacaatgccacgtttatgattatctctcatgaactgtcagatcgcgtactggagcagctgaacgatcagaccaagcgcctgctcaataagatcgaggtcaacggggccgcggctcagtataaatgggggacgcagaagatcgatcggcaaaacgtggcgcactttatgacgtttgaaaaggttgatcggcatctgcagcgggaaatggagactgacattgtcaccgaatatctgaaaggaaatgtgatcgatggttaggatctttttttggctggcgacggcaattacgctgcttttttaactggcaatggttgtttggtttatctgtaactggatcatctactatcgcattgaggagatggcaacgcatggcttggtcaaaaacgatttaacgcaggccaaagatgatcttttaaagctaccgcctaaagaacacatcaagcggcggttgcaggaactgggggtgaagtcggctgatgatcagtgaaataatgatggtcgtgacgctggtgtcaatctggctttcactgttgatgtcgatcattacgctgagcggagcaaccagtttttggttcaagcacagccagattcgtgctgatgtcttgccattgaaacgctatcccatgatcaccctggtcgtgccggctcataatgaagaaatcgtgattgcccagactgccaaggcgattttggagctcaactacccgcaagacaaggttgaactgctgctgtacgccgataactgtactgacgatacgctaaaggagatgcaccgcttgattgcgcagccccgctattttggccgcaacgttaagatcatcaatcgtcacggtacaggcggcaaggcaggcgtgctcaacgatgccctaaggattgcgcatggcgaatatattggcgtttacgatgcggatgccattcccgagcgcaatgccctgtattttttggtacaaaaagcgctggagaatccagaacgctatgtggcggtgtttggccgcaacaaaacgcgaaacgcacagcagaactttctgacgcgctgtattaatcaagaaatcgtcgtaacccagcgaattcagcattgcggcatttggcacatgtttaagattggccggattccgggaaccaatttcatcattcagaccagcttcgtcaaatcaattggcggctggcgcaatggggcattgactgaggataccgacatctcgtttaagatcatgcagcagaaccgtttgattgcattggcctataactcggaggcctttcaacaggagcctgagacagtgcatgactactactttcagcgactgcgctgggccaagggcaactatcaggtggtgatccataattttagacatctgtttgaccatagcaactggcgcgttaagctggagacgttttattactcatgtacgttcttttggttcaatgcggcgatcgttttatcagacgtgatcttttttgccaacgtggtcacgctgcttttgcggttggtagtgcctagtctgacggtgccatttgcttttggcgaaagcaacatcctgattgcgcagctgcttttattcaactggcttttgatgatcaacctgtacgttttacagatcagtattgccatgtcgacgcagtttggccaggcgactaccagtcagctttggcttgccctggcctcttattttacctattcgcagctgtttatcgtcgtttccgttcatgcggtcatctcggtaactctagatgcgatcctgcaccgcaacggcaacgtctgggtaaagaccaagcgctttgatgattgatgatgggagattgcaatgaagctcaataaatatacctggatctttgttggcctgattgccgcagtttatctgggaaccttgctgtgggtgcggctgaccaatccagtctatctgcagcagaacatgtatcggacctgggaaaaaagctatgtcatgcatcccagagctgatcagtcgtttgtcaataccagtacgaacaacaaccatcaaaaaccgatcgcactgtccgaatcacagggctacggcatgtggattacgatcatggccgctaaaaaaggctgggcaagtcggcaggattttgatcgctttgtcaactattggctggcgcatcgtgattacgttggcgatcagcaccagacgccgacgtatctgatgtcttggcggcaatactataaccggcatcatcagtgggtggctgacgtcaacagtgcaaccgatggcgatgtgtatatcgatatggcattggcacaggctgccagacagtggccgtcaaaagcagactattatcgcagcctggctaagaaactgagcagcgacattctggcctatgagtataatccacagaccagagcgttgacggttggcgactgggtgaccaaagactcgccatattggcggctgatgcgtacttctgacgtgatgccgtttgtatttaagaccttggctgagacaacgggggactcgcgttggcagaccgtcaacaatgcaatgctggatcggctggttgacttgagccgccagcatcagaccggtttggtaccagattttgcctggatcacccgaaattctgccaagccggtcaagccaaagacgatttctaccaaacaggatggcagctatgactttaatgcctgtcgggtgccaatgatgatggcagtttctgatgattcgcgcgctcaaaaagtattaaagaagatgctgcgtttctttagtcatcagcaatatgtcacggccggctactcgttaaacggcaaacgcctggttaagtatcagtcggccagcttttcggcaccgatcttttttgccgtcagtcatcatcgtggcgaaggctttgacaatctgtttgacagtcaaaagtatatcttcagcaagccgctgacgcgcaaaaactattatgacgcgacgcttacggtgatcgtggctttggaaggactgaactaaaatgaagattatgacggtaattggtacgcggccggaaggaatcaagatggcgccagtaatcaagctgctggcccaagacccggctttaaaatcagtggtcgtaacgactggccagcaccgtgaaatgctgcagaccgtttttgaagtgtttgattttcaacctgactacgacttaaagatcatggcgcccaatcagacgctgacccagattaccagccgggtgctgctggggatggaacgcgtcttgcagcaggaaaagcctgacttgattctggtgcatggcgataccagtacgacgatggcggctagccttagtgcgttttatcatcagattccaattggtcatgtggaagctggtctgcgtacctgggacaagtattcgccatatccagaagaaatgaatcgccaattgaccgatgacctggccgatctgtattttgcgccaaccaagctcagtcaagccaatctgctaaaggagcatcatcgtgccagtcggatcttcgtgaccggcaataccgcgattgatgctctgcagtatacggttcaaagcgattatcaccatgacgttctggctaagatctcgccccaacagcgcatcattctgctgacgatgcatcggcgcgaaaaccaaggcgcccccatgcagcgggtttttgaagtcataaaaaaagaagttgctcggcatcccgatgttgaggtcatttatcccgtgcatctaagtcccaaggtgcagcaggctgcccaggcggtatttaaagacgagccccgtgttcatctgattgctcctttagacgtggttgactttcataatctggccgcgcgcagctatctgattatgaccgattcaggcggcgtgcaggaagaggcgccctcgttaaacaagccggtgctggtgttgcgtgacgagactgagcgtccagaaggcgtcaaggccggcacgctgcgtttggtagggacggatccgaaccgtgtcgcccaggcaatggaggaactgctttgtaaccagaccgtctatcaaaaaatggcgcaggctcctaatccatatggagatggtcatgctgctgagcgcatcgttgccatctgcaagcagttcttaaattccaaaaactgatacatattttaagatgatcccggtctcaagctttaggcagctgggatcttttttattgatggactggctaactaactcaaacaggactagactaaaaatgatttgaatttatggagtagggagaaaaaagtgaaaaattatcgaatgcagagcctggtattggtcttgattgcctttgcgcttggctttagcgaatttattatcgtcggcgtcctgcctgacattgccaagacgtttcatgagcctgtaaccattgtcggactgctggtaacgatctttgcgctggtttatgcaatcagtacgcctttgattacgatgctgattggaacgcgcagtctgctgaaagtcgagctggtattatggattgtttttattctaggcaatgcaatggtgatggccgcgcccagctatccgattctggtagctgcgcgggtgatcacggcaatcgtttctggggtaatcatctcgattgcaacgacatttgccaacagtctggcgccgtttgaaaaaagggcggggctgattgcctggatcttttctggtttttcaattgcctcagtctttggcgttccagtgggtacctggatttcaatgcactttggctggcgggccacgtttggtgtgatcgttatcgtcagcctagtcatcttatttatgatgcgagccagtctgctgattgatctcagacagggcgcgtcacgacaattcagcgatcagtttagaatctttggtgatcgccgcatctatatcgggatgctgctgccaatgtttaacctagccgcgacgtataccttctacacctatttaagaccgctgctggcaggaccactgcattttaagaccggcgcgatcacgctgcttttatttctgtatggcttgatgtctttgtttagcaatcagttctctggccggctggttgaactgggcggcttgcgcaaaatgccgcttgtgcatggtctgcagctcatgttgctggccatgctggcgatcagccttgactggcggtggcttgccatgatcgtgattatgctgatcggcacgctgatgtatctgatcaattcaccgattcagctgcattttatcgatatcgctactcatgactatccggcttctttagtcatggcgtcttcgatcaactcgattttttccaattttggcattgcgttaggatcggcaacgggcagtctgttggttaagatgcatggcttgagcgcggttgggccaggcggtgctgtttatgccggggttgcctgtggattgatgattttcttaaaccgcatcaatcaaaaacatggtactgactgagtaaaacgacgactgccaatgagcctttgttgattttaaaaataagtcttgacatttattaaaaagtgattagaattaactcataattaaaacgaaatgatgcccctgggatgagtagtcgctttaagcctttcagagagctcttggctggtggaaaagagcagactttggcaatgaagatggtcctggatcaatggcgtattggcgaaatgagtagtcagtaccggcaagcgaccgttatctcgctgagtcaatgacttgataaggctgttttggcgacaagacggcaaataaaggtggcatcacgaaaaaactcgtcctttaaccagggcgggcttttttattaaaaggagtgattttatgacgttcaaggtagctgttgcccagatcgatattgcattgggcgaacctgaccgcaactatcagacggttacgcaggcagtcaaagacgcggctaaagcaggcgcagacgtggtggtatttcctgaaatgtggaataccggctatgcattgactgaattggcccggctggctgatcaagatggctggcgaaccaagcagacgctttctcgcgccgctaaggaaaatcagattgccatcgtgggtggatccgtggcaaccgtgcgtgctggcggtcaatattacaatacgacctatatctatgatcaaaacgggaacctaaccggcagctatgacaaggtgcacctgtttggtctgatgcatgaagacgacttcattcaagcaggcagtcaaggcagcttttttgaattaaaaggcgtcaagagtgccagtttcatctgctatgatctgcggtttccggaatggtttcggacggtagccaaacagggtgccgatgtaatctatgtcgttgctgaatggccaacgccgcggattgaacagtgggaggcactggttaaggctcgcgcaattgagaatcaagcttttgtcgttgcggtcaatcgcgttggtcatgacgccgaaaacagctacaacgggcattcgctggtcgttgatccgttgggaaacgtaattgccgatgcaggtgaaaaagcaggcctgacgcttgctgagctggatctggacgaattaaagacggtgcgtggtccgattccggtatttaaggatcggcgtccagatctgtatgactaaatcttgccgtattgacatgactaaactttgaaaggaagatcataatggaatttcaacaatcaaaactactggacacgctgccaaaacagttctttgccaatctggttgccaaagtaaatgccaaggtagcagaaggcgtggacgtcatcaacctgggacagggcaatccagataagccaacgccagaatatatcgtcaagagtacccaaaagtgggtggcggatccgaagacgcacaagtattcgccatttcaagggctgccagagtttaagcaggccgcggctgatttttatcaagaaaaatatggtgcgcatcttgatcccaataccgaggttgcgattctaggtggctccaagattggattggttgaactgccatgggcgctgatgaatccaggcgacacgctgctcttgcctgatcctggctatcctgactactggtcgggagcggctctaggcgaggttaaatttgaaaccttcccattactggcagaaaacaactttttgccagaccttgataagattccagaagcaacggcacagcgagcaaagtttatgtatctgaactatcctaacaatccaaccggtgccgtggcaaccaaggaattttacgtcaagctggttgaatgggctaagaagtatcacgttggcattatcagcgattttgcctatggcgcgctgggctttgatgatcaggcaccggtcagttttatggagacgcctggagccaaggaagtcggtgttgaattctatacctactctaagacgtttaacatggctgggtggcgaatcgcgtttgcagtgggcaatgcagatatcattcatgcgttgaacctgattcaggatcacctgtttgtcagcctattcccagccctgcagtatgctgcgatcgatgccttaaagaagccggagcgtgatgccgagattaaaaagatcgtgcaccgctacgaaaaacggcgcaatgccttcgttcaagcagctgaaaagatcggctggcatgcctatgtgccaaagggaaccttctatgcatggatgccggtgccaaaaggctttaccagtgagacgtttgccgatctgttgttggataaggcaggcgtggcggtagcaccgggcaatggctttggtgagcatggcgaaggatatgtccggattggtctgttgattaagcctaagcgcctggttgaagccgttgagcgaatcgagaagctgcatttgtttaattagccaaccgtcaacattcaaaagcatcagctgaaactgctgatgcttttttgttggaatgaaaaatggcttaaaagcagattttgtctttcttttaccagaatatacgacagattttgctgaaagcggttgaaaatgtttcctgaattgcgttatccttaataggtagtaatacaaaggtcttttgcgatctaagagagcctaaaatcgcaccggctgttcgttttaaagatcagatcaaccaagaatggcgtctgccagctcaaagaaaaggcagtatggcagaaaaatcggcatgggagtttgattatcgcttgttccatcaatgggatgatcagattcaaaaaacgcctgcttggacggggtatgccgcgatcgtacgggaaatgcgccaggtcaatgatgcctttttacggcgctaccatgactacctggaacagacggaaatggttgacgataccaggatgcagcagtatctgcgtttggctgatgtttatttgaatcgctatctgattgccagccatccagaaaccctgaccagcgacttgaccgctcccacggcctatctgtttgaatggctgttagagcatggacagatcaaagctgagaacgtgcagctggtaattgatgccatgctggcgttgggcgcgttcgttaaagtggcaggcgtctattccacgctggatgaggatctgtatcgtcaagcggttcgtgacggcggcgatcgggtaagggctttttttaaggcagctgcagcccaggcccaattggaagctaaagacgatgcaccagtgagccgtcaagagattgccggcagtcaggtggatacgctggtacaggaattgatggcgttggccgatgatgagcggttggttgatgcgctggccgacgttttcaatcagacgccggcactgattgataagctgctggttaagatgacgcccttgcagcggcagaatctggctcgaaaactggcacggctgcttgctgatgatcatgatgattgatttaagctgatgaaaagcagtcaaggttgaggcgactaaatacatcggttgttgccataacgtttgactgatgctgggcagcattagggacggtcaataatcatgatttaaagaaccggtccgaatactgcttttgagagggaacgttacttatggctagcggcgttaattcaatgcaatcctgatcaggttgcagttttttaatcgttaccgtaatcagtgcttagcaggattttatggcaacgaggccggggagtacttcgccgtaaagcattgaacgaaaattatcttgcattgcagcaacagcctgtcaatgttttggaaaccaggcttcatcacccgcacaggaagatccctttttacacaaaattattgacacacccttatttttacctactatgcattgattttttgaaaaaagtaggtaatgatatttttatcatatgtgttatacaggattttttgcataatgcctgctgataaccttgattacgatgatattaaagccgtgattcatgattaataaaagagccgctaagaaacaggggagtttcttagcggctctttctcataccagggggggtcctgataattttgacaatggattgcgcgactttttattatggggaggattggttgaatgcagctgtccactcacagccatcacaggggttgtcaaccaatcgtcgcgttgttgtctgcatcagcagacaatcgttccatgcccaaaccagacgaggtgcgttcgtcatgatttatgtttgcattatatcacactgacttcagaatgccatagttaggtctcaaaatcgtcaataaatgtgttggattattaatgtttttaatcttgtttcaatcgtttgccaccaattcccagcatggcagctaaagcagaaagtcctaaaccgagcagagccgaattctgattaccggtctgtggcagctgctgattagcggtggcttggttagccggccggtttgaggtgctggctgcggatgtttgatcaatagcaacggttgggttagttgaattgtcggcaataaccaatggggatggcgtatcggcgactgaactgtttgaatcagccggaatatcgctaggcagagcggcactttgcgaaccagaatcgctcggggtgttggagccaggatcgataggcgtatcggatgccttcaccgcggtctttaaatgtacggtgtaggtagtcggctgcttattaagggtcagcaagccgtccaccggcagatcgcttccgaccagttcatagttttctggaatgctgaccgtgtaggactgcgtagtaccgatatcaccagttaaggtttggctggcaacttgagtctcgttttgatcgtcagcaacataattgattgtaatttgagtcttaactgcttcaaccgtgacgatggtcgtgaccggctcactgactgcaccatcgctgtcgataacggtataggtaatggagtagatgccaggcgtattgacgtctaccgtgccggctacgttggcagcagtcagcgtaagcgtaccatcatcagcatcggttgccgtaacgtctgccaacgggtcaaacgtgctcccttgtttgatagtgactgtagctggagcggtgatgatcggttgggaattggtaccagccagccgcagatgcaggttcttggtaacctcatagacaaacttgcgcgaactgctgcctttaagactttccggcgcgaccagctgcatgccgtcatgagtgtcaaacgttaagatatcgccggcattaagcttgattgcagtcgtaccggcagtttcagcaacgttgccatagaagatcttttggtaggtttgattgccattggcgtcagtcaccgtcaccgtaatgagccaccgtagccattaaactcccattgatcgatcaggccggccgcgcgctccaaaagctgctcgttggcgtttttgatcgtctcgtttagcaggtcgtcaagcatgctgcgcgcattgttggtcagttcaaccgtggcagtatcggccagcttttgataggtatcatcggtaaacagactggcaatgcttggcagaatctggctggatgatgcaacggcttcattgaccgtcgcatcttctttaatgtagagatactgatcagtcagcttgacgtttggattgtcagtagttagtgtatagattccgttggccagcgttcccagatcaaccgtatttgaagtgactggaatcgtcgcgatcgtctgcgtaccgttcatcagcttgatagaagagccaatcagcttgtcggcattgctcagatttaagataatgtggctggtcaggccggtttgtgcgagctgctcattggtaatcagggcgaccttagactttagaaaatcctgatcccagcccagcttttgcatgaccgtcgtcaattgatcgtccggtacgacttgagtaagcatggctacggcggggtagttcaatgaattgagcgccgttacgtcatcaacgcttacacccatcgttgcaaagaaaggcgtcacgttaagctgatagtgctgagcatagacgctgatccagtccttgccgatctggttgaccgtctttccggcaacggcattggtgcgatggtcaatgttgaagtacttgaacgcgtccgtgccttctaggttgtaggctagattcatccacagtacgagccgttctcgatagccaagatccgcccagctttgctttttggtcaggactgaatctaccacgctttgcacgatgctgtctttggaagtcccgaagatccagctgccagtagtgaagttgctgttgaattgactttgataaagcgtaccataaatattgttgaatgagtcgatgatgtacatatcactggctggggcttcatagccgtggccgatttcatgtagcggcagccagttgatcgtcagataagaagcaatcgagctgctgttggcggccgtgtagttgactgaccagtaggcagcaccaattccatcttgatcggcaaaggcaaaatagcgtcccttcaccggctgatcacgaacggtattggtagggatgccagtcagttcatcgtaaagcttgaagacttgattatcgtattgatcaatcagactattcatatcggtatttttaaccgttttgatatcttgataaggaatcagaatctcaatgttgttggcatccatcaaggcaaaagcggctttgctctggtcccattgctttaagacggcaacctggtcactgtcagcggtaaagacgggcagttccttggccgttccggaaaccagctcatattccaacagcaatccgttgtctgagcgttttcaggcgtacgcaggaaaaccgcggcatcgccattgaccgtaatctcgacccagtcggtacctaccgattgcgtcacgatctttttagaagaattgccaatcagctgaattgaaacgctgcccgagtagccattgtcaatgcgccgaatcttgagcgtagcgccatccgacagtaccatgcctaatgactgccgatcatggtaggttcccatatagcggccttccttgttggtctgcgtaatgctggcatcaggcgacaatacgaagccttggtaggtcatggtctggccaacgttaatgctgttggtagtgttggcaagcagtgctttagcttgatccaggcgtgtctgcagcagtgctctttgttcggtcgtcaaatcagcctgctggttatcaagctgattctgcatggtcgcaacatcgctgaccgatgcgccaaaagccagcgcgccattatcaatcagctgtttggtcttgacatccagataggcatagtcgctgatgttttttaatgaaagattattggccacgacaaaaacgaaacggcttaaatcacccaaagctgaggtcttcatcgtggcatcgtcactggtagtgtagcgcgtcttggcttctgcatgctcaatgtttaagacatcgccggcctgaagctgcagtgtttgcttgaatcgatagctctgatcaccaataaagatttgatcaaaaaacgtttctgaaccgcgggtaaccgtaatgtgggcatattgagcgtttggaaagtagctgtgcagctgaccgctggcattgattgataattgaccagccggctgggcagtctgattggagttgtagtaatcgacctgagcaaaagtgtagttgccaagcccctttaacgtccagctggcatcggactgggttacgttgccggtatctggtgtcgtgacctcagtcaagacgtcggctgaagaactggcgcgctgctcgctggctgctgacgaggcggagtcgctgaggctagcggcatcatcggcaaccgcgctgcttgcggcgtccgtttttaagacaacggtattgctgacggttgtgctcacggcggtagctgccttattttcagcagtgtcagccttgatttcatgattgttgaaaatcaggctggtggttgccgttaaaagtgcaaagctggacagcattaagtattttggcaatcttggtgtctgcattgaattttccccttaatattattagaatactgaattttgaatgcggcactaagcattaggaaaccctaatgaattcagcattgattatacattacaaaaggggccgattcccaacgaaatggccaaaaccaagaagttgtatcaaaagattattaaacgaacacttagttggctaatgatcttttgtcgtcagctgctgatagttgatacaaaaaacagcagtgccgcttcagacactgctgtttttaattactccggcagtcagactcgaactgacgacaacctgattaacagtcaggtgctctaccaactgagctatgccggaatgacttaacaaataagtacttaattatattaacacataatttagaaaatgccagtaaaaatcagaaaaaagtcaaaaattttttaaaaggataattaaatccgactaaccagtgctgttaacattgcttgacagtgcagcaaccgcaaacgtttcaactgacaggcacgcaccaatgtcaaggatgttaagcagaccgcataactaaagcggacagctatcatgctgggtaccaggataaaaaccggatcatagagctgtaggtcggtgtcagcatcaaaagtaatcattcttcacaagctttgtcagcttgaattattagtaaaaagtcaacaatgtcaatcgattatcaacattttgtatcgtttgaaacgctttcaaaaattcacaagtaggtttataataaaaatacattttgaactatcaaaagaaggcgaggttgttaattatgtcaattaaaaacgtaacgattgccggtgccggaacgctgggcagtcagattgcctatcaaagtgcgctgtgcggctatcaggttcgcatctggaatccgcatccagaacgggccgaaaaacgaattgcggcgctgcggccattttacaagcatgacctaaagctgaccgacgaacagtttgacgccggcttgaaaaatatcgtttcgattaccaatgattgggaaacgtcatttaaggatgccgatctggtaattgaagccgtaccagaaaatctggacatgaaaaaggatttctacgcgcagctctgctcggtcctgccaaatgaagcaatcattgccagcaactcatcgacctatgtgccaagtcagctggttcaactggtcgatcggccggcaaagttcctgcatctgcattttgccaaccatatctgggtcttcaatacggctgagatcgttggcaatgccaagaccgatccggcggtaattcaagaagtcgtggcttttgccaagggaatcaagatgctgccgatcgttttgaaaaaggaacagcacggctacatcatgaacgcgctgtccgtaccattcttaaacgcagcattgggcctttggggaaagggcgtggctgatccgatcacgattgacaaggactggatgaattcaactggttcgccaatggggccgtttatgtcgatggacgtgattggtctgcggacggtttgggcaattttcagctctcatgctgatacgccagagcaaaaagcaattgccgacaagctgaaggccatgatcgatgccggtcactatggcgttgaagccggtgaaggattttacacctacccgcacccggcttatgaagatcccaactttttaaaagaataaacctgcaaaaaacagcgcgataccaggtcttttaaagcttgatgccgcgctgttttaattatttctagccggaaatcccgtgactttagtcgatggtggttggctcggagctctgattggtaagtgggtggtagctgtcagaaaatttaatcaaaagtggcacgaattgataaatagatgacgcgtttcgatgtttattatgacagagtaggcgtgtatcatatagtcattcactaaacgttaagcaaaggcgggaatttaaatgaactattttttgattgatggccgctatgatgatctcttacggcactatggcttggatcctcaggccgttttgcgccaggcagagttgccggcagacactttgaatcatgaccgatcaccatgaaagaggaacagtactatcgctttatgcaggcaattgatgaattaaagacgatggacgatctggcggtaaagatggcgacggcagaccagatcgagactttttcaccaccgatttttgccgcctactgcagtcataatggcgagcagtgcattaatcgactggctgaatataaaaaattgatcggtccgatgacttatcagattacgtcatcagccgatcaagttacagttgagctgctgcccggggatgccagcttaaaaattcccgcgtttttggcggtcgcggaatgggcctttttaatcggtcttttaaggcgcgcgacaaagcaggaagtaacgccggtcaaagtggtcttgaatgcagctaaacctgatcctgccttggctgagttggcaggaatcaagcttgaatcaggcagcataaatcagatcagtttttccaaagcagacctgcagtggccgtttgtcagctataatgcggcgatgtggaactattttgagccggagctgaccaaacgcctggccgaccttgaaattgatgactctacctcggcacgggtgcgcagtgctttagctgaactgctgccaagcggcgaaacgacgattgatgacgttgcccgtgagctgggaatctccaaaagaactctgcagcgcaagctcaaagaagaaaagacgactttccaaaaacagcttaacagtacgcgagaaaatttagccgttcattatttaattaatactgacattaccacgaacgagattgcgtttctgcttggctatcaagaactgaactcatttttaagagcctttttactgtggaccggcaaaagcgtctcagagtatcgtcgtcagcaccagaatcagtcgaaagcaaatcgcagctagcagtcgtgagcaccattaaatgctgattcagtactaaagccttcctgcagatctaaaaattccaggttgtccgtcatcgtacgctgctcactgaccaaaggcatcgtgaaataagtttggttgaaacggacttccattttttcatccagttgcgatgctgtgtaatccttataccagatcggccctaggtttgagtcgagttgggcgttaaagtcaggaagcttggcgtctttgcttacaatgatcaacttgaaattggcatccaaagagcagttgcctagcttggaaaatggaccgacgccatcatcaaagtccagaattagtttggaatcaggctgcaggtatttttgcagtcgctgctgagcttgaggagtaaaggtaagtttcatgattagaacctcgcttttgatttttttatcagtttatacttatttttagtaagtgtaaattttaatgctcagcggcagttaaaaagtccccgttccaaaataacggaacgagggctttttttaaaacgagctacgaatcgtaattaagatcgtggtcattaatgccagaatcataaaaccttctgaaaaaacgttggccaacagtgcacaggtataattgataaaaaacagtcccaagctggcagcaaaggccacaaatcccatcgtgagcagtgcccgctcatgatcgaccagtttttgacagtgctttagactgcgggcaggcagctggcggcggacaaaaaagataatggcactcgctaagacaagcgtcgcgatgcaaaggacgtaagacaaaataatagtagatgacgacttcatttaaaaataggtttgagccacgcctgagcatggtggtcctttccttgaaagattttgccgctatcttagcagaaaatgccctaaaccacaaatttgaagaaatcatgaagttcgggtctgacaaagatcactaatcgataattagcagaatcgacaaaagataatggctgactagggcaaaatgacagttgacaaggattgttgacgggaataaatagacagtgccgagctgaaaaaacaatgatatctgaaaaaaacttcataagtaaattgattgctgaaacgaaaagcggctgggacaggtgataataaaatagtcaatttttaaatgacttagccagaaacgctcattatctaaaacttggatacggatccaaaaatatcagccgcagctggtttgattaaagcaatcaaaatcgaatttgcacaacgtgtttgcttatgatattttcatgaaaactcgccaaccggctgcaattgatctgacagcgacgtttgttcagcaggtggcagcaaaagagggatatcgtgagtaagcgtcaatttaggctgattaattcaatcagtcatcgttatttgactattgatgaccatattttaagaacagttgatcaaaagcaggcgctgatcgttagtgaagcagttggacggcagctgttaaaaaaggtcaaccggattgctgaggctttggcacaggccaatgggacggcttttaacgaatatcggctggaagaagcaccgctggccacgatcagactgggcagcgaggatctggatgccttaatcgaaaccgttcagctgctgggctgctcttatgaggaagcggcgacacgaatcaagcatcaaaaaatcaggcaggatgatcaaatggcgatgcatcagtattatggcctgtcaattccgcataagattcggtagcaaacaaacttgaaagcgtttctttgagaagatatacttggcttaccgaacgcattgcattatttggaaagaaggaatgatcatgctatttgataaggcaattgtcagaacgccaggcaagtcagtcgtggatggaattgacgactatgctgatgctggcaagccaagctatgaaaaggcagtggctgaacaccatgcctatgttgagctgctcaaaaagctggggatcgcagtcacggttctcgagccattagagcagtttccggactcatgtttcgttgaggatccggccgttgtctttgatgattttgcggtcgttaccaatccagcccgcagtacgcgacaaaaagaacgtgaattcatccgcccagtcctcgatcagttctttgagcatgaccagatttttgagattaccgccccaggaactctggaaggcggggatgtcatgccagttgacgatgatctgatctatgtggggctctcggcacggaccaatcaagccggcattgatcagtttgccaagattgcggcgcgctttggcaagacagtcaaggcggtaccggttgaacaggttctgcatctaaagaccgggacgacctatctgggcgacaacaagctgctggtagccggtgagtacatcgacagtccctgctttaaggattttgatcagcttaaggtccctgccggcgaggactacgcggtcaactgtatcaacactggcaatggcgtgatgatgccggctggtttccctggcgtccaccaattgttggttgaaaacggctttaaggtttacgagaccgacatgtcagaatttgccaagatcgatggcggcttgacctgtttatcactgcggtttagctaaccgttaaaggccgccgcggttcctgccacgacgaccgagaatttattgactataaaaaaacagcgcgtgatcactgattcggcgctgttttatttttgaaatgacttattgggatacaagttcagccagccgcttgatccccacggcaatatcggcttctttaactggagccaaggacaggcgaatccggttatgcggggcggcatgaatgtagtagcggtcgccattttcaatcaagacgcctgaattttgcgcggccgtgcagaattcagctgccgtcatgggcagattgagctgcagccagaaccacacggcaccatcagccggctgccagcttaaacgatcaccaaatgattcagccaagagtttgccggctgcctgatactgctgatgataggccagttttaggccggtaaggtgcttgcgccagagtcggtttcgcaggtaatagtcaaatatgcgctgggacagtcccgaagttgagatatcggcaatccgcttaacgccggcaaagctttcgatcagtcgagtcggcgataccagatagcccagccgcatccccgaggcgaaaatctgtgaaagactgcggacatagatgatgcggtcatcgggatcgtgttctttcatggtatgaagcgtattactatcatacgccaagccagagccataatcgtcttcaataatccaaaaatcatgacgatgagccagtccgatgatgcgggctttttctaagcggctcaacgagtttgtggtggggttttgcaggttgggcatgagatagagaatcttgggctggatgattttaagcattttttccagttcgtcaatcagcgtgccatgattaaaattcagaccaattactttggcgccgcaagccttaaaagcatccacggccccgggataggtaggattttgaaccatcacgcagtcgccctgtctgatcagcgcgcgcgcacagatatcaatcgcctgctgtgatcctgaggtaatctgaatattttggggcttcgttttaatccagcgctgggccagttcggcagccagcgattcgcgcaggggataatagcccatctcgtcttcgattacaaaagcgtgaccaccatcccgatctaagatatggttgacggcttgtttaaaagttgaggttgaaaagcggtctggattgagcgaatagctagcaaaatcgataaagtgctgattggcgtcagtcgcatctaagcgaggcaagtaaggtatctgcgcttgatcagttgccaatgaatccgccatgccttcctgaacaaagctgccagaaccacgccggctgatgatatagccatttttctccagttcacgataggcactaacgaccgtcccagggttgattcctagcgccttagccaaaactcgaaccgccggaagacgacgatcgggagccagctgaccattgacaatccggctgcgcagtgcatcataaagctgagcatagagcggttctttggcctgacgattcagtctgatgttattagccgcgcttaattgatctgcattcaataaggatcctcttttccgtgtcgttgtttcagtcccgtcaaaagtattcatggcttactgtcatcgctggctagccgggctggatagcggaatttgacattaagcgccgtttaagcaatgcgtgcctcgtttttaatggcaaattcccgaaagtatggcagcgtaaacgcgacctggcctggctggggaagactgacgatctggttttcaatcagatgctgcaggcagactggtgcggctgtgctggtatcgtcaatctgctcttttaaaaagccttcatcaacgacgctgctgatctcatgggccagaatctcgattacctcacgatcaccggttgtcagttcatcaacgatcggcaggtaggcattgctgaatagctgttgttgatagtcgggcataattttttcaaacgcagccggattgatttttttaacaccagacccccacagcagcgagccaagaatctgaaacgcgtaggcatagccgccagttgctgccgctatgtttggcaggacttcaggttcaatgacgcgatgggccttggtaaaaatctgctgatattgattggccaccgtatccagatcaagcatgggcaaggtcagccgcctgcttttttgaaccagcgcggcaaagttgtcatcgcctaaaaactgcggcattcggctggtgattctggccagcacgaccatgatcgaattaccgtgattgcccagctgctggcatagctgaagcagagtgagcagtgattcggttggctgattggcttcatcaacggtgataaaaaggcgctgctgatacttggtaagcgtttcaacgtattgaatgaacatctcgctgggagtatcgtagtccaggacgtccagttccttggtaatggcggcattggcttgataatagattgccccgaccagtgtgcttaaaaaatcatcgtgcagctctagatcaaccgtgatccagccatcacgatccagcattgcatcgccaagatcatttaaaaaaacggttttaccacagccacgcggaccatcgatgaagattgagcgaaatccttgctgcagctgatcggcttgatcaagcagtttttgctgcatggctggccgtttgatacagctgggtgagatattgccaaagcctgggttaaatggattgatcatgtttatccctcatttcgactgaagtttgcctttattttagcgtgctggccagggtaagacaaggtacggttggcctaatcagttgcagattgtcaaagatttagaaagcgcatacaatgagagcgtgtattttaaatctttggaaggaataccgattatgaaaacaaaaatcattccagtagcagccgacaatgaaaaagacgtgatcacgcttcaaaaaattgccaccaaatcatttactgccatgtttggaccataccatgaaccccaagccgttaaagcatatactgatgaggcatatgccttaacgattttgcgcaccgagctcagtaatcccgacagtcggacctattttttgaaacttgatggcagaccgattggctatatgaagctgaattggcgtgcggcacaaaccgatcagctctttgacaatgcgatgcagcttcagcgaatctacctgcttcctgaatactgggatcagcacctgggcagtcagcttatggaaaaagcactggatgaggcgcgtaaaactggagtcaaaacggtttggctcggtgtttgggaacataatgagcgagcacggcatttttatgagcggtacggttttaaaaaggctggcacgcatacgtttacaattggaccagatcaacagaccgacttttggtatgctcgatcaatgatgcctgctgactaacttaataacttgccatgcatcagcaggatgattccttggctgatgcttttttagttgtttgattcgggcagcgaggactgttagcgttagcggtgcagacagccgtttttgatcaattttttgagtttttttgaagttgagcgaatcaacgttgagaataggacaacggagcgattggctttaaactgttttaaaacgcgaaataatttctttgctgaagattcttgattaagcttgaagattgttgaaacagcctggtatgctctagatgtttattgaaatcgtttacaaaggggcgtgatgagataatatcgacgcgacagtggaaaatttatcttaaaaactgtcaaatcgggctgcttgataaaatttatgtattcggggggataagaatggacacagcagcaacaccaaaaaagaaaaaatttaaattgaagatgccgggagcatttacgatcctgtttttcttgacggtaatttccgtaatgctcacctggtgcgtaccagccggcagttattctaagctgcagtatactggcggacatcttcaagaaacgacctcattgggacagaaaaaaacgctgccggctacgcaaaaaacgcttgatagattaaacgttaagattgatattaagcagtttacatcgggcgccatcagcaagccggtttcgattcccaatacctatcgacgtcttaagcagcacccagccaagctttacacgatcttcaccagcatggttgaaggaacgatgcaggcaactgatattatgatttttatttttgtgctgggtggcctgattggtgtcgttaaagaaagcggggcctttgaatccgggttgatgtccctaaccaagaaaaccaagggacatgaatttattctggtcttcttggttgccattttgctggttctggggggtacgctttgcggaatcgaagaagaagccgtggcgttttatccaattctggtgccgatttttattgctatggggtatgactcgattgtctgtgtcggggcaattttcttagccagttcggtaggtacgactttctcaacgatcaatccgttttcagtcgtaattgcctcgaatgctgccggaacaacgtttactcaaggtctgctgggccgggtaatcggtctgattgtggcggcagtttgtttggtcgggtacctgtattggtattcaagcaaggttaaggctaatccagaattttcatactcatatgaagacaagcagaagtttgacaagatgtggtcagtggtatctgacgaggaaaaggacctgacctttacctttaagaaaaagattaccctgacgatgtttgcctgcgcctttccaattatgatctggggcgttatggctaagggatggggtttccctcagatggcttcttctttcttggcaattgccattacgttaatgtttattaactgttttggtaaagatggtcttggcgagactgggattgttgatgcctttgttaaaggatcatccggcttggtcggcgtttccctgattattgggctggcgcgcgggatcaatatggtactaaacaatggctatatttctgatacgattctctatgtatcttccgagctggtatcgcacatgaacggggtcttctttatcttaatgatgatgatgatcttctttgtgctgggctttatcgtaccatcttcatccggtctggctgtattagcaatgccgatcatggctccgttggctgatacggtacacattccacgctatattgtcgtaactgcctaccaatttggtcagtacgcaatgctgttcttagcgccaactggtttggtaatggcaaccttgcagatgcttgacatgaagtactcgcactggctccggtttgtctggccagtcgtcgtcttcgtgctggtctttggtggcgcgctgctggttactgaagtcttgattgccggctgattgattttgcatttgcttgaaaaagtctgacgatttcgtcgggctttttttggtgtacaggtattaaactggtctaaaaaaagttaaaatagcattgtcgatatattaacgaaatgggagaggattttatgagcagtaacgcaaaaaaacgcgatcaaaaaatcctgattaaaattgccgtggcgctatgttatggggtgctttcggcaatggcaatcaatatgtttttgtcgcatgccaactcatattcggctggtctgttgggggtttcacagctgctgcaggctttatttttacaaagtggtctgcatatcagtatgagtctactggtcgcggttttgaacgtgccactgtttgtgtttgcttggtatgaattcggctttagctatatcttattttcaatgctggcggttggctttaacgttgtctttttaaagtttattccaacggccaccttggtaaacgacccgctgaccaatacgattatcggtgcggcaatcttgggaatcgggattgggctgtgttttaaccagggctttacgactggtggttccgatatcgtcgtaacttattgtcaaaaaaagctgcataagaaagtcgggatgctgaacaacctgatcaatggcgcgattctggtggtaaccgtcctatgctttggtcccagccggatcgtctatagtctgatcgggatgctggtgaccagcctgatgatggatcataccttcgtcctacaagaagacgtctcggttacgatctataccaagaaatcagctgccgtcgcggaacagctgcgcaatttcgtgcatggggcaacgcttttgcatggaactggcgtctataccaatgaacccactgatattattctggtatgtacgcccaaggctcagttaaacgagctgcgcaagatggttcataacgttgatccggacagctttatcagtatttcacgagctgatgtcgaatttggcaactatcagcactattcgttttagcagctgcctaaatagccgtcagaaacagcatgccgcgatggctgcagcgtgctgactgaatattaaaagtccttatcccgttgttgaagtcgagggataaggactgagtataactaaaagcaccgcgcttgactgatgttggcacggtgctttttgtatatcaaaacacttaatggtgagtggcactgtatttggcaatgctgtaggcgtcaacgccgcgcatggcattaacgacgtccagcggcgtaacctcaaacggcatgcgattcatggtgtcgtttggcgcgcaggctgccttgccgactttcagcaggtttgcttcgcttggatcctcgattcccagctcgacaaagttggttggcagatgcagcttctttaaaaagtggaagtatttttcgaaacgttcagttgccgcgccctccagcatcaattgcgtcagcaggccgaatgcaactttttcaccatgcagccgttcatgaactggaccattcaaaacgctaagagcatcattaatggcatgagccgcagccagaccaccagattcgaagccaacaccgctcatcagcgtattggcttcaacgatccggtcaaatgctttggtgtcggcatgggcaatggcagcggcataagcctcgtcgccatatgcaaacagcgtgttctcgcattcctgggcaactgccaggccaaccagcgtctggtgctcgcctagcatgttgagaccatgcgattttttgacggcctgggcttcaatgttggttgccaaagcgtcagccatgccgcatgccaaaagcttggctggtgccgtggcgatgactttggtatcaaccatgaccaggtcggggttctgattatagaaacgataatggtcaaactcgccattgtcttgatagataactgacagtcgcgaacaaggcgcatcagttgaggctacggtcggcaaaataacggttttggcactcagattgtcggcgatggccttggcggcgtcaatcgttttgccgccccccagaccgatcaccatttcgacatggttgtcatggccgattttagagacgcgcttgatctcattttcggatgattcgccattgaactgaaccttggtaacggtaaagtcgttgttgatcaaataatcgccaaactcattgccaacgatgcgcaatgaggtaggtccagccagcagcaggattcgattgccaagtcgtgccagatattcagcactcttaaataaaacatcgcttccttgaatgtaggaagcaggactgccaaacatattgagactcatttttatcagctcccttcagatgcaaaagcttgcttagctaagttaaatataccatgaaagcgatacctcggtaggcggattttaataatttagtcaaaaaatatgacaatctcggcttcggctgtctgataagctttgcgtacgatttgcatcgtttcaatttgttcagcttaggcataaaaattctggcaagagcatcatggttttagagacacagcagagcagtgatacgacctatcgcttctatgactgggatcgtgttgaccaaacgactggccaaaagcggccgctgcagattaaggaatcgatgtacgacggtgcctttccacgatccagtgctgaatacagaagtatatgaggttggcgatgctaaagtaacgcgttttgtatcaaccaactactttgccgtctatcgttggttgcttaagaatggcacggccatattcaaacgcgtccagagtccctacgcgctggtcgcggttctggacgatcaaggatcaattacggttggtggtaaggaatatccgttaaagaaagggcagcactttattattactaccctggcagaccaatggacgatcaaaggcgatatgatgattatcgcttttgagccaggatcggactcgctaaaggcatagattacaaaaaagaccgtcctgacgctgcacaactttgagatatcatggtatttggaatgggtgcctacgataagggtcaagctacccccgaataaaattcgggggcttgtagacttcacctatcagttcatcgctgaatgagttactagctacaatttgcctagataaagccagcgtagcaacatctcagataataaattatcttcggatggcactatgtcttacagccaataactaggccatttaagatcaagctaacgcttaatctaggggcgcaagtttccaaacgtccctttctaaaactaataaattgcttctagattttggtcgggtctggttagcaagcgttgacacttcgctaagatattcaaagcagcattgtgatcacgaatgtgatgaacatggcagttaggacaagtccattcacgatcatgaagagtcaatcgtttggtacctttgctgcccatcacgaagccgcaatcataacaagtttgggttgtgtaagctggattaacttcgacaaacgtgcgcccatacagcggggccttatactccagcatacccaaaaaggtccgccaaccaacatcggaaatactcattgccagggcatgatttttaagcatatttttactcttcaagttttccgcaactaccaaatcgtggctcttgattagtgcagtcgaggtttcatgaaggaagtttaggcgccgattacgaatccgttgatggattttggcaacgaccagcttctcctgttggtaattcttgcttgcccacaaaggacgatgctcttttttggcacgccttgcccggcgagaaagaatccgttggtgttttgccaagtgctttttgagggcacgataatagtggggattagcaacctgcttctgatcactggtagtaagaaagttttcggtgtttagatcaataccaactgcttgattggtattgggtaaagcttggtggaacggctcatcacttttaagcagtaatgaaacggtccattgcccggtcgcgtagtgcttaattgtaacagtggcaatccgtaccaaccgattagttggtaatgaacggtgtaatttcaccttaataggacctaacttcggtagctggatatggttatgatctaaaaatttgattgacccattataaagcgaaggagcgcccccgtgtttctttacggttgcactcgaataatgattggaagtcgaatatgactgaacaggacggctttttcgcttaaactttggttttccggcagtgtgtactttccgaaacatattccaagcggccttataattaacttcggtattggtgaacatatcactatcaagatcatcatcaccaagccaaggatatcgttgagcagtgatacgagctaaaccagtcggccgtttttggctcttcttaattaccttaccgttcttgtcataacgccaatatgcttctggaattgggtatcgcttatcaagtttgtttttgataattctactatcagtccaactattagctaacaattggttataaatgaaccgtgaagcattcagattcttccacaaaatcttttcttgtttccaatttgggtataagcgtaactttagccccatcatatatggcaaatcatcttttttcggcatgtcatttcaccccctttactaatttcaattgtactactaaatatcggaatgccacatttacaacgccagcactagtcaacgagacgaaagatattctaggcgcattgccgatcttcatgatattacgatagaaaaaatggaagtggtgccagatcatgttcatatgttgatcagttttaagcccaagtattcagcaactaatatcgttaaggcactgaaggggggcagcgcgcgaatattcctacgtaatcatccagaaatcgagcaaaggcaatactgggtgaggcggccatttgtggtcacgtagctattacatggggacactgggaaacatgagtaaagaggttgtagagcgttatattgccaaccagaggacgactaaaagtaacgctggcagaccacctctcaaaagaaaatagcgccttactgcactaataaaggggcattcctcccccgattaaaatcgtgggattcctgcccaagttttaattgaatccaacggtgccgttttgcaggctgactaaaatcattggagcctgattctaagcagtaatcgaaatttataagatcaatcaacgacttgataaaaatgatgtgacatttaaactttcgccaagctgaatgctgcatcatttttcatttttgtcagccactatcagctcagcatggcagactatctgctaatcgggctttgacgcgccgctggaatgctgacgtaaaaaatcaactggagacggcgttaaaagcctgtcggcagcttgaaatggtaatcaatcttgtagtaattattgactggctgaattcggctgcggtatcgacagttttcttgcgtttcaagacgagctgtagataaaaatccggtttagctaaaaataatgtaaaaaagctattgacttaagcaagtttagtcggtatagtaatatatcgttgtcgcgttgatgaacgcttaaaatttttaaagtcattttgcttgaatttgtttgaattatctttaatgccttcaaataaaaaaattcttgactttgaaatgacaacctgttaaaataacaaagttgcttgcttggaataagcgagcaatggtagacctttgaaaactgaatacagtttcgacgaacacaaatgtgcagggtcatcaatcattacgattgatgcaaaaacatttgcgaagtcaattcgcttaatttaaatttgagcttttcaagttcttatattttatatgagagtttgatcctggctcaggatgaacgccggcggtgtgcctaatacatgcaagtcgaacgcgttggcccaactgattgaacgtgcttgcacggacttgacgttggtttaccagcgagtggcggacgggtgagtaacacgtaggtaacctgccccaaagcgggggataacatttggaaacagatgctaataccgcataacaatttgaatcgcatgattcaaatttaaaagatggcttcggctatcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagaacgtgcgtgagagcaactgttcacgcagtgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagctaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgcaacacccaaagtcggtggggtaacccttcggggagctagccgcctaaggtggggcagatgattagggtgaagtcgtaacaaggtagccgtaggagaacctgcggctggatcacctcctttctaaggaattaatcggaaacctgcacattcgttgaaactgcgttcagttttgaggggtctaccctcagcttgtactttgaaaactaaataatatttatttctttattcacaattaaaccgagaacaccgcgttatttgagttttattaacgaaattaatcgcatactcaataactgagtgattggtaagatcatcaaggttaagttataagggcgcatggtgaatgccttggtactaggagccgatgaaggacgggactaacaccgatatgcttcggggagcggtaagtacctttgatccggagatttccgaatggggaaaccaatcatcttagtcgtgattgctgagcagtgaatacatagctgtcagggtagacgcagtgaactgaaacatctaagtagctgcaggaagagaaagaaaatcgatccctgagtagcggcgagcgaaacgggaagagcccaaaccaaagagcttgcttgttggggttgtaggactgaacattgagttaccaaagtggacgtagttgagtcgttgggaagcgacgccaagatggtgatagccagtaaacgaaacgtcacacttcagttcaggatcctgagtacggcgggacacgtgaaacccgtcggaatccgcggggaccatctcgccaaggctaaatacccctagtgaccgataggaaccagtaccgtgagggaaaggtgaaaagcacccgggaggggagtgaaacagttcctgaaaccatgtgcctacaagctgtcggagcaatttacgtgtgacggcgtgctcttgcagaatgaaccggcgagtatgattgcgtgcaaggttaaggggaaaaacggagcgcagcgaaagcgagtctgaaatgggcgtacgaagtacgcagttatgtacccgaaaccaggtgacctacccatgtccaggttgaaggtggggtaaaacgcactggaggaccgaacccgtatcagttgaaaatggttggatgaggtgtgggtagcggtgaaattccaaacgaacttggagatagctggttcttccgaatatctttaggggagcctcgagttgaatcatggaggtagagcactgttggactaggggcccgtcatgggttactgacttcagataaactccgaatgccattgatttttctcgggagtcacacggtgagtgataagtccatcgtggaaagggaacagcccagatcatcagctaaggtccctaaatatattgtaagtggaaaaggatgtggaattgcagacaactaggatgtttgctcagaagcagccatcattataagagtggtaatagctcactagtcgagtgactctgcgccgaaaatgtaccggggctaagcatattaccgaagctatggatgcatccatcaggtgcgtggtaggagagcgttccaagggcgatgaagtcagacgtaaggactggtggagcgcttggaagtgagaatgggtatgagtagcgaaagacaggtgagaatccgtccaccgaatgactaggtttcctggggaaggctcgtcctcccagggttagtcgggacctaagtcgaggccgagaggcgtagacgatggacaacaggttgatattcctgtaccagttgattgtgcttgagtgatggagtgacgcagaaggctaagcgatccgacgattggaagtccggccaagcagcaagtcagttgatgagtcaaatgcttatcagcggttgacaagcgtgaggggagcgaaattatagtagcgaagtcgtgatgtcacgctgccgagaaaagcttctagcgaataatcaactgcccgtaccgcaaaccgacacaggtaggcgaggagagtatcctaaggtgagcgagcgaactctcgttaaggaactcggcaaaatgaccccgtaacttcgggagaaggggtgctgatcgcaagatcagccgcagtgaaaaggcccaggcgactgtttatcaaaaacacaggtttctgcaaacgtaagatgaagttaggggctgacgcctgcccggtgctggaaggttaaaaggaagaggtagctcggcgaagccctgattgaagccccagtaaacggcggccgtaactataacggtctaaggtagcgaaattccttgtcgggtaagttccgaccgccacgaaaggcgtaacgatctgggcactgtctcaacgagagaatctggtgaaattgaattgcctgtgaagatgcaggtacccgcgacaggacggaaagaccccatggagctttactgtagcttgatattggtgcttgtactgcttgtacaggataggtaggagccatagaagccaggacgctagttttggcagaggcgttggtgggatactacccttgcattatgatcactctaaccgcaccactgatcgtggtgggagacagtgtcaggtgggcagtttgactggggcggtcgcctccaaaagataacggggcgcccaaaggttcgctcagaatggttggaaatcattcgcagagtgtaaaggcacaagcgagcttgactgcgagacagacaggtcgagcagggacgaaagtcgggcttagtgatccggtggttccgcatggaagggccatcgctcaacggataaaagctaccctggggataacaggcttatctccccaagagtccacaagacgggaggtttggacatcgatgtcggctcatcgcatcctggggctgtagtcggtcccaagggttgggctgttcgcccattaaagcggtacgcgagcgggttcagaacgtcgtgagacagttcggtccctatcctcgcgggcgtggaaattgagaggacctgtccttagtacgagaggaccgggatggacataccgctggtgtaccagttgttcgccaggagcatcgctgggtagctatgtatggatgagataaacgctgaagacatctaagcgtgaaactcgcctcacgatgagatttcccattccttatggaagtaagacccctcagagatgatgaggtagataggatggaagtggaagtgccgcgaggcatggagcggaccattactaatcggtcgaggacttaaccaagtttagggtgtttcgattgaacgtgagaagaatagatattgtttagttttgagagtgcaagctctcaatcctgaaaaggattagtgtggtgatgatggcttgaaggatacacctgttcccatgccgaacacagaagttaagcttcaacgcgccgaaagtagttgggggatcgctccctgcgaggatagggcattgccatgcattattccggcatagctcagttggtagagcacctgactgttaatcaggttgtcgtcagttcgagtctgactgccggagtcattgaaatactgatcggtatttcttttgccaacttagctcagctggtagagcatctccctcgtaaagagaaggtcgtaggttcgactcctatagttggcataataaacattcgttaaatgttacaaagcttgatatatcaacgtttttcgtcgatatatcaagctttgtttttgtttattgcaaaaagtgctgcacacgttttgacaagaaaaactcgaatctgctagttgtaactgaaaagctccgtttattttggccaggcttgactcatcgtttttaacagtggctggacggtgcgacgctcgctttttagataggtaccaatgaaaccattgcatcgattggtgaaaagtatggcaagtccaatgggcagattattttacgctggctgctgcagcgtggcatcgtagcaattcctaaatcggttcacaaagctcggatgcgtgaaaacattgatgtctttgattttgagctgagtgaggccgacatgcagctgatgagcagtttggacaaaaatgagagtcagttttttgatcaccgcgatccagccgcaattgaaagtatttttggccaaagcatgaaagcattacgcgactaacccagtttaaggagaaatttttatgaaagccgcagtatttatcgctccaggacagattgaggtccaagagactgccaagccagaaatcgatggtgaaaaccaagctatcattcgtgtcgttcgagcaagtgtctgtggttctgatctgtggtggtaccgcgacattgccaaacgagaagccaatacgctggttggtcatgaggcaatcggggttgttgaacaggcgagtgcagacgtcagccagattaaagcgggcaactttgtaatcgtaccgtttactcatggctgtggacattgcgtggcctgtttgaacggctttgaaggcaactgtctgaatcaaaagccaggatctaacggcggctatcaagcagaattcatgaaatatgaaccagctgactccggactggtaaagattcctggtgcgccagccgactacacggatgagcagctggcctcgctgcagacgctttctgacgttatggcgaccggctttcatgcagccaaaaatgctgagatcaagccaggcgatacggttgcagtgattggtgatggcgcggttggcctgtgtggcgtaatcggtgccaagctgttgggctcggaaaagattatcctgctcagccaccacgaaaatcgagcagctttaggccgagagtttggtgctactgacattgttgcccaaaaaggcgccgctgctgttcagcaggtattggctctgactaaagaaaatgccggtgttgacgctgttttggaatgtgttggcacggctggggccattgatcaggctggccagattgcacgaccgggagcagtgattggtcgcgtcggcgtaccgcatgctgaaccaaaatccaaccagctgttctggaaaaacatcggtctgcgtggcggaattgcctcggttaccaagccggataaggaactgctgctcaaggccgttttggatggggagattaacccaggcaaggtctttaccaagagctttgaccttgatcacgctgctgatgcctatgcagcaatggatcaacgccaggccatcaaatcgctgctggtaatcgattagtcgttggtttgccgtcttgattaagtcttaaacattattggtggtctttcttaagcacaattaaaatttgatgatataatcacttaaaagacataagagaggcgaaaaacatgagcgacgtggatattgaagagattcgcttgctaacgaaaaaaggactcagtgagctgctagaacaggcccatctggaaccggatgatctgttcgtcctgggcttgagtaccagtgaggttcaaggcaagatgatcggcaagcattccaacattgaaattggccggacgatcgtcaaaacgattattgagactttaaaaccgtcgggcgttcatttggccgtacagggatgcgagcatttaaaccgagcactggtggttgaaaaagcggttgccaaggctaaaggactcgagatcgtcagtgtctttccccagatcaatgccggtggcgccggtcagattgccgcctttgaaaattttactgatcccgttgaggtcgaacatgtcgttgccaatgctggcatggatatcggtgatacgtttattggtatgcatgttaagtttgtccaggtgccagttcgtacttcagttaaggagattggtcaggcccacgtgacatatctgcgttcacggccaaaatacattggcggaccacgggcaaagtatgagtgggatccgttcaacgaaaaataaaacgggacaggtgcttgaaattgtgcatgtgcatgattttaagcactttttttagttaaaatctcaacagataattgttatcgcttacaattgcctttaatgataattttattaactaacagtatagattagcattcaattttaaaattttgtgaacatttattactttttaagatggtgcgcaaacgattccaaaatgccttgatatcacgatttacctcttggaataccggcacttggtttgacggaatgaagataaacagtatataatagtaaacgttattttaaggaaattgttactttcctttaatcttttgactttttcaataatttgactgagcttttattagattcaatcaaaatttggaggaaatggaatggataagcaaaaacaattagacacgtccttcttcgggcagccaagaggactggctacgctgttcttcactgaaatgtgggaacggttcagttactacgggatgcgtgccatcctgctgttctacatgtactacgccgtcagcaaaggcggtttgggcatggaccaggcaacggctgcttcgatcatgtcaatctatggttcgctggtatatctttctggggtgatcggcggctggctttctgaccggctttggggaccaagaaagaccgtctttattggtggggttttgatcatgtttggtcatattgctctgtcattgcctgctgggacgacggcactttatgcttcaattattttgatcgttatcgggactgggcttttgaagccaaacgtttctgaaatggtcggtggcctgtacagtgaagaagaccggcgccgggatgccgggttctcaatgttcgtcttcgggatcaactttggggcggctatttcaccaatcgcagttccttgggctgccaacggttttggcctgcacctgtttggcaacgaaatgaacttccatgctggtttctcactggctgcgatcgggatgttctttggcttgctgcaatactacattgatggtaagaagtatctgccaaaagacagcctctacccagacgatccaatcgacaaagaagatcttaagccaatcatcaactggacgatcgttgccgtagttgtcttggcaatcatcctcggtctgatgggagccatgggtcagttaaacattaacagcatcatcaatttgattacggttattgcgattgctttgccaattatctactttatcatgatgctcaactccaagaaggttaccaaggtcgaaaaatcacgggttgtagcctacattccgctgtttatcgccgcggcaatcttctgggcaattgaagaatctggttcggttgtgctggcactgtttgctgctcaacggacggttctgcacattgggggctggcactttgcagctgccaacttccagacgctgaacccactgtttatcatgattctgacgccattcttcgttcacctgtggagtcactggaagaaccagccgagtgctcctggtaagtttgctgccggtctggtaatcgttggtctttcatttgcttggatggcactgcctggcttgattcacggcacgacttctggacgggtcagtccgttctggctggtcggctcatggtttatctgtgaaatcgccgaaatgctgatctcgccaattggtctgtcaatcacgactaagctggcaccagttgcattccgttcacaaatgatgagtatgtggttcctggccgattctgcaggccaagccgtcaatgcgcaaattgttaagttctacacgccaggtacggaaattcaatacttcctgatcgttggtggtgtagcaatcgtcttcgggatcgttctttgcttctttgttaagcgaattcacggcttgatggaaggcgttgactaataaaatcaattaacgttcgcgatttatttcgcgggcgttttttaattcatctgggattatgttatccttactttcaaggggggttaagaatgattaagctggcagtcagcagcgataatcacctggatgtcaaccgaatcatgtcaacgcgagccttgcacattcaagcaagctggctgttaaggcatgatatcgactactatctatatgccggtgatctttacaataattttggacgaacgcggcgctattttgctgctttacagcgcttggttggcgaacgggttcagatctattatatcctgggaaatcatgatatgctgtcgcatgcgtcataccaagacgttgagcacctggcggatccaatgtacctgcacaatcaatatgttgatctgccggggacggactggcgcttaatcggtaataacggctggtatgactattcattttctgactacgctcagcagccgcagcaagtagcccaatggaaaaaggtctactggattgatgccgccatcaaacagcccatgtctgacccgcaaagaatgggactggtgctgaatcaggttgaacagcagctgacaatggctcaagcggcgggcaaaaaagtgatttttttaactcacttcgcaccaagaaaggctttgctgagtcccaaaccgtcatttgtccaaagtcaaagacagttgaaaacctaccagatgatcaatgcaatgatgggcagcgagcgcttaggcagactgctggaaaaggctccgcacgtaaaatacgtcttttatggtcatctgcatggtattcatgatccactaaaagcagcccatctggtttatcttaatcaggctgttggtgtcaagaaagccaagcggactgagtggcagtatgataagtttgcggagcaatgggagcatcgtttgaagataattgagttaaataattaaaaaagggcttgcttttattggctaaattagttatcatatttattgttgattgttactgattgttttcaataacagttaagctcttatggaggagtagcgaagtggctaaacgcgacggtctgtaaaaccgttccttcgggttcggcggttcgaatccaccctcctccattattattgggctatagccaagtggtaaggcaacggtttttggtaccgtcatgcgctggttcgaacccagctagcccaactgatgaagcatcgcgctggcggtgctttttttgtacgcttttttagtttttgaaaagaggattaagatgccaaaacaaggacagtttgccaaatcagttcgccaaaaaaagctaaatgattttaaggttaagcgtcatgagcaaggagccgtgattgatgaaacgcagctgacggattttttaacggtccgttttgccttgacgattaaaaagaaactgccaagcgttcagcgcgagtcggcacaacgactgctgcaagagattgcaccgcgtttgcggaatcaagatggtcggttggctgatttgatggctgaattgatcgttgagcttaatgccaagacaccatggcagtttttctggcagatcagcgatttttggccagtgctgcagaaatttctgcaaaaagaggtcccagccgttccgctcagtcagcgtatcttgatcaggcaggttctgagtcagactgagttggaacgtatgttaggacaggcgctgactcaaaaaacagcggctgcaatgctgttgggacagggccaggctgaggcagctaagattaatcagctgagtgggctgctgatggccgatttgtaccaggaaacgcatctgaactggcaaaaggttcgccaattgctggcgccgtttgctttttcgattgatgaagaactcgatgaaacaaccagacagtggctgcgagatttgacagcattgtgaaaataaaaacgtgcattctggcttaatttgatttataataacaacactaattttaagtaagttaatagagggctgtggcggagctgattgccatagccctttttgcgtgctttttaagttttaggagggatttttttgcacggcaggcatccatactgggccattttttcagcggccttaatgacttttattggtgttttaaacgagacctcgatgaacgttgcctatccggtcttagccaaggaatttggcgtctcacttgatgtcgttcagtggattaccggcggctatctgctgatggtgacgatcgtaatgggaactacggcttattgcttaaggcagtgggcagcgcgctggctgcatctggcggcagtttcggcatttgtgattggtgatctgatctgcgcgttggccgtcaattttccaatgcttttagcagggcgattgattcaggcaattgcaacgggcttttcaacacccatgatgttctttttgatttttactcagatcccgcgtgagcgcttaggtgtaatgaatggcgtagcgggaatggtgatttcgttggcgccggctttgggtccgacatatggcggcgccgtgctggcagctggatcttggcgcgttattttctggctgattctgccgctggcactgttaagtctgattgctggtcaattgacgattcgtaaccagccgtttggcaattcacagccgttcagttttttggctctgtttttgctggccggtagtctgttcagcatcgtcactggcgttgctaggtttggcaaatcaggctggacgagttcatgctggctgctcttattactgggcttgattctatttggcggttttgtctggctaaatcagcacggcaaaacacgattgtttgatctgggtgtctttgcgcaatcgtccgtgcgactttcggaatggacctatttcagtctgcagttcatcaacattggtgcatcattggccctgccgatctattgtgagtatgttttgcatgcctcatcactgactgctggaatggttctattaccaggatcgcttttaggggcggtaatggcaccgttgtccggctttttggcagatcgttatggctatggtctgccgactcgtctgggcagcattttgatcgttttaggaacgactggactgctggtcttccagtctcagctgacgccactatccgtaatggtacttttcatcgtaatgcggctgggctttaatgcggccttttccaatacgattgccaatgcctcgaccttggtggcaaaagaaaaatcaaccgacgttaattcaatttttaatatgacgcagcagtttgccggttcattaggcgttggcatcatgactgccttgattgcgctcagtcaaaaccaaggacaaggatcaatggcgctgagaacgtttaaaggcagccgcctcgatttttggctgctggtgatcttggcattcagcgtcttggtcgcggtctggcttaatttttcccgccagcagcaattgaagaacgcggccactaaatgatgcgtcaataaaatagtcaagccgttcgcttgatgatcatcaaaatgatataattttattcgatacttaaatcggcaaaagcttgccagaaagaagaaaaattgccatgattgcgcagatacagcattttttggttgaccagcagatttttacgttgtttatctgtctggcgctcggttatgtcctgggaaatatcaaactgtttgggaccaattttacgcttggctcaaccgtgggcacgctggcggtagcattggtggtcggtcaggctgggagctttccgcgtgataagatgctgggaacgatcttttttggcgccttcatgttttcaattggttaccggatcggcccatcttttttggtcagtatgaagctgtttggtggacggatgattgccgtgagtctgttttggctgttggccgcttttctaacctcgtggggctgttttgtcctgtttcatctgggaccaggcgtggctgccggaacgattgccggttcattgacgcagtcggctacggttgccagttcgctgcaggccttggagaatctgccgatcagtaagacgctgcggctgtcctatgaagctcagctgccggttgcctatgcgctgacctatgtctttggcacgctgggcgtaattatcttgctgcgcgatgttgcgccgcgtctgctaaaaattgatgttcccaagcagggagatcggatggccagaaaataccactttcacgcgcccgctcctgatccgacctggcgtcgaacctaccggctggctgctgagtcgccgctggttggcaaaaagattcgtgagattaatgaattctttgatttacgcttgattgcgctggcggcctttcatcaggatcgcatgaccgacaagttggaatatgttctgcaggcaggtgatcgcctggctttgattggctatgcgctgcattttgatgatttgacgggaattaccgggttgacggaggttttaacgccaaccaatgccccgcgcgaacgaaaatttgtccttggcaaaaactttgatcccagcactttggcaaggattcggcaaaatggggtctttgtaaacattcatgatccattaagtggtcaagagcatctgatcaatcagctaaaaccgggcgatgtaatctcattgactggtaataccagcaaatcagcaccattgctaaaacagattggacgttggcataccagtgaacaggccatcaactatacggtgttctctttgggaattgctggggcctcgcttttgggtctggttggtatcaaggtcaatggcatgccgctgcagcttggcaacggcacggcagctttgatcatggggcttttgctcagcagctggattgatcggcatcatgaatgtagctcgattccggcaacggtaacttctttttggcagagctttggcttgactgtttttgtcggcagcgttggtctggagtcggctcaggcttttactggtgcgattaagtcactggggtttgggattctgctgattggtgctttggtctcagtggccccgcatctgttgaccttgctgtttggcaggtttgtactgcgcgttgagcccttggccttattaggagcgctgtgtggttcgggaaccgtggcagccgcaatgaatgatctggctgagcaagcgggtctggaaggtggggcttaccttgcttctgcatttacgccggcatttgttgttggtaatataggtattacgttattgggacctttgtttgtggcaattttgtcatgatggtcattatcagaaaggttgatttttatgaaacagttctttaccgttttaggcggcatgggtacgctggcaaccgaaagctattgtcgactgctggatgagcgtacgccaacgcaccgcgaccaggattatcttgattacatcgttttgaatcatgcaacggttcccgatcgaacggaatggattttggatcaccaaaagcctgactataatccgctcttaattgaagatatccaacagattacgcctctaaaaccagaattttttgtcttgatctgcaatacggctcactatgctttcgaccgcttgcaggcaacaacttcaattccgattctaaacatgctgcaggaaacggttaatgagatcaaaaacatcgcaccacatgccaagcgggttggagtattggctacgcggggcacgattgcgtctggtctgtacgattcttacattcaaaatgccggctatgaagaggtcaagcccacgccagcaattttggacgctacagaagatctgatctaccatgacattaaagaagctggtcattcagatggcaagaagttccatgaattggtccggacgatgattgaggatcaaaagtgcgatgtagtaatcttaggatgtaccgagctttcctatgccaacgaaatgaatccagaaacggaatttcccgttgccgattcacagtcgatcattgtcaatcgttcgttggcgcgagctttggcaattcgcaacggtaatcaataagctaaaacgacagtccatgcaaagtggctgtcgttttattttcgttccaagatttaatgctaaattggtctaggctaacttatattcgtgttaaaataaaaaagacaaaccgtgaatgaatggtctgaagaggggaaataagatatgggatcaccggtatatattcaaattcataatcaattacgtgaaaatattgaaaatggtcattggaaggttggacaaaaaatcccggctgaacgtgaattggcagctgaatttggcgtcagtcgcatgacgctgcgccaggctattcaaacgctggttgatgaaggggtcttggaacggcgggttggttcgggaacctttgtcgccagccggaaggtccaagataagatggccggggtaaccagctttactgaattgatgattgctgctgggaaaaaaccttccagtaagacgatttcctatcatttaacaacgccttcgcaaagtgaaatcgaacggcttaaattagaaccagatgagcgcgttttgcgaatggagcgcattcgttatggcaatgagattccaatctgttatgaggttgcgaccgttccggcaaaactggtggaaaacttcagcaaaaccgagatcacctcatcgttttaccgcaccttggaaaaaaaggccaacctttatcctggtcatgctgtgcaatgggtttcggcaatcagcgctactgaaaagattgctgagtatctgcggattcggcgtggcgacgcgctgctgcatttgattcagctttcctatctgcaggatggccggccttttgaatatgtccatactcaatatgtcggcagtcgctttgaattcgtgttggaaaaataaaaggagtttatatgaagtttgattatccagatgacagtatcgctctgcataccgatgcctaccagctgacgatgatgcagacctattggcaaaaaggcattgccaatcgtcacgtggtttttgaggcctttttccgtaagatgccgtttggaaatggctacgcagtttttgctggtttgagccatattattcgctatctgaacgctctgcatttttcagattctgatattgaatacctcaagtcgacgcagcagtttgatcccgaatttattgaatatctgcgtggctttagatttaagggaacgctgcgcagtgcggttgaaggtgatctggtatatagtcatgaaccgatcattcaagttgagggcacgcttttggaatgccagctggtagaaacggcactgctcaatattattaattatcaaatcatgattgccaccaaggcttctcgaatcaagtcaatcgttggcgatcagccagtgatggaatttggctcgcggcgggcgcaggaatttgacgcggcaatctggggcacgcgggctgcttatattggcggattcgatgctaccagcaatctaagggccggcaaactgttcggcatcccggtatctggtacgcatgctcacgcgctcgtgcaggcataccgcaatgattatgatgcttttaaggcctacgcgcagacccatcatgactgtgttttcttggttgatacctttgatacgcttaaaagcggggttcctaatgcaatcaaagtcgctgatgagtttggggatgccatcaatttccagggtgtccgaattgattctggcgatatggcctacctctctaaaaaagtacggcagatgctggatgaagccggctatcccaacgccaagatctttgcttccaataatctggatgaacgaacgattatggacctgcagcggcagggtgccaagatcgacgtttggggaattggcaccaagctgattaccagttatgatcagccgacgctgggagcggtctataagatggtttccttagaagatgatcatggtcagatggttgatacgatcaaactttccaataatgccgccaagatgtcgacccctggcaagcatcaggtttggcgaatcaccgatcgaggcagcgaaaaaagcgagggcgattatgtaacgctggctgatgaagatccgcgtcagctagactcgctttatatgttcgaccccaactatccgttcctgaataaaacggttgaggacttcattgctcggccgcttttaaaggatattttcgtcgatggtcagcaagtctaccaagagccaagtatgaacgagattcgtcaggctcgccagcggcatctggatcgtctgtgggaagaatataagcgaaacctcaatccagaagtatatccggttgacttatcgcaaaagtgctatgacaataagatgaaaatcatcaaagacgttaaggactatattaagcatttgaactaggatctagactaaagagggaaagaatatgcgcaagctgcaagaagaaatcattaataccttggccgtaacgccatcaattgatccggcaatcgaggtcaagcgccgcgttgaatttttaaaggactatctgaagaagaccggattaaaaacactggtgctgggcatctccggtggtcaggactcaagcttggcgggacggctttcacagttggcagttgaaagcctgcgagcagaaactgcagacgatgcctatcgttttattgtcgtccggctgccttatggcgaacaggccgatgaagctgatgcaatgctttcgatcaatgaatttatcaagcctgatcagaccatgcgagtcaacatcaagccagccgttgatgcaatggttgccgcggttgaacaaaatgggctgcagatcagcgactttaacaaaggcaacgtcaaggctcgagagcgaatgattgcccagtatgcaattgccggtgagttccgtggggcagtcgttggtaccgatcatgccgctgaagcagttactggcttttacacaaaatttggcgatggcggggctgacatcacgccactgtcacagctggataagcgccagggacgccagcttttggaatatctaaaggcgccaagagtactttatgaaaagacgccgactgctgacctggaagaagatcggccagccctgcctgatgaaaaggcattaggcgttacttatcaagcaattgatgactatctagaaggcaagccggtttccgatcaaacagccgccaaaattgagggctggtatcttaaaaccaagcacaagcgtcacctgccagttagtccattggatacctggtggaaagactagccttaatatagggcccaggctcggccattgccgaacgctgggccctataatggttaatcgactaatgcagcaaaaagattaaaaaagaaatgagttacggatcgctatggaaaaaaatgatcttaaattaatgagccagcagctgccagaattaagagatcggcagattgaagccgccttgagccttttggaagagggcaatacgattccattcattgctcgttatcgaaaagaggcaaccggcagcctggatgaagttcagctgcagggaattcaagaacagtggcatcgggtaaagaatctgcgcgatcgtcaacagaccgtgatcaaagcaatcgaggaacaaggcaagctgacgccggctttaagaatgcagattgaaacggctgccgagctgaacgttgttgaagacctgtacctgccttataagaaaaaacgccgcaccaaggcacagattgcccgtgaacagggcctgcagccgcttgccaactggatctttatggctaaaggaaatgatctggacggcaaggctgctgaatttatcagtcaagacgttcctgacgttcagacagccttggagggggccaatgagattctagccgaaacgatcagtgaaagcagtacgattcgcgcttggctgcgcaactataccaagcagcatggcgaactgatcgcgacggttaaaaaaggcggtcaggaacttgattcagggggcgtctatcagcaatattatgatttttcggcccctttatccgcaatgaattcctaccgtgtcttagccattaatcgtggggaaaaagctaagatcttaagcgtcaagattcttgctgatgagcagatcgtccaaaattatctaaatttccggctggttaaaaaaagcagtgctcaaaacgctgctgagtttgtcaaaaacgcggctgccgaagcctacaagcgtttcttgggaccagcaatcgagcgagaattgcggcgcgaactgactgatcaggccaatgagcaggcaatcaaggtttttggtgaaaatctctatcatttgctgatgcaggcgccaatcaagggcaaggtggttttgggctttgatccagcatatcggacgggatgcaagttagcggttttagacccaaatggcaagctgctcaaagtggccgtcatctacccgcacaagccggcaccagaaaatcagcgtcaacaggcggaaggacagctgctgcagctgattgaggactaccaggttgagatgattgcaatcggtaatgggacggccagtcgtgagtcagaacgctttgtggctcagataatcaaaaaaatcaagcgtcccgtttattatgtaattgttaatgaatctggcgcgtcagtctattcagccagtcaggacgcgcgtgacgagtttccagagctgacggtggaaaagcgcagtgccatcagtattggccggcgtctccaagatccattggccgagctggtaaagattagtccggaagccattggcgttggtcagtatcagcatgatctgccgaaaacggcactgaaagttgaactggatgccgtcgttgagcgagccgtcaatcgggtcggcgttaatcttaatacggccagttatcagctgctggcacacattgctgggctgaacgccacgctggcaaaaaatatcgtgcggtatcgcaatgaaaatggccgttttaccagccggatgcagttaaaatcggttccccgcctaggacctaaagccttccagcaagcggtgggctttttacgaatcgtggatggtgatgaaccattggataacactgatattcatccagaaagctatgcaattgctcgtcagttgctgcaggcagctggcatagccagtgaacttggctcaccgatggctgcccagcagctgcggcagttggatattaaacagttcgtcagtgaaaaagtcggcttggcaacgcttaaagatatcattgcctcgctttgcgaaccaggacgagacctgcgtgactcattgccagcaccgcttttgcgacaagacgttttgacgattgaggatctaaagccgggaatgcagctgcaggggacggttcgcaacgttgtggatttcggtgcctttgttgatgttggcatcaagcatgatgggctggttcacatctcgcatctgaccaagaagttcattcaggatccgcgtcaagtcgtagcagttggcgatatcgttgacgtctgggtgctgagcgtagacttaaagcgccagcgtgtacagctgacgatggttcagccaaatgagtgaccagatgactgacgaagagctgcagagactgacccagatctggtcgctgcaggcgtttcagcgaccgtttaagcaccgggtctggtttaaccgccgcttaaagacgactggcggccgctatcatttaaaagaccatcatatcgatatcaatcccttgatgtatgaagagtttgacctggccaatctgcgcggcgtcgtattgcatgagctctgtcactatcatctgcatctggctggtcatgactgtcatcatacttctgaattcaagacgcttttaaaacgagtcggcggtctgcgctatgctccagcagttaggcaagccgagaagcaatttaaatggatctatcaatgcagtggctgcggcattcggattggtcgcatgcggcgctttgacgtgcagcggtttgtctgtcggcgctgcggcagtcattttgaacttttaaccaaaaaatagtttgccaacaagtagcatttctggtaaaatgttatttgttgatgcggcagtggcggaattggcagacgcgcaagattaaggatcttgtggtcgttttagaccgtggaggttcgagtcctctttgccgcactcttattgcacttggcgttagtcaggtgctttttattgcttttaagttcgctcttgaaaaacaggagcggactttttttgagcagatttttaattatgcctgcagtggcttttcaattaatttagtaaattttttagtgaaataatactgttttatcgttcatgaaagcgctatactaaatagacagagaataatttgatttgaggaggcgctttttaatgcaagcagatttaaaatggctggatgatccgcagacgttccgggtcaatcagctgccagcccacagtgatcatcaatggtatcttgattatgccgaggctggtcagcaaagcagcagctttactcagagtttggatggtcagtggcgctttgcctttgccaaggatccgcaaaaccgcattaaggaattttatgcaccggactatgatgtcagtcaatgggatctgatcaaggttcccagcatgatcgaattaaacggctatgctcaaaaccaatacaccaacatctggtatccatgggccggtaagatctatcggcgcccagcctatgccttgagccctgatgatctgcaggccggctcattcagtcagggaactgataacaccaatggctcatacgtcaagcactttgatctaaacgaatcactgcgcggaaaaaaagttcgtgttcggtttgagggggttgagcgcgcgatgtatgtctggctgaacggtcatttcattggctatgctgaagatagctttacgcccagcgagtttgacctgacgccttatttaaaggacacagacaatattttggcagttcgcgtatataagcacagcacggcttcttatctggaagaccaagatatgttccgcttttcagggatctttagaagtgtcaagctgttgggtcagcctaagctgcatttggaagacttggatcttaagccgcgcgtaactgatgactttaaaaccggaatctttaacgtggatctaaagctgcagggacaagatggtcaggttttgattaaagtctttgatgcacagggcaatctgatcgttgatgaaagcaaagcggctgctgaacgggttggtgtacatgacattaaagttaaggatgctcatctctgggataatcatcatccttatctctaccaattgtttgtcgagctgcgcgatcaaggcggtcagcttttagaggtcgttccttatcgattcggcttccgacgcgtagaaatcaatgctgatcacgtggttctgctcaacggtcagcgcttgatcatcaacggcgtcaaccgtcatgaatggaactgccggacgggacgctgcgtaacgatggccgacatggaacaggacatggccacgtttaaagaaaacaacatcaatgccgtgcgaacctgccattattcagaccagattccttggtactacatgtgtgatcaagaagggatctacatgatggccgaaaataatctggaaacccacgcaacctggcagaaaatgggccaagatgagccgtcatttaacgtaccaggctccatcccgcaatggagagaagttgtagttgatcgggcccggaccaactatgaaacgtttaagaaccatactgcgattttattctggtcgttgggcaacgaatcatatgccggcgataatctggtagcaatgcaagaattctacaaagatcatgacgatagccgcctggttcactatgaaggcgtcgtgcacacgccagcctatcgcgatcggatttctgattttgaaagctggatgtatctgccgccaaagaaggttgaggaatatctgcagaataatcccgacaagccgtttattgaatgcgagtacatgcacgacatggggaattcagatggcggcatggggtcatacattgaattgatcgacaagtatccgcaatacgttggtggatttatctgggactttatcgatcaggcactgctggttcacgatgagatcagcggtcaagatgtaatgcgctatggtggcgattttgatgaccgccacagtgacaatgagttttccggtgatggactgatgtttgccgaccggacgccaaagccagcaatgcaggaggtaagatactactatggactgcacaaataagattcacgtcgtttatgatgatggcctgttgggactgaacggtcaggactaccaatatttgttcagctacgaaaagggcggtttggagtcaatgcgttttaacggtaaggaatggctgtaccggccgctttatccaacctattggcgagcaacgaccgataatgaccgcggcaatggcttcaattttaagagtgcccaatggctgggagcagacttggcgcctaagtgcatcaatattgatctgaccgttgatgaccgtcactttgatcagctgccgattgcgccgttgaccaatcagttcagcaatgatgaatttgcaaaacaggttaagattgagtttacttacgagacagcaaccaatccaacagcgcaggtcaaggtagcctatgcgattgatgccagcggtaaatgtcgtattgcagcccattaccttggtcaggccggcctgccagagctgcccgtctttggtgtacggctgatcatgccgactttggccaccgagtttgaatacgatggcttgtctggtgaaacctatcccgatcgaatggcggggggagtcaaaggaacctggcatgttgatggagttccggtaacgccttacttaacgccgcaggaaatggggatgcacatgcaaagctcacggctgaaaattgtccgcaatcaaacccaaaataacgccgaccatgacgagcagccgtttgcgctgactgtcaagcaaactgatcagccattcaactttagtctgctgccatataccgcttcagagttggaaaacgcaacacacattgaagaactgccgctcaaacgtcgcactgttttggtagtagcgggagccgtacgcggtgttggcgggattgacagctggggtgccgacgttgaggagcagtatcacctgccagctgatcgcgactatcagtttagttttgaaattgagccagcaacaattgaatagtttgaaaaaatgggaatttgattaaaaaattcccatttttaattttttaaagcagccagcgggtgtaaaattaattatgttaatttgcattagagagaggctaaagatatgttaagcatattctggtcaagtctgtcgggagtattgatcatcttaattatgatcgcagctggatttgttatgaatgaacgccactggtttacccccgactcacccaaggccatttcaaagatagttacccaagttgccttgccgacttacatgatcagtacgattacaaccaaatttacagcggctgagctaaagacgcttttgccggatctgcgctacccggttttatcgatgctgatcctgtttgcattgtcgtttgccgtcgctagagcattggccatcaaaaagagccacattggtctgttcagttcgatgttttttaattccaatacggtttttattgggctgccgatcaacctggctttgtttggcgcgcgttcggttccatacgtgctggtctattatatggccaatacgactttcttttggacgctgggtgtttggctgattcagcatgacggtatgaaggaagccaagattgatttcaagcaggcgctgggcaagctgttctcgccaccgctccttggctttatgctggcggtggttctggtagctttgcatatccgactgcctaagttcatcatcagtacctgtgcttatctgggtaatttaacgattccaatgtcaatgctgtttatcggcatcgtgctgtccaatgccgggctgtcaagaattcgttttacgcgcgatgcctgggggattttgctgggccggttcttattggcaccactgctgatgacgattttggtgttgccgagcaacatgccgctgatgatgaagcaggtctttattctgcaggcagcaatgccggtcatgaccaatgcgccggtcgtttcgcgaatgtatcatgctgactacaactatgctgcaattatggtaactgagaccaccacgctttcaattatcgtaattccaattttaatggtggcaattaaaaccatggtccactaattaatggttaaagttgccgaatctccaataaataagaaatgagcggtcagcctgtcgtcgaatccagacgagctggccgtttgacgtttatctttaagaaaaagttttattgatctgattagtcgtttcgatcggtgatttgcgttatagttaaagtagcagcataagggggaagtttattgatgacggcaacactggtaatcgttaggcatggtcagagtcaggccaataaggataacgtttttacgggatggagcgatgcaccgctcaccaaattgggaattcagcaaggcaaacaggttggtgatcaattggcaaaattaggcctgcagtttgatgacgtccatgtttcctacatgcagcgggcaattattacggccaacttgattctggaaaaaatcgatcaactctggctgccgatccataagacctggcgactgaatgaacgtcattatggagctttaagcggcttaaacaaggacgcggtcaaaaaagaggtcggcgcggcaactttgcatcagtggcggcgcggctttttaaaacgaccgccaatgcttaagaaacgtacccacgagcgacgctatgaccgtttaggagtaaaggtgccgcttagcgaaagcctcaagatgacccaggagcgactgttgccatattggcaggatcagatcgccccacgacttctggatggcagaaatcagctgatcgttgcgcatggcagttcgctgcgagccttgatcaaatatctggattcgattgctgacgatcagattgatcaagttgaggtgccaaatggtgagccgattttataccggtttgacgatcatttgaacattatcgagaaaaaatttattacggatggtgaacagcatgtcaattaaagaaatctccaacaatcctacactggccggtcaagtcagactgattgaagatatcgtctattcagcagctgatggcgaggcacagaaaatgtcgattctggcaccatggacgcagcgctacaaggatctgccgcaagccaagcgaccactgctggtttttgttcaaggcagctcttggacgaccccgactttaggtgaaaagattccacaattagtccagttcgtccatgccggttatatcgtggcaaccgttcagcatcgcagcgccttggatgggcatgcctttcctgcgtttttacaggatgtcaagactgcgattcgctatctgcgagcccatgccgctgaatatcaaattgatcctgatcgggttggtatctggggaacctcatccggggccaatgctgcgcttttaaccgcgctgacgccgaatgatccgcgttatgagacggctgactatgctgatcagtcagatgccgttgatgccgtaatcagctgttttgccccaacggacgtcgctgatacgtttgctttttccaaaaacgtgcctggctcggatgccatgcagttttgtctgtttggtaccgatccaacaaaatggccggccatcaagcgggaaatgagcccattatatcaagtcaaggataatcagcaatatccgccatttctgctgatgcacggggatgccgacaagaccgtgccatatcatgaaatggaagacatgtatcatgagctggaaaagcatcatgtcgccgttgaggcctaccgggtacggggcgccgttcatgagcgcgacttctggagtcagcagatttatgatattgcccgcgagttcttggatcgcaacgttaaatagacaaaaaactcattgcctgattagacaatgagttttttgattgcagctatcaagtcgttgttaggccaaagttcccattggatcccatggtttgaggacgattggttcttgagcctggtcagccttgagttcatcactgagatattttttattgacgacgatttgatagacgtattgatccatccattcatcactcatgacaaagtagcctttttcgccgacttttggtccccatgaattctcaaccttccatttggctggcttgccatcaaccagatcaaccccggtcaagaccatggcgtgatccatcattgactggtgatagtccagcatgtcagccttattcatggtcagctttgtgtcaaacagatcttcatagccatacgtgttgagcgccagaatccccagcttggtttcggaatatttgacaacgtcagagccaaaccagacactctcgccgttttgcagctgcttgatggccagttcctttaattccgtcattgaaaggtttaagtgcttgacttgacgaccgccaaccacgtttcccaacatctcgatcgtgtaggtcttgtggtaggccttgtctttggttggtgcctgaatgatggagacgtattcgctcagatcccagccaacgtacttatcaaagaatgctaccggtgtcagattgctgtcgcgatggaactgcttgtcttttttagtccgatattcaaaatcaaaggtctgtaccggttcaccaaaagcatatgccagcatgcggtagacggtgttgagcatttctttgcgcgtggcgttgatctgggattcgctggcctgttcatgaaccaattgacgcagaattacggcatcatgacgcaattgattgttcaaaacagcattgatttcgtttgagcggctggaattgtaggtttcgggctgagccgacttaggtacgaccccatacttttcaatcaatgcacacagcatgtcccattgaccgccatcagattggggtgcatccaaaagccaggctaccttgcgatcgtcaatatccagatcggcagtctgaatgatgttttcataaaaccagttggccttttcgaacttgtcccagaagaaggcataggattgtgacaactcgaaatcatccggcagattgaaacggttctgcatgttgtgacgcatcgtgtttaaagcagcaaacagccagcagcgtcccgactgtttttgatcggcgacgtcaccggttgccagatcaattgagaagtgctgatcattgtcggcaatcgcatgccagtcaaagctggcggccttgaccccatttttggcgacggttcgttcaagaatccgagtctcttgacggttggcatagtcttgcttgaaatctttcagttggtcggcattaatgacaaaactcaaaaaaatcactcctttaagataatgacttaattatagtcgaatgtttgattcacgccaaaaaagtaatcaaaaaaggctcgccgggcattctgcgcggctgagcctttttaattagcgggcatgcaggatttctggcccattttgccgaccaacgataacgtcattgactcggtttaagaataagccgtgctcaacaacgccaaccatgtgaatcagttcttcggccatggcttgcgggtcatcgattttgcccaggtgcagatcgatgatgtagtcattttcatcggtacggtagcgctgatcgccatccatccgccaagttggctggtagcccttagcagccagcttgttaaagacatgctgagcaccgaacgggattacttcaactggcagtgggaaggcccccagctggtgaaccatcttgctttcatcaacgatccacatgtaatgcttcgagatgtcggcaacgattttttcccaaagcagggcgccaccgccacctttaatgccctggaagtcatcgctgatctcatcggcaccatcaatcgtaaggtcgatgtggtcgacttcatcaatgtctttgatggtgatgccaagactttgtgcctgtttggtcgtgcgattggaggtcgtgacgccgatgatgctcaagccttcatttttaacgcgttcgcccaacgcgtcaaccatgtagcgaacagtcgagccagtccccaagccaacgatcatgccgtctttgatatattcaacggcagcccggccaacaagcgattttaattcattttggtccatatagaacgctcctttattgattaaagcgatcctccggcaatagcaaatcctggtattccggatgatcacggaatgccgctttaacatatggacacatcagtttaaccgtcagatggcgttcatgggcataatcgacgaagcgcttggtaagctcggccgccagtccatggccacgaccttcaggagcgacaaaaacacgctctgcgacgacgcggtcaggatagccggcaactggcggaaagctgatgtcgccgacccatttgccattatcatcgatagcactgatgcgatgcggttccgttacaaattgcatttttgtcccctccatcattaataaatttaatccaacttgattttccatggttctgaaatgattgtcaaggattaacatgctacaattaaatgctggacaagtttaaagataagttacgattaaaaaataaaaactgaacgcatgaattttagaggtgaagaaatgaaaaaaagaggatttgagattgttgccaagtatgctgatgccggcctaagcctgccgcagcggcaaaccaagcaggcagctggctatgactttgaggccgctgctgattttgtggtgccttcaatctggaaacagggcctttttaaagcgctgcatgccatcaaacatgctgccaagccgggagaagaagagctgacggctggcgatcaggcgctcaagccggtgctggtgcctactggaatcaaggcctacatgcagccagatgaggtgctgatgctcttcaatcgttccagcggtcccttaaagcggcggctgattctgcccaatggcgttggaatcattgatgctgactactataacaatccagccaatgaaggcgagattttcgtacagctgctgaactatgggctctttgactaccatgtaaaaaaaggcgagcgaatcgcgcagggcatctttatgccatacttaacggctgacgatgagtcaatgcctaaaaacgatcgggcaggcggctttggctcaactaaaaaataattccagctaaccagcttttatcaagaaaggaaatgcctatggcgaaagtcaagacccagtatatttgtcaaaactgcggctataattcgccgcgttaccttggtcgctgccccaactgcggtcagtggaatactctggttgaagagcgtgtcgagacggtaaatgcgcaaagcacgacgcggcattcgtcgactttgacgggaatcgttgccaaaccgcagcgcgttaaggacatcgatgcgcaaaagctgccgtgcgtcaagactaagctaaatgagctcaatcgtgttttaggcggcggcattgtaccaggatcgctgattttgattggcggggatccgggaatcggtaagtcaacgcttttactgcaggtttcgggccagctcagcgatgaagggcattccgtcctgtatgtttcgggcgaagaaagcggtgtgcagatcaaaatgcgtgccgaacggttggcagtagccggcgatgatttctacatctaccctgagaccagtatggacagcattcgggcaacgattgacgatctgaatcctgaatacgtggtgatcgattcggtccagaccatgcaggcaaccgatgtcaacagtgcgattgggagcgtgtcgcagatcagagaggttaccgcgcagctgatgcagattgccaaaagcaagaacattacgatttttgttgttggtcacgttactaaaggcggcgcgctggcaggacctaaaatcttggaacacatggttgataccgttttgtactttgaaggcgatctgcatcatacctatcgaatcttgcgggcagttaagaatcgttttggctcgaccaatgaactgggcatctttgaaatgcgcacggcggggctggcagaggtcaaaaatccatctgagatctttttggaagagcgactccaggatgctactggctcagccgttgtggtttccttggaagggacgcggccaatcctggttgagattcaggccctggttacgccgactgtctttggcaatgctcaacgcacggcgacgggcttgaatcggaatcgggtctctttgattatggcagttttagaaaagcgtgccaaccttatgctgcagaatcaggatgcctatcttaaggcagccgggggcgtaaaattggatgagccggcgattgatctggcgattgccatcgcgattgcctccagctaccgcgacaagggaacgcgtcctgatgatgcctttgtcggtgaagttgggctgaccggtgagattcgtcgtgtcagccgtattgagcagcgcgttgctgaggcagctaagctgggttttaaacgaattttggttcctaaaaacaatctgcagggctggaatccgccagctgatattgaagtggtcggcgttacgactataaatgaggcattacgactcgcattagcgtaaaatagaaattacgacaccataacgatttatcaaaggagggctgcaggtgagaaagagaattattagactgctgttcgtaatcgtgggggcagcagttggtttttactatctaccaccgatttggattgccatgcgcaatcagcttggcgttcagctggcacggccaattgagtcagcaattgattttttgattggagcacttgttttttggctgatttcactgctgctgactgactggacgatcaagatgctgaaacaggcagaaaacgcactgactaaaaagagtctgacctatctgctctttggggcgatttcaacgatctttggcttgatcttggcgattttgatctcaattccgctgtggcgattgagtattcccgttgtcaacaatgtcttgccggtacttttgatgatcctgttcagctatttagggtttcatttagggaccacgcgtcaagacgaatggcgtaagcttttaacgcgacgcgggcgagatgaacaagaagcccaggtaatcaagcgtcaggatgaaaactatcatcactataagattttggataccaacatcctgattgacggccgcatttacgatttggtcaagaccggttttttggaaggaacgcttttagtaccgaattttgtgctttatgagctgcaatatatcgcggatgccggcgaaagcatcaaacgcgtacgggggcggcgcggcttggatatcttaaacaagctgcgcagcgaaaagatcgttccggttgagatgtataaaggtgactttgaagatatcaaagaagtcgatgaaaaattgattgccctggccaaaaaggttgatggcgtgatcgttaccaacgattacaatctaaacaaggtcattcaattccaaaacgtgcaggtgctcaacatcaataatctggccaaatcattgcggccacgcgtgattccaggtgaacagctgacggtcgtcgtcgttaaaaaagggaccgagcgtcagcagggagttgcctatctggatgatggcacgatggtcgtggttgaagatggccgctactacatgaatgagcagctggacgttgaggtaaccagtgcgctgcagactgatgccggccggatgatcttcgcgcgtccagtacattcagcgtcatcacatggcattgacggcagcgagcgtcaagatcagaaacgattggcagaatcaaccaaaaagactgatcataagaataacgatcgtaataatcgcaaaaactagtatttgcaatttaagcattgcacggtacactagaatagaaatattttcaatttttatgaaagaggcggaacaacttgtcaaaaaacgaaattcgggttcgctatgcgcctagcccgactggacacctgcacattggtaacgcacggacggcactgttcaactacctgttcgcacgtcactaccatggtaaattcatcattcggattgaggatactgatacgaagcgtaacatcgcggatggcgaacgcagtcagctggacaatctgaagtggatgggactggactgggatgaaggtcctgacatcggcggcgactacggtccatatcgtcaatcagaacgcaaggacatttatgaaaagtatgttcaggaactgatggacaaggacctggcctacaagtcctacatgaccgaagatgagctggctgagcaacgggaacggcaaaaggcagctcaccagatgcctcattatgaatatgaatatgctggcatgactgatgaagagatcaagcaggcacaagcagatgctgaagcaaaaggtctaaaaccggttattcgtttccgcgtgccaaaggatcacacgtacgcttgggatgatatcgttaaagggccattgtcatttgactcagcttcagttggcggcgactttgtcatcatgaagcgtgatggcatgccaacctacaactttgccgtcgtcgttgatgatcatctgatgaagatcagccacgtcttccgtggggatgatcacgtttctaacacgccaaagcagatgatgatctacgaagctttaggctgggaagcgccaaagtttggtcacatggcgctgattatcaacaacgaaacgggtaagaaactctccaagcgtgatgaatccgtgctgcagtttatcgaacagtaccgcgacctgggatatctgccagaagctatggataactttattattctgctgggctggtcaccagttggcgaagacgagatcttctcgctcaaagaattcgtcaagatgtatgatgaaacgcgtctgtccaagtcgccggctgcctttgaccgcaagaagctgcgctggatcaataaccaatacatgaagaattccgacgttgatgaagtcttcaatgttgccatgccgcttttgatcaatgccggcttgattgaaaaacatgctgatccatacaagatcgaatggatgcggcggatcgttgaaatcttcaagcgggaaatctcttatggtgaagagattcttcaatatgctaagccatttgtcgaagaaccacagatcctgactgacgaagccaaagaagaaatgagtgctgaaacggttgccgtagtgctgcgtgatttccgtgacaagattgctgccttggactttatggatgccacatccattctgcgctgcatcaaaggcgtgcagaactataccaaggttaagggacgtaagctgtggatgccgctgcggattgcaattacgcatgaaacgcatggcccacaactgccggaaagcattgagctgattggtcaaaaagctacgctggctcgactggacgatatgattgaccgggtagaaaacggcaagctttaagattttgatgactgacgaccaacttggcgttagctcaaactaaaaatgggatccgatattcggcttgaccgaatcaggatcccattttatttgactcgaatgtttagataattcaagatgatgcgaggtcaaaaggaggaagacatgcgaatcactcccacacaaaatgatgcgctgcagatgctggcagccttggcgaccttgatctttatgagctggtctttaaaatactggccggctttttatcatttggatcaaagactgcatgatcaggtacctaatcggcaaaacagtttcttttggcgcggcgtggcttggattggtcagcctaagctcacggtcggctatgcgtttgtcttagccggtgttttatggctgactgctgattcaatcacggcgttttgggtgttggcaacgctgggcagcctggacgcgctggggattggcgttaaattgtattttaagcgcaagcggcctgaccagcatctgccaggtgacgatggctatagctttcccagtggacatgttttgggaaccacagttttggtactgatgatctgggcactttggccgacgccatggacaggaagcttaggcctgggctggctaatgttggttgcggcatccagattggtcttaagagctcactatccaagcgatgtcttcagtacgatggtgatggctgccggctgggtggcgctgttaagaagattgtatgcaccattggctgagctggtgaccaggctgttttagcattaggcaaaagaaaaagcagcggccgggggagccactgcttgaggagtattacgaagatcttgggggagatttcgtaaaaatgtgtatttttcggttactattgggaggagtaattgaaaaataataggtttcggttaaattgattgcagccaagctatctcgtttgactacacctgtaatattagcacccttttatgaaaaaagtatgaacaaagacttaacaatttatttttaatgcgccaaccaggaatcgtaatgaattgtggtaaaatactgttattgcaattacttttaaaggaggattacggcgttatgttgactatttataatacgcttacccgtaaaaaagaagaatttaagcctttgcaccctggagttgttaacatgtacgtctgtggtcccacggtctacaactacatccatatcggcaacgcgcgcagtgccattgcctttgataccgtacgtcgctatttggagttcaaaggctatcaggtcaattacgtctccaactttaccgatgttgacgacaaaatgatcaaggcagctgctgaacaggggattacggttcctcagctggccgacaagtttatcaaggcctttatggaagatacggccgccttaaatatagaaccagctaccaagcgaccacgcgcgacagaaagtattcctgaagtcattgactttatcaaggtcctgattgaaaaagactatgcttatgtcaaagatggcaacgtttattatcggacgcgcaagtttaagcattatggcgagctttccggacagtcgatcgatgatttggaaaccggcgccagtgagcatattacagctgaagagattcagcaaaaagaggatcctttagattttgcgctttggaaagctgccaaaccaggtgagatcaactgggattcgccatgggggcaaggacggcctggctggcacattgaatgctcggttatgtcaacgcgctacctaggcaaaacgattgatattcatgcgggtggtcaggatctgcagtttccgcaccatgaaaatgagattgcgcaaagcgaggcagagactggtcagcagttcgtccgctattggatgcacaatggctttgtcacgattggcaaggacaatgaaaaaatgagcaagtcactgcataacttcattacggtgcatgacatcatcaagcatgttgatccgcaggtattgcgcttctttatggcaaccactcagtatcgacggccgattcaatatagcgaggctaatctgcaggatgcacaaaacaatctggaacatatccgcaacacctatgacaacctgacctatcgccagcgtgatgctcagaatggcaatgacgatgaagttgctcagcgagtagcggcatttacgcagcagttcattacggcaatggatgatgacattaacgtccaaaacgggattgccacggtctatgagctggtcaaatatgccaacgtctatgcccaaaagccagtcgttaaggctgaggcgctcaagacgcttaaacaggagctggaagcgctgctggggatttttggcgtacgtttggaaacgtctaattgtgaaattgatgatcaagccattaaagatctgatcagcaagcgtaatcaggcacgggctgctaagaacttcgccttgagcgatcagattcgcgatgagttaaaggcgcaggggattattctggaagataccccgcaaggaacgcgctacagaaaggaataaaatggaaaaagccgactatcagcaactaaatggcattgccctggcttatctgggtgatgccgtctatgaggtatttattcgtcaacatctattggcactgggaatgagcaagcccaatcgtctgcagcatcaagccactcactatgtctcggccaaggcgcaggctgctttgattgagctgatgaaagccgatgatctcttgactgaggatgaatggagctattttaagcgtggccgcaatgccaacagctatactcatgccaaacacacctcggttctgacgtatcgcatgtcaactggatttgaagccttgtttggctatctgcagctgtcaggacagtttgagcgaatcaatgaattggcgcaatggtgcattaagcaagtagaaacaggaagaacaaaacatgaaaactgatgaaccagaatttattattggccgtcacccagcagtaatggccttgaaatctgatcaggaaatcaacaaggtttttattcaaaaagatttgaaagccgatattattggtcagatcgtcaaattggccaaggagcggcatttggtgatttcaaacgtccccaagaacaagttggatcaaatgaccaatcaccaaaatcaccagggggttgcgctggcaatagcggcttaccggtatgcaacgattgacgatctgtttgccaacgctgaaaaacatgacgaggcaccgtttttcttgattttagatgaactggcagatccgcataatctgggttcaattcttagaacggctgatgcagcgggagttcatggtctgatcattcctaagcggcgttctgttggtctgacctcagtcgttgccaaaacgtcaaccggagcaattgagcatgttcccgtggcgcgggtaaccaatctggtacagacggccaatgagttaaaagaacgcgggctgtggctgtttggcacggatatgcagggaactgattaccgtcgctgggatgctaagggtccagttgctttggtaattggcaatgaaggaaaagggatttcgccgctgctgaaaaaaacatgtgatgagatgctgacgattccaatgattggccatgttcagagtctgaatgccagtgttgcggccagtcttttgatctaccaaggctttaattcgcgtcatccgctttaaaatcatgccgcagtgttggctgacactgcggttttatttttattgaaaaattgaggtgattaaattatgaaacgacgcagactggtagtaatttctctcgattcaatggggtttcgcgatctaaacgagctacgcgagctgacaccgaatctggcacgcttgattgaacaggggacctgggtcaaaaaagttcgtggaatctttccgactttgacctatccatcgcacacatcgatcattactggccaatatccggcagttcatggaatcgtcaacaataccaagctgcagccgaccaggcagtcgccagattggtactggtatcagcgaaaagaaatcaaggctgcaacgctttatgacgttgcccattctgcgggactgaagacagcagcctttttatggccggtaactgctggcagccgcatcgactggaacgtagctgagatttttcccaatcgaatttggaccaatcaggtactggtttcattaaaagccagttcaccatggtttttgtatcagatgaatcataaattcggtcatttgcgcaaaggaatcaagcagccctggctggatgattttgtgacagcaatggcatcctggacgttaaaacacaaaaagccggatctaaccttgattcatctggtcgacatggacagtatgcggcatcgctatggcgtaagatcagattaagccaaacaggcactgcagcgcttggatcaaagagtcggtcagctgattcaggcaactaaggatgctggaacgtttgagcaaaccaattttgtctgtcttggcgatcattatcagattgacgtcaaccagatgattcactttaatacgctgtttgctaaaaaaggatggctgactccgattaagaaccagcaaacctttaaaaacaattggcgggtaatggccaaaacctgcgatggcgaaacctacgtctatgtgcggccaggaatcgatcgtgatgaggtcagacgagaaattgccggggttaagggaattgagaagatctatgacggtgctcaggcggttagactgggggctgatccgcgctgtacgtttttggttgaggccaaagccggttggtactttactgatgaggcccagcgtccggccgtcgttgaatcggtcttgccgtcaatgatgggcacaagcgatcgctaccgtggcgtgcatggctatggggccgataagccagactattttacgaccgccgttttttatggaccggatatcaaaaaaagagcccaggttgagcatgctgagttggtagatgaagggccaacttttgctgagctgcttggcttaagctatcccagaccaactgccggcaagccgatcaaaggaatctttaagaaagtgaaacatgaaatttaacaaacagcagtggcaatggatcttttatgactgggcaaattcaggctatggcattttggtcgtaaccgcagtcctgccggtatattttaaggcagctgctcaccagaacgggatctcagccgcgctctcaacggcattatggggatatgccaacagcgcggggactttggtcgtttcgcttttagcgccttttttaggagcaatggcggattatccttatgccaaacgacgctggctgaactggtttgctggcttgggtatcattatgacgatgattctgggggctttatcgccaaatgcctggcaatggctgctgatcatctatgttttgtcagcaatcggctattcaggcggcaaccttttttatgacagctttttaaccgacgtggccgactatcgccaaatcgatgctctgtcagcaactggatacggtatggggtatctaggtggggttatggcttttttgatctttttgacagttgagctgggtcatggttttggctggctgaacgattatggaattgcgcgcttcagctttatcttggctggcctttggtggatcatttttggcttgccgtttctaaaaaatgcccatcaacgctatagcgtgccaaaagaacaaaaaccgattgtcgccagttttgcccgcgtgataaaaaccatgcggcatattcggcaatatcgagccgcattttggtttttggttgcgtatttcttttatattgacggcgtcgacacgatttttacgatggctacttcgattggatccgatatggggattgatactaccatgctgatggtcgttttattagtcgtgcagctgattgcctttccgttctcaatctggtatggctggctggccaatcgcacttcaacacgacgggctctattgctggggatctgcgtctacttgtttatctgtctgcaggccctgcatttaaagacgctgcgtgatttttggctgctagccgttttggtcggtactagtcagggcggggttcaagcgttgagtcgttcttattttggcaagttgattcctaaagaaaacagcagcgagttttttggcttttacaatattttggggaagttttcagcaattattggtccggttttggtcggaatcgttacgcagttgacgggtgagtcaaccaagggagctgcctcattagccgtcttatttgcagtggggcttttgatctttttgagactgcctgcaccttcagattagtttcactttccatttataagtaaagacggcataaatgtaaatatatgaaagtatatttatgtcttgtaaccgttttacttatcatgtatattaaaaataacaagcagggggtgcagaccttagacggaaatcgccggggcaatgcatcaggtaaaggtgcactgcttttctatcagtttactgatcagtcaaggcaacccgaatccatttgctaacgagaggaagaaaatgacgaaagcgagaatcggtgacgctgattttctagcgtcagctgctgaaaaagcaattttacgcgaagcaaaaagtggcaatccactggcaattcaaaaactgttcgttagttatcaaagacttttttgctatgcatggcaaaaatatcatccagctgatctgtctttgcatgattggcttgcaaatatgtatcagctgctttatcaggtcgttttacattatgatgatcaacagaatgcatcgtttggccactatctctatcgttctctggaaaacttcgccaagggtcagtatcgtaagtgtcgtgcccaaaagagaataccggcagattgtctggtgagcctgagtgatcagctgccaatcgccagtcaagagtcaatggaagaacgaatctattgtcgtttgatttttgaaaactttttagattacgatctttcaaattttgaacgtgaggttttagtagccagtctgtttatggacatgccggcgttgtgcaaaaaattcggctgccatcagcgtacgatccaatccgctttatcacggtgtcgaaagaaattgattttggctttgcaggcttaagtgagttgcttttatacctgggtccatgataggctagacaggtaaaattggaggcatcagatgactcagaaaaaagcggcactggaatgtaccaaatgcggtgcgcgcaactatacgataacggtcaagcctgatcgcgaatcgcgtctggaactaagcaagttctgcaagcactgtggtgaatatactttgcatcgacaaacaaaataagggacgatttcaatgaaacttacaaaattcgtaaagaacgtcaatgctgaaatgcataaggtagtctggccaactgctaaagaaacgcggcgggacacgactacggtagtttcgctgacgattttctttattatcttttttgcgattattgactggctgctgcaccagttcatgctgctgattgttggctaattattggtcaaattgcacagaatctggtatactgctgtttggttaaggagacttcgctttaggcggggttttttattttgaacttttttggttttacaaaaatggaggaacaacgtggaatcaactgaaaagcgctggtacgtgctgcacacgtattctggctacgaaaaccgagttaagagcaatttggaatcccgggctcagtcaatgggaatgcaggactatatttttcgggttgtcgtacctgaagaaaaggttcgtcaggttaaagatggtgaagctaaggaaattgaagaaaaaactttccctggctatgtcttagtcgaaatggttatgactgatcaagcatggtacatcgctcggaataccccaggcgtaactggctttttgggttctcacggtggtggctccaagccaactccactgctgcctgaagaagtcgatcgcattttaaagcggatggacgactcagaagagacaccacgtactgatattgacgttaaagtcggcgatacggttaagattattgctggaccatttgctgacatggttggcaaggtaaccgaagtcgatcatgataagctgaaactgcgagctgagattgaaatgtttggccggctgacttcagctgaggttggctttgatcaaatcgattcagtcgaataatcaagatatttttaatagctgactattgaaaaaacagtgatttagtggtattcttctcgagtatgctatttaacgcatacagtgggaggggcaaatcttactaccccatcattaccacaacacggactaaggaggttttgtctcgtggcaaaaaaagtagctaacattgtcaagttgcaaatccctgcaggtgccgctacgccggctcctccagtgggtcctgcacttggtcaagcaggtattaacatcatgggcttcactaaggagttcaacgcacggactgctgatcaaaagggtatgattatccctgttgtaattacggtatacgaagaccgttcgttcgaattcattacgaagacgccacctgctgctgtactgctgaagaaggctgctggtgttgaacacggttccggtgaacctaacacgaagaaggttgctactgtaaccaaggatcaagttaagcaaatcgccgaaactaagatgcaagatcttaacgccgctgacgttgaagcagcgatgcgcatgatcgaaggtacggcacggagcatgggcttcgtcgttgaaggctaagctttctcgtaccgggctgattcatgaaagtgaacagtcttagtgggaggtatacactccgttagaccacatttgcaaggaggaaaacatcaacatggctaaacatcgcggtaagaagtaccaagacgccctgaagaaggttgattccaagaaggaatacgctgtcagcgacgcggtacaattagtaaaagacattgactttgcaaacttcgactcaaccctcgaagttgcatttaacttaaacgtagacacgaagcaagcggaccaacaattgcgtggtgccgtagtgctgccaaacggtactggtaaagaccaaaccgttgttgtgtttgcaaagggtgaaaaggctaaggaagctgaagctgctggtgcagacttcgttggcgaccaagacctggttgacaagattcaagacggttggctggactttgacgttgccatcgcaacgccagacatgatgccactggttggtcgtctgggtcgggtattgggtcctaagggcttgatgccaaaccctaagacgggtacggttacgatggacgtagccaaggctgtttctgaatccaaggccggcaaggttacctaccggactgaccgtgacggcaacgttgccgttccattcggtaaggcatcctttgacacggacaagctggttgaaaacctaaagacgattgaagaaacgatcgttaaggttcgtccagcagccgttcgtggtgcttacatcaagcacgtttcggtagcttcgacttttggtcctagcgtaacgattgacctggctagtttctaagccaatggtttaaaattgaaaaggtcatcaaataattttgatgaccttatttttgtctaaaatcatgtaagcgctaacattatatgttataatatagatgtagcaaaggtagcaaccaaatgaggtgatgcctaatggttaagatgattcgagcagtaacaaaatagcttcaccacgggataaagaaatggagctgataccgatgggctgtgaaaatagttagtcattttaggtgagcaaccgaggtggtatctgatggttaagatgattcgagcagtaacaaaatagcttcaccatgggataaaggaatggagctgataccgatgggctgtgaaaatagttagtcattttaggtgagcgaccgaggtggtatctgatggttaagatgattcgagcagtaacaaaatagcttcaccacgggataaaggaatggagctggtaccaatgggttgtgaaaatagttagtcatcgcttagctgatcaggtaggattgatgtccatttaaaacggggcgattttatgtttaaaccaccataaaaattaagatgataaaattgacaaatcgatgaattaattagaaaagcaatatgataaaagaaactgaaatcaaaaagcgatcgtgagagtaaaacacgatcgcttctttagtttatctaaggctaatcattagctgattgatcaagttttttaacaatccagaacacgggcagcccgattacgaccacgccggcaaaaagcatgacaccggctggatcattgatgatttcactaatcaagacaaagatgccgccagcaattgcaataattggaatccaaggataaagcggtgtggagaatggacggggtgcttcattggtcttgcgaagaatgaagataccaaagaaagccaaaatataaaaacagtagacggtaaatacgcatagatccgacagatgatcaggatcaaagaacagcatcatgatggtagccaacagaataatgaaaagcgttgcaacaaccggtgattttcctttaggggtcaggtaagacaaggcccgagaaaatggaatgtcgcgccgtttagccatggcatagacaattcttggaaaagtcagcatcttaccattgatcgttcccatcattgaaatgataataccgatggacaaaagcttgccgccaatcgttccaaaagctttaaccgctagataggcagtcgtgttctctcctagtcggtggatcgtttggactggcaaaaagcggagaacgccaattgtaattaaggtatagatcaataaaacggcactgattcctaaaatgattgctttaggcagcagcttttgtggatttttcatttcaccacccaaattggcgattagaatccagccatcatagccaaatagagttgccaggatagcaacaccgaaattgcctgccgattgatgtacttgactgagcgtctggccaaaagcgtgctgatgtccccaaaataagccaaaaataataattgcagcaattggaatcattttggcaatcgtagtaattacggaaaatgttgccccaacgcggttttccagcatgttcatagcaccgatggcaagaatcgttatcacagcgagagggattcgccaagcggagctgagaccgaaaagattagccatcaaaatactcataaatcctgctacagaagcaataattgcaggaccataaacgataatctgcatccagccggctaaaaagccccagatgcgaccgtaaagattctcgatatagacatacaggccgccagtatatggcatctgcgaaccgatttcagcaatcgtcaggccagccgttaaagtgataatccctcctaaaacccaggcgaggatggccatggttgaagatccggcactatccaggaccgaaccttgtttaaagaagatgccggaaccgataatggtgccgattacgatcgaaagtgctgagccgaaccctagcgagcgtttcagctctgtttgtggctgtttttccatatagaaatcctccattcattttgccaacaaaaaaaccgagctgctcaactgcagagaaagttctaaagcagttaagcatactcggtgctgttggtgatttgagtacgtcaaaattcctcaactgcttttaaattggagctgaggatgaggattgattgattttagaataatgctgaatcattaaacgcacctcttgacgctggaaaaatttacaaagcttacaataacatgagaaaaaattaaacgcaactaattatgattgaaaataatttggagaaatgttattgcaatctcgatctaatcctgttatactagcgaagttgattaaatatgactctgcctaagactcaggtggcaccagccttaattaatgcctgccgaggaagaaatgaaatgttccttctctatgtctgccggtcatagggatttttttaaatccgatcaaaatacatcgcaggaggtgaaattcatgagcgaagcaacgattgctaagaaggctgaagcagttaagaacgtcaacgaaatgctgacgaacgctgaaacggccattgttgttgactaccgtggtctgacggttgccgaagttacggatctgcgtaagcagttgcgtgatgctggcatcaagatgatggttatcaagaacaagattctggaacgtgccgttgaaggtacggactacgaagatctgaagagcacgttcgttggcccaacggccgtagccttctctgacgaagatgctattgccccagcaaagattctgaagaagtttgctgacgaccacgaagctctggaaatcaagggtggcttcatcgaaaagaaggttcaaaccctcgacaagatcaacgaatacgctacgctgccaagtcgcgaagacctgctgtccatgctggcaagtgctctgcaagatccaatgcggaagattgcccgtgcagtcaaggctgttgccgacaagaagagcgaagaagaagctgcctaagtttctcagcgtacccgctaaatttaaagatctgcgcctaagcgcataaaccgaaatattggaggaaaataaacatggcttttgataaggatgctatcattgcttctctgaaggaagcatcaatctctgaccttaacgacctggttaaggctatcgaagaagaattcgacgtttctgctgctgctccagttgctgttgccggtgctgccggtggcgaagctgctgctaaggacagcttcactgttgaactgacttctgcaggttctgcaaaggttaaggtcatcaaggctgttaaggacattactggtctgggcctgaaggacgctaaggacctggttgacaacgcaccatccgctgtcaaggaagacgttaaggaagacgaagccaacgacatcaaggaaaagcttgaagccgcaggtgctactgttacccttaagtagtctcagcttaataataaaaaagacgatcgcaatgcggtcgtcttttttattatcataatctaatgtctactagtaaattacaattttatttatataaaaaatacctttgtaaataaatttacctaatattaacttgattagtggggcgtttctttactttgacagtctatcctaaaacttgacaggagggattgatttgagtgaagagaatcaaaagaagctgtttggcatctcagcaattatttgcattattttattaacgattgcctattttggtgatttagccatcagcaatactttaattaattatcacagctgggtagggacgttttgccagacttttggcgagtttccggtttatcttatttttgccttatgtggacagattgtgatgacttatgcctggcgaggcgactgtgaaaagctgctggcaggaccgttgtttgttggcgggcttgcactgtcgctttggcagagcaagcagtatgtcaatgaattcttgggctatctgtattcggcacaaactaaccttaaaaacggtacggcgatagcaatggccaacagcgactcagcaacgggcggttatgcaggctcaacgattataatggtctggctgctgtttttcgttatatttacgctgttggtacaatggtggctgaaaaacaaaacgactaaacagctgacccgctatatgaaaattgcgattttggcgtcattgacggtttggtttgcattggaagttaatctgaccttaaaagacctgtggggacgctatcgcccatatgaactcacgagcggcaatcatgaatttaccaattggctgacgatcaatggcgttaatgggcataagtcatttccatccgggcatacgatggcggcaacgctatgcatcgttttttcatggttcgtttccaacaataagcgtaagagctttttcattggtggcatcgtttatggtgtcgtgattgctataagtcgagtaatcgtgggcgcacatttcttttcggacgttacgttctcgtttttcctgaccgcactgatcatctttatcatgaatggtcttggtaaaaagctaattgaagatttttaaaaataagggctgtgattatcgaaaggtgaccacagcttttatttatgtgttaaatagctcaatggtgagctaatttgtgaggaatggagacggattttaaagattatcatacaaataatccctgttttgactattaaaaataaaaaatagctgaaaaaagttgtgaatcagcatacaaaaagtgtgaggaaaaatcgcttaaaaccattataatggccccaaataaaaatatttttagacttcattcctactgcggcaagggttgacattatagtattgtaatcgctttctgtaatgtcggaattgttatttatttcacaaaaagtatttacaaatctagaaaaaagagtatagtaataattgttcaaaggataacaaagttgttgaaaagtaattaatcgagaaggagctagtgcaatgacagttaaagctaaagccactgttaaggccactgaaaagcctaaagacaaggaacaaaccgctgaagaactgattaacggcttgattgataagagtgaaaaagctcttgatcaattacgcacatttagccaagaacaggttgacaaaatttgccaaaaccttgcattggccgctgaagaacatcatatggatctggctatttcagccgctgaagaaactggtcgtggggtagctgaagacaaggctatcaagaacatctacgccagtgaatacatctggaacaacatccgcaatgacaagacggttggcattatcgatgaagatgatgaaaaccaaatgattacgattgctgatccactgggggtaattgctggggtcgtaccagttaccaaccccacgtcaacggttatctttaagtcgatcattgccttaaagacgcggaatacgattatcttctcattccacccacaggcctttaagtcatgtctgaagactggtcagattttggaagccgctgctgaagccgctggggcaccaaaagacgtaattcaatggattccacaatgcagtcgtgaaaatacgacggcactgctgcagaattctcgtatcgccacgattttggctactggtggccctggactggttaaggcagcctacagttctggtaatcctgccttgggtgtcggtcctggtaacggtcctgcctacattgaaaagagtgccaacattgatcgttccatctacgatatcgtattatcaaagacctttgacaatgggatgatctgtgccactgaaaactcggttgtcattgatgacgaaatctacgaccaggttaaagaagcctttaagaagtggaactgctacttcttgaagccaagcgagattccaacgtttaccaatggttttattgatcctgatcggcaccaggtccgtggtccaattgctggtcgttctgcaaatgatattgctgaaatgtgtgggttgaagaacgttccagctaataccaaagtactgattgccgaattggatggggttggtcctaagtatccactgtcagccgaaaagctttcgccagtactgacaatgtaccgtgccaagagtcgtgaagatgcattccggatctgtagcgaactgctggcctacggtggtgaaggtcacacggcagccatccacaccaacgatgatgaattgatcaaggaatactcactgaagatgaaggcttcccgaatcatcgtcaactcgccgtcaggtcttggtggcattggtaatgtctacaacaacatgacgccatcatttacgctggggacgggttcatacggcagcaactcgatctcgcacaacgtttctgactgggatctgttgaacattaagaaggttgctatgcgtcgtgataatccacaatgggtacagattccgccaaaggtctacttccagcggaactcactgaagtacctgaaagaaattccaaatatcaacaaggcatttatcgttactggtccaggaatggttaagcgcggttatattcaacgggttattgaccagctgcggctgcgcaacaaccgggttcaatacgagatcttctccgatatcgaacctgacccatcaacggatacggttgacaagggtgttgcctggatgaacgacttccagccagacacgatcatcgcactgggtggtggttcgccaatggacgctgctaaggcaatgtggatgttctatgagcacccagacacgacttggaatggggttcggcaaaagtaccttgatatccgtaagcgggcctacaagatcggccggccaaagaaggcacaatttatcgggatccctacgacttctggtaccggttctgaagttacgccatttgcggttatcaccaactccaagacgcatgtcaagtacccactggctgactacgctttgacgccggacatcgcaattgtcgactcgcaattcgttgaatccgtgccagccaacacgacggcctggactggtctggacgtcttgacgcacgctacggaatcatacgtttccgtaatggcaactgactacacgcgtggctggtcgctggaagccatcaagggcgttatggaaaatcttgaggcatccgtcaagggcgacaagctggcccgcaagaagatgcatgacagctccacgattgctggtctggcctttgccaatgccttcttggggatcacgcactctttggctcacaagatgggtggggcctttgatctgccacacggtctggtaattgcgattgcactgccacaagtaattcgtttcaacgctaagcggccaaccaagctggcaatgtggccacattacgaagactaccgtgctgacaaggactatgcagcgattgcccgtttcttaggcttgaagggcgatacgactgaagagctggttgaagcatacgtacaaaagattatcgaattggctcataagtgtggcgtaacgctgagcttgaaagctaatggcgttaagcgcgaagactttgacaaggtcgttgatcaactggccgttctggcttatgaagaccaatgtacgactgctaacccggttgaaccactggtcagccagcttaaggaactgttggaacgctgctacgaaggcactggcgtcgaaactgaagaataggctgttgatttccaagcactctcaattaatcttctcaacttaaaatctcaactttaaaagacggtcgcggatccatgaccgtcttttttgatttcaattaaaaaaatatgagaaaaaggttgacaattcattaagaaggatttagagtattagacaagttaatcaacggaacaaaacacgatgatccggagagtaaggttatggttggctgatcagcgaccccgatgaagtgtgagcggggacaggagccataactggaaagtagccggtgagtggccgatgcgacgtaagaagtgtcggacgggtgcgcccgtgatcgcgccagcgtatgaacacgtacgcgttaaggcttaattggcgacgattaagcaaaaaaaggtggtaacacgcgaaagcgtccttttcaaatcatggtctgatttgaaaaggacgcttttattttccgttgatcacgaaatcttagctaagatctctttttaaaattcatttgttgattgaaaggggattgatttttatgaatacgaataaactgactttccgtaatgctttattgattggatcattaatttttgggatgctttttggtgccggcaatctgatctttccggttcatttgggtcagatggcaggggcgcattggctaagcgcggctggcggctttttgatgtcgggggtgctcttgccgctgatggcgctgctggcaatcagcattacgcgctccaatggaatctatgatctggcgcgtcctaatggtgcctggtatgcacttatttttctgattttggttcatgcaacgctaggacctttgttcgccacgccacggacggcaaccgtttcatatgcgattggtattgcgccgcatctttcggccagtgccaacacctggggaaccttgatctattcagcagccttctttggcttgacgtactacttctcaactcgggaaggacgaatcaccgacacgatcggtaaaatgcttaatccgctgtttttaggcttgatgtttattattttctttatggcatttatcagccccatgggacacgctggttcagctgccatcacggctgcttatcgtcacgcttcatttaccaacggctttttgcaaggctacaacacaatggactgcttggcttctttggcctttgggattacggttattacggcgatcaagggattgggtatcaagcgtcagcgcgatatctcctgggcaacggctaagggaggagctttgggtatcattggtattgctctgatctacattgccttgatctggcttggtgctaccagcctggcgcactttaagatggctgataatggtggtacgactttggaacagattgccaactactacttgggcacggcaggcgatgcaatcttggcagtcttggcaacgacgacctgcatgaccagtgcaatggggctggtagttgccttttcacaagatttccaccggcgttttcctaagatttcctacaaagccttcctgcgcttcaactgcggtctttcattcttggttgccaacctgggcttggatcagattattgcctggtcaacgccgatcttgatgttcttgtacccattggcaattacgctgatcatcatggggatcatgtcgccgctctttaaaaatgatccattggtttaccgcatcacgactggctttacgctgattccagctttctttgacatgatgaacgctacgccggctattttgcataatacggctgccgttcaggcaatgatcagctttgcggctaaattcttcccgttcttcggtcttggcttcggctggctttcatttggcattgctggcctggcactgggcttgatcattcactttgctaaggaacggatggcttcaccggcaatcagtgaggattaagattactgaaatagcaagcaaataaaaacgtgcgaatgcagctgctgcattacgcacgttttttatatattagtctttttcgttgatgtctttgccggcattaggatcagcaacatggtagtcactgtcatgcatggcctcaacctcaccgagtcggtagccattgccgacctgactgaaaaagtcatggttggaagtcgtggttgaaataccgttcattacgactggattgacgtcactggccgtatctgggaacagcggatcctgccctagattcatcaaggctttgttggcattgtagcgaatgaacgtcaagacttcatcggtccagccaacttgatcgtacagcaggtgggtgtacttttcttcattgtcgtagagttcgtataagaaattgtacatccagtctttcatgtcctgttgctgcttttcggtcagatccttcatgccgacttggaacttatagccgatgtaagttccgtgaactgattcatcacgcaggatcagcttgatgatttctgccacgttgttaagcttgttgtggcccaggtagtacagtggcgtgtagaaaccagaatagaacaggaatgtttccaaaaagacgttggcaacttttttcttcaaaggactgacgcttggatccaggtaaagattgccgatccgcgttgccttgttttgcagatattcttcagtatcggaccagtcaaagatttcactgatttcttcaggggtattcagcgtagaaaaaatcgtggagtaagacttggcgtgaactgattccataaattgaatattgttaagcacggccgtttcatgctgggtcttaacattttctttcaaggccgtcaaaccagcttccgactgcagcgtgtccaaaagcgtcaagccaccaaatacgtgaccaacgacccactggtgatcagtatcaagctcgcgccaatcatccatgtcgttggaaactggaatccgtgtatccagccagaactgttcggttagtttttcccaggtggctttgtcgatcatatcagagacttcattccaattgatcgcctggtagtttttaagcggtacaaaattctcaatcttcattattaagtggggctcctttagtctttaatgattccaataagttagataacgcagctttcgcattggttggcaccgatctcatcttgatcatcggtaaacgtccgaatatagtagatggatttaatgcctttttgataagcataatggcgcagaatgtttaagtcacgcgttgtcatcttatcagttcgattatttttccattcgtacatcccggctggaatcgtggaacgcataaacagcgtcatcgccagtgattgatcaatatgttcctgagcagccgcataggtatcgattacgctgcgcatgtcggtatcataagccgacttgtagtatggcatggtatcgttgctgaggtatggtgccgggtagtagatcttgccaatcattttttcctgacgctcttcaatccgattgatgattgggtgcaggctggaagtcgagtcgccaatgtatgacgtcgatccattcggggcaacggctaaacgataggcgttgtagagaccatccttttgcacggctgctttgagctcctgccagtccttgataccaggaataaagatgccttcaaacagctgcttgaccgttgccgacttaggcccccagtcttgactgacgtatttgtcgaagtaggagccatctgcatacgtgctcttttcaaattcggcaaacgtttcatgacgttcacaggcaatgtcgttggaggctttgatcgtccaatagttgagcagcataaagtagacactggtaaattccagggcgactggcgagccatattgaatgtgatgcttggccaggtagccatgcagtcccatggcaccaagaccaattgcgtgagccatgtcgttgccgtgctcgattgatggaacgacgtcaaggtgctcaatgtcactgatatgggtcagtccccgtaccatggcactaactgagcggccaaagtctggcgtttccatcatgttggcgatgttggtggagccaaggttgcaagaaacgtcggtccccagcttggcaaacgtctgatcatcgttaatgattgacggccgctgaacctgagcaatttctgaacaaagattgctcattacgatcttaccgtcaattggattggcacggttgacggtatccagattaacgatgtatgggtagccggattcttgctgcagcttggagatctcatcttctaagtcgcgagcgttgactttgtatttggtaatggcgtcattagcgaccatgttctcatattcattggtgatgtcgacgtacgagaatggcacgccatagatgcgctcaacgtcataaggactgaacagatacatctcttgattggcttctaccagctcgtaaaatttatcgggaacggtaatcccaagcgaaagcgttttgattcggatcttttcatcagcattttctttcttagcagacaagaaggccacgatatcgggatgaaagacgcttaggtaaactacgccggccccctgccgctgacccagctgatttgagtaggaaaaagagtcctccaaaagcttcatgactgggacgaccccactggcagcacctttgatctttttgattggtgcgccagcttcacggaggttggaaagattgatgccaacgccaccgccgatcttggaaagctgcagggcagaattgatcgtccgtccgattgaattcatatcatcggttgcttgaatctcaaaacaggatacgaattcgccacgccgtttgcgacctgcatttaaaaaggttggcgtagctggctgatagcgctggtgaatcaattcgtcggccagctgcatggccagttcctcattgccgtcagccaaaaacaaggcgttcatggcaacgcgatcaatgtagttttccaggtagtattccttatcgttggttcgcagggcatactgggcgtaaaacttgtaggccgccataaatgaatgaaaatgaaaatcctgggcctttaaaaagtcgtagagctcttcgatgaattcaaagcggtacttgtgcataaagccggtttcgatataatcgtttgcctccagccagtcatagcgttcctttaatgaagcaaagcgtttggtgttgggcaaaacgttttctttgataaaatcagctaaggcttcatgatccttatcaagctggatttgaccgtctttaggaatgttgagttcattattgaggtcgtagtattttactttggtgaggtcgatatctgatagtgccatggataactcctttttccagtgcaataaaaagcgggcatcgtgcaaaatgattgaacgatccccgggaataacgcggtatacattgacaattaagccaattgcttcagcatgtcaggacggaagccagtaaaggattgaccgtcaggcagcttgattactggcgtcgccttaaaaccgtcagctttcagttgatcaacatattctggatgctcatcaatattatgttcaacaaagtcaacgtggtgctgcgttagaaacattttggtcatcttgcattgaatacagttgtttttagagaaaacagtaatcataaatctcaatcccctttaacttttcgttaatttaatgttttatagtatagcgggttatgaagaaattacaagcattgacatactatataatgtgcgcttgcaaaacgtaaatacaacatgtggtagctaagcgataagggattgaggtgctgacagctgcggcaaattttttattttcaatgaagattgcttcataactcacacggtagaaaaatcacaaaaaccattatacactgattaataataattgataagggagaaaaattttgcaaccggaagattatatggaaatggcgctggcagaagcaagacaggctgaattgatggatgaggtaccgattggggccatcgttgtctatcatggcaaggtgatcggtgccggtcataatatgcgggagagatttcaaaatgcagcctatcatgccgaactgctggccattatggaagcctgcgagtatctggggagctggcgactggaggaatgtgatctgtacgtaacactggagccgtgtatgatgtgcagcggtgccattatgaactcacgaattcgtactttatattatggagccaaaaatcccaaagccggcacggtcgagagtctgtatcacctgctgagcgattcaagattcaatcatcaagttgagattagatcaggggtcaaagaaaacgagtgtcagcagctgctcaaacaattttttaaacgggttcgcaaagcacgtaaagccgccagaaaatcagctcagcaaaagaattaacagaagactggcatttagttttaaaatagtgtaagatattatttgccgtaaggtcatggggcaaggttgtgcctacgaatcgtgtcaggtccggaaggaagcagcactaagttcgctacagcttgtgccccatgttttttatgaagattaaccgctgtgtggatcgtttcgcacggctttttttatgtacaaaatatttttcaatcgaattgcaacgattttactagtataataacgataatacggatttttaccagaaaggaagcagtcaagatgagctatcaggcgctttaccgagtttggcggccccagcgatttgacgagatcgttggtcagcaggtggttacgcagactttaaaaaacgcgatcataaccaagcagatcagtcatgcttatttgtttgccggcccaaggggaactggcaagacctcagcggcaaaaatcttcgccaaagccatcaactgtcatcatcggcaagacggcgaaccctgcaatgaatgcgagatctgccaggcaattactaatgggcagcttggcgacgtgattgaaattgatgctgcttccaacaacggggttgaagaaatacgcgatattcgcgacaaggccaagtatgcgccaactcaagccgactacaaggtttatatcattgatgaagtgcacatgctttcaactggggcgttcaatgctcttttgaaaaccttggaagaaccgcccgctaatgtgatttttatcctggcaactaccgaaccgcataaaattccgctgactatcatcagtcgggtacagcggtttgactttcggcggatctcggctcaggatgcttttgagcgcatgcagtatatcctggatcaaaagcacgttgaatatgaaaatgacgcgctctgggtaattgccaatgctgctgagggtggcatgcgtgacgcactgagtattttggatcaggtcttgtcgtttagcgataatcaagtcaggctggatgatgcgcttttggttaccggcagcgtcaccaagcagctgctgaaaaaatactttgatgagacgaccagtcatcaaagtgccgcggccctgcatacaatgaaagaaattctggatcagggtaaggatggtcagcgctttatcgaagacttgatctcatttattcgcgacgtactgctttatcaagaatcgccacagttggtcaacgtcgcgggatctggacttaaggaagccgattttcagcagttgagtcaggctgccagtgccgatgagctgtaccaaatgatcgacgaattaaatgagattcaagaagagatgcgctttacgacgcatcctgacgtctatttggaagtcttgacggtcaagcttagtcaaatcaaaccgcaagataataaaacgagtgcgacggatccccgcctcaatcagacgattggtcagctgcagcaagagattcagcagctgcaggcagcaattgccggcttaagacaaaccggcagcagctcggcatcccggattgtccgacgagcaggtggcaatgctggcaataaaattcagcctaagatgacggttaagctggatcgcgtctatccaattctggaacatgccactaagcagaatctgcgtgggctgcaggaaatctggggtgatctgcttaacatgctggatacgccgcagcgagctctgatcaatacctcccagccggtagcggccagtccgcaaggcgtcgtggtttcatttgacagcagttttttgctgcagcgtgccaacagcggcagcttagcagcagatatggaagctggcctgcagcgtctgtcaggcaatgagatgcgcgtggcattcgtgccgatggatcagtggccaaagatccgccataactatttggtagagcatggctatttaaatcaaggcaaaaccggtactgataaaaaagattcatcagctcagtcagcaccagccacgccagttaaaactgatccactgattgataaggccaagcaaatgtttggcgatttggtaaagatagaagataattaagcaataacataagtaaaggatggataataactatgatgcgcggaatgaacatgcaacaaatgatgaagcaggctaagaagatgcagcaaaagatgatggaagagcagcagaatctggctaaggaagaatttattggcgtctcgcctgatgaaatggtcaaggcaacttttaccggcgacaaaaagctgactgacctgcagattgatccgcaagccgttgaccctgatgatgttgacatgctggctgatctggttttggcagccgttaatgatggcctggaaaaagtcgatgccgccacgcagcaaaaattcggcaaatacactaagggcttgaacatttaaggaggcttggcgatgcagtatcctgagccaattgccaaactgatcgacagctatatgaaactgccgggaattggcgaaaaaaccgcgactcgccttgctttttatacactgggaatggaccaaaaagacgttgaggattttgccaagtcgctcttaagcgtgaaaaaagatctgcactactgcagcatctgtggctttattaccgaagacgatccttgtccaatctgccgagataagttgcgtgaccgttcaacgattctggtggttgagcattcgcaagatattatggcaatggagcggatgcacgaataccatggcctctatcatgttttgcacggttccatctcgccaagcgaaggaacagggccaatggatatcaacatcccggctttgcttaagcgcctgcagaaaaataccgaggtcaaagaaatcattgtggcaaccaatgcctcgctggatggtgagaccacggcacaatatctggccaagctgatcaagccggcgggcatcagagtcacccgtttggcccatggactgtcagctggcgccaatatcgactatactgatgaggtaaccttgttcagagcagttcaaggtagaacggaaatgtaggtgaagatcatgttttttaagcatcgcaatccccatgccgttgaagagctgggtaatcaaaagctgttggaactgatctacaatgtcaaggatagttgggatcatgccaaagaaaccgagcacgctgtctatgaagggcaggttgataatgagctctacagtcgaaccaagctgcaggagcaaaaatatctgtacctttatactaaagcgcgtcgcaattatctgcatggctatttaaacgacagcgtaatcaagcagtagttgaggaacgacaatggacggtaaatttatttcatttgaaggaccagatggagcgggtaaaaccagcgttatgcgccagattacggctgacctgcaaaaacagctgggattggatggcgttttgtataccagagagccaggcggcaaccatatcgctgagcagattcgggatgtcttgtttgacgctcgcaatatcgacatggatccgcgcacggaagcactgctgtttgccgcagcacggcgccagcacttggttgccgatatcatgccagcgctcaaaagcggcaaggtaattctctgtgatcgctacgttgacagctcaattgcctaccaaggcgctggtcgtggtctgggcgaggataacatctggcagatcaatcagtttgcaattgatggcttgatgccggaactgacgatttatctggatattgattccgaactgggccttaagcgtatcgcgcagaatcgtgctgatcaggtcaaccgcttggatgaagaggcgctgtcttttcatcgcaaggtcagaagtgcctatcagaagctggcgcgacaaaaccctgatcgcatcgttacgattgatgccagtcagccgctgacacaggtgatttcagcaactcgtttggcaattcatcagcgctttgagcaactgttttaactaacgcgactttttaaggagggcttattatgaaaatgattatggcaatcgttcaaccaaaagatgccggcaagctgcgggatgcttttatcgacaacaatatcggtgcgaccaagctgtcatcgacgggtggcttcttaagagaaggcaacaccacttatatggtagtcgtagaagatgatcgggttgatgaagtattggaaatcatcaagcataatgccaagtcgcgtgaacagtacatgaccccggcagcccagatcgacaacggttcatcggccattccgattaacgttcagattgggggagcaacggtctttatcctgccagttgaaaaatttttacagttttaagttgcaaaccggtcaagacgaggtgatccaaaatggcaaatgccacgcaatcaaaatggcaagctgaacggctgcagccagcaatcagtcagcgtctaaaaaaaaccatggttcaaggtgaactggcacatgcctatttgtttgcaggcccgtctggatcagggaaaaaagcattggcgcagtggatggccctgcgccttttttgtgaacagccgcaagctggtgagccggatggaacctgcagcgaatgtcagcgaattctttctggcaatcatcctgatgtggttactgcagctccagagggtcggcagatcaaggtcgatacgattcggcgcctaaaggcagaatttaccaagagtggcgtagaaggcagtcaaaaactgttcatcattgaagatgccgaaaaaatgacgacaagtgccgccaatagtctgttaaaatttattgaagagccgctgcctggcatttatattctgcttttaacaaccaataaaagtgccgttttgccaacgattcgttcgcgcacccagattattgagctgcagccgctgcctaaaaagattctgcaggagatgctggatcaagctgagattcccgttggcctgcagtcgattgcattagggttaactgattcaacggcgcggattaaagaatggatggaagacgactggctcaatcaagcggtgcaagctgtcgtgcagtggtacaaagaatgtggtcgggctgatctggtagcctttgtcacggttcagacaacgcttttgaaagtggctggcgatcgtgaaaaacaaggattgatcctggatttgatggctttgatctggcgcgatacgctgatggtagccaatggcgctgatgaagtcgatgatctgcatttcaatgaccaattgacgatgatcaaagaaatcgcgcagcactatcgactggatcaattactgaaggtcagcgaactgacgcttgaaaccaggcatttaatggatcagaacatttcatttcaaaatacggccgagcagctttcactgcgcattatcaatgtcttgcagcgatagaaatggggaaagacacaaatgagtgagcgagtagacaaaagcaagatttatgaacgattcaccagagttaccaagcaaaccaaggatctagtcgacagcatggaagaattgcagtcaatgatgacggcggttctggaagaaaatgctgagttgtcgattgaaaacgagcatctgcatcaaatgctcaaacaaaagcatcagcaggcaaccaaagacggcttgaccgattcaagacgcaacctgcaaaagttgtatcaagaaggctttcatgtctgcaatgaatactatggcaagcgattggatgaagacgattcatgcgcgttttgtctggatgcaatctatgggcgccacgatcagccgcaaaagtaagggtgatatttatgcaacagattcgcagctttactgataatgaaacgggacgactctacttggtgccaacgccaatcggcaatcttgacgatatgacgtttcgagccgttaagacgctggcggcagttgatttgattgcttccgaggacacgcggcatacgcagatgcttttgaatcattttgagattgataccaaacagatcagctttcatgagcataataccgaacagcgaattccacagctgattgagcttttaaagcaaggcaagtcgattgcgcagtgcagtgatgccggtatgccatcaatctctgatccaggtcgggaactggttgcagcagcggttgcagccggtctccaggtcgttgcactgcctggcgccaatgcggggattacggccttgattgcctctggtcttaacccgcagccattttatttttatggtttcttaagccgcaagcatcagcagcagattgcagaattgacgccgttaaatcaacaccaggaaacgatgatcttttatgaggcgccacatcgactggcaaaaacgctgagttcgatggccgaggtttttgggttggatcgcaaagcagtcttggcaagagagctaaccaagcgttatgaggagttttgtcgcgggtcactggaggaattgattcagtgggcagatgagcatcagattcgcggtgagtttgtgattctggtggccggcaatgatcatcccgaccagccagctgatgatgcggccaacctcagcctaaaagagcagatcgaccaagagattcagcatggtctttcaaccaatgcggccatcaagctggttgccaagcgcaatcagatcaagcgccaggatttgtatcggcagtaccatgagctttaagatgaggtgagacgatggcattgaaagcccctttggtatatgaaaccaagcatcatttaagttactatgaatgcgatgcaaccggtcatcccagcttaagcatgctgatcagtatggctgtgcaggtatcagaagaacacggcaattcgctaggactggatacggcaaccatccaaagctatggcggtggctgggtgattaccagctatgaaggatcctttgccgcacgacagccgattaatggtgaagaggtaattctgggtacgcgggcgattgccaataatcgtttctttgccctgcgcgaattttggattcaatcagctgatcgtcaagttgagtatgttcgcttgaccggactgttcgtttatatgaacctgcagacgcgtcatttaatgtcgatcccacaagcggtcattgaaccttatcatggtccggaaaagaagcggctgcctagattggctaaggctcgcgaactccaagatgttagatgtaaaaacgactaccatgttcgattctttgatattgactcaaatcgtcacgtcaataatgctcgctactttgactggatgcaggatccgctgggggcagaatttttaacgcgccatcagctgaagcatatgacgatgcgctatgaaaaagaagtgcgctatggccagaccatcaccagtgagatcagcagtccctatcgcaatgaaaatggcgagttgaccactgatcatcgaatcgttgtcgatggccagttggcggcggcctcaacgatgatctggtatgaataaaattacgtaaaatcgcgtctgccaagctgacagacgcgatttttagtatgacgaacggctttgaagcgatatgctttaggcttttcgtattatttacactgcaaaaaagttttaaggcccaaacaggctgaaattggtggtattctttatatataacagataaaagggcattcaatgaataaaatcatgtgaggagtgttaatttgaaaaattcgttatttgggattattttcctagagccggatcgcttgacgcttcggattgtagagctcccaacccttaaaatcattaccgaggtccaatcaggggccttgatcgttggcagtcataacgttgccaactatgcacaaaacatgcaggctattgttgataatcttcaaggttttcaacgaatcctgcgtgaatatcaagttgaaaaattcgccttttatggctctttagaagacttaaacatggtcgaggcccgctatattgccgatcaattaaaagtcaggactgatttgaatattgaatggctcagcaacaatcagctgatggccagcgccttggcagccgtaatggcccagatgccgcggttcaacgagcttagtaaaaaggcgttgtatattttgacgattggtctgaacacgacgcggctttcctatttccgccacggcaagtttcagacgtcatgggatatcgacttgggcgaggcgcgcgtcaatcacctggcccaaacgctgcgccagacgacgacgacgccaagcgagattattctggactatatttcaagcaagctggaatacctggtaccagaactgcgtcatgtcaaaaattccaatctgttgattcataacgtaggaacgatggcccaaagctacgttaagcctgatgagatgctgggcaaggtaccgcgtgaagattttgaaaagcgctaccagcggatcgtcagctcgtccaatcagttcattatcaatcattacaacgttgatgagcaaagcgtcaactgggtattgcccaactacctggtgatttcgcgtaccattcatctgctggatgcacagcgaatctatgccaccagtctgcgcattttggatggcctgacgattatgcagctgggtgatcgctcgctggtcgccaatatgattcgaacctcagcagccaacatggcacaacgctatggaggtgatacggcgcattcaacgtttgttaccagagttgcgctgcagctgtttgatgccctgcagccgattcaccggcttgatcggcatgatcgcctgcttttagagattgcctgcaagattgaagatatcggcaactttatcaatccacaagggcactatcggcattcgcaatacatcttagaagctaatccgctgattggtctttcagctgatgataaccgtacgattgctgaagtagcgcgctatcacagttctgagagtcccgacgttgcgcaggctcactatcggcatatggatgatgatattcagatgccggttgccaaattggcggcaattcttagggtagcggactcgcttgatgactcacgcctgcagaaaatttcacgagttgagctgcgcctgcaggatgaacgcttgctgatcacggcccatgccaatgacgatctggtcttggaaaagtgggcctttcaacgaaaaaatcagctgtttaccgatgtctatggcctaaagccagaattaattgccaaggaaggggaatgaaatgatgtataaagatttttatcagccgcaaaactacgtcaaccgtgagctttcttggattgactttaatggtcgggtcttagaagaagcgctggccccagaaaatccgctgctggagcgggctaatttcctgggaattacgcaaagcaacgtggacgagttctttatggtacgagttgcctcgctgcataagctttcggctgccaacgttacgacaaccgatgcttcaggtatgacgcctaaagaacagctggacgcggttaataaaaaagaacatggcatggttgagcagcgctatcagatttataatgatcagctgctgccagaactggcatcgcaaaatattcagattctgcatgtcagaagcttggatgcagaacaatatgaatacgttcgtcgctactttaatgaggaattgatgccggtgctgacgccaatggccgatgatacgtcgcggccatttccttttatctccaataattcgctcaatattgcaatcaagctggaacgcgatccagaaagcctgcacgttaaagagcacgaaattctggaaggcgatcaagagattcaagaccgctcgcaagaaccacatgatgagaataccgaaaatgaagagaaatttgcgacggtccgcgttccggagatctataagcgtctggtcaagctgccaggcgaaaaccagtttgtcttattggatgaattgatcaaggaatttctgtcggtgctctttcccggctatcgcatcatttcttctggtacctatcgggtcatgcgggacatggatctggacgttgccgaagaagatacgtctgatctattgcgggccgttcagcatcaactgcgggagcgtgaacatggtcatgtcatgcgcctagaggttgagcgtgatattgatccatggttggaaaatcatctaattaagaacctgcatgtaaatgaaacggcggtctaccgcgtcaatggaccagtcgatctgacgtttttaaagaagctttccgtcatggtcaaaggacacgatgagctgcgttatcagccgttcaaagcgcacctcgatccgcgctttgatatggatcataatatctttgaggcaattcgcaccaaagatcatctggttcagcatccttatgatgattttcaatcggtcgtcaacttcattcatcaagcggccactgatgaccaggtcttggcgattaagatgaccttgtatcgtgtttcgggcaattcgccgatcattaagtatctggggatggctgctcagcaaggcaaacaggttacggttttggttgaagtcaaggcgcggtttgatgaacaaaacaacgttcgctgggcgcggcgtctggaacgaatgggctgtcacgttatctatggcctggttggcttaaagacgcactgtaagctggcattggtcattcggcgcgatgaggacggcatccggcgctacatgcatctggggactggtaactataatgatgttacggctcatttctacaccgatatgggactgtttacgtgcgactacgaactgggcgaagacatgaccaacctgttcaatatgctttcaggatttgctcggccacgctacttccataagctgcgagtctcaccagatggcattcgggagtttattgatggcaagattgatgagcagatcaagattgctaaggccggcagcccagctttgattcgcatgaagatgaactcgctgtctgacaagcagattatcgcgcggctttatgaagcggctgcggcaggcgttaagattcagctgctgattcgcggaattacctgtctgcgcaatgatctgcctcagctgcatgaaaatattgaggttcattcaatcgtggggcgttttttggaacactcacggatctattacttcaagggcaacggtcatgaagaaatctatctggccagtgctgatatgatgacgcgcaatctgaatcgacgggttgaggagctgttcccagttttggaaagtgatactaaggcacgggcaatcgatatttttgacaagatgtggcaagataatgtcaagacacgaattctgcacggcaacaagtatgaacgaattgaccgcggcaagacgcagccgtttagctgtcaagaatactttattgcgcaagctcaggcagctaaccgggctgataaaaaggaaacggaacagcatcaagcagccagtgcctttcaaccaatgacgcgtcatgtatccaagctgcatttgaacgatgaagaggacaatgcgcatgattaatctagcggttattgatctgggctcgaattcggttcggctgcgaattaccgaaattgacgagtctggtaattataatttggtaagctatgaaaaagaatacgttcgcctttcagaaaacatggggccagaaaaaatgctcaagccagcgccaatggatcggacgataaaagcactgcagcattttaagcagctttgcatggcgctggaaaacgttcggatgattgcagttgctacggctgccgttcgtcaggctgccaaccagacggaattcttaaagcgggtcaagacagagaccggttttagctttaaggtaatctctggtgagcgggaggcttatctggactatgttggcgttaccagaactctgccgattaaaaacggattgattatcgatactggtggcgccagcatggaattgatctatgtcgatgacggacaggctgaagaaatcatcagtctgccgatcggtgcggtgctgctttctcaagaatatcatctggatgatcagattaactctgctgatttgtttgatgccatcgttagagttgatcacgcgctgggacctcagcactggctgcagcgggcccgacaccaagaagtcgtggccctgggtggcagcaatcgagctctggccaagatctatcgctggcagttggaggctcagggcaaaggtcgtcaacccgttcatggtctaaaaatgtcgacagctgatgccaatcgcattatgcactcgctgcttgcgatggataaaaagcagcgggccaacgttcatggcattgcttctgaacgggctgatgtaattgttggcggcctgctgccattaatggcgattttgcggcagttggacgtcaagcagctgacatttagcaataacggtctgcgggaaggattaatgtttaagttcttggaccatgaaattatgagcagtatcgttcagccgctgacggattaaatttttaaagattgatatcaaatgggtttttactaaaattttatgttataattttactaagagagaaatgaagaggtaaacccgtcaagataagggaggaaaacactttggctattttagttgcaggtggggccggatacattggctcacacatggttaaagatttaattgaacatggttatgacgtggtcgttgcagacaacctttcaacgggacacaaaaaggccatcaatccaaaggctaagttctactatggcgacattcgcgatcgtgcctttctggatcggattttcgttaatgaagagattgaagccgtagttcactttgcggccttctcaatcgttcccgaatcaatgagtgagcctttgaagtactttgacaacaacacgagtggcatggttacgcttttggaagccatgcgcgactttggcgttaagtacattgtcttcagctcaacggcggctacttatggtacgccggaacacatgccaattaaagaaaccgatccgcaaaagccaatcaatccatatggtctgtccaagctgatgatggaacaaatgatggcatgggctgacaaggcttatggtattaaattcgtggcgctgcgctacttcaacgtggctggggctgctccagacggtacgattggcgaggatcatggtcccgaaacgcacctggttccaatcatcatgcaggttgctcaaggcaagcgcaaagaactcagcatctttggcgatgactacgatacgccggatggtaccaacgtgcgtgactatgttcatgttatggatttagccgatgctcatattctggctttgcagtatctgaagaagaacaatcaatccaaccagttcaacctgggctcttcaaccggcttttccaacaagcagatgctggaagcggctcgtgaggttacgggtaaggagattccagctaagatggcgcctcgtcgtcccggggatccagactcgttggttgcggccagtgaaaaggcacgtgaagtcttgagttggaagccgaaatttgatgacgtgcacgatatcattgcaacggcttggaagtggcactccacgcatccaaagggctacgacgaccgcaacaattaaaaatcaaataataattgcttaattaaagatgagtacgctaagagctaaaaagcttgccgtactcattttttagttgtgtgataaaattactaagtacgaaaggaacgagaaactaatgaaaatacttgcaattgatacctctaatcacccaatgagcgtggcattggtagaagacgaccagcttctagccacaacgacgcttaatatggtccgcaaccacagcatttttcttttaccggtaattgatgatctgtttcaaaaagttcaatggcagccccaagacttggatcgggtcgtagttgcccagggtccgggatcatataccggcatccgcattgcagtaactactgccaaggtgcttgccgatactttggacatcgaattgacaggcgtctccagcttaaagacggtggcggctaacctgccttcagcaactgacgcgttgatcgtgccattttttgatgcacgacgcggcaatgtttttgcgggggtctatcagtggcaagatgatcagctggtcagcgtattgccagatcagcacctgtcaatgcaggccttgctggatcagttggcaaaacttgaaaaaccggtcttaatggcaggcgagctgactgaccgtttgcaaaagcagctgaaaaccgtgcctgagcagctgaagtttttaccgactgcatttagtattccgtcaacctatcagctggccttgctgggggaaaaggcagcaccggttaaaaacattgatgcatttgtgccgcaatacttaagaattaccgaggccgaggcagtttggcaccaccagcaccccgacgctccacagcaggattatgttcgagaagtttaagaattggctggaacaggttggcagcactgaccggatgccgatgacgtttgccagccgttcgatcagacttaatcatcaatctggtacgatcagtcaggctaaggaagcagatattgctgctatggtgcatattgaggaactgatctatggcgtggcaccgtggaatcgagcggcatttgcagcggatctgaagaaaagtgatcggctgtatctggtgctgaaaaatgccaatggggacgtcctgggctttatcggctgttcatttgactggaatcgtgctgatgctcatatcaccaactttggcgtgcatccggcttttcaaagacagggactgggaacctacctgctgcagacgaccaggcagattgctctggcacaagcaatgcgcacgatgagtctggaagtcagagtctccaactatcaggcacagcggctctatcgacggatgggttttatggatggcgagctcaagcggcattattacctggacaatcatgaagatgcgttagacatggttgcccagcttgaagaagtgaaaggatagaataaagtggcaaagaaaaatttgatcttggcgtttgaaagcagttgtgatgagaccagtgtggcggtcattgaagatgggcaaaagatcctaagcaatatcgtagcaacccagattttgagtcatcagcgttttggcggggtcgtgcctgaggtggccagccgtcatcatattgagcagattaccaaatgcattgataaggcactgaatgaggcagccgttgactatgacgacttaagtgcagtcgcggttacgtatggtcctggtctggttggttcgctgttggtaggcgtgacggctgccaaaatggttgcctgggctcatcaactgccattggtgccggttaatcatatggctggccatctatacgcggctcgttttgaaaaccagtttgcctatccgcagctggcacttttggtttcgggcggacacacagaactggtttacatggccagtgaacacgaatacgagatcattggcgaaacgcgtgatgatgcggctggagaagcttatgacaagattggccgagtattaggcgtcaactatccagccggtaagacgattgatgagtgggcagccaaaggatccgatacgttccattttccgcgggcgatggaaaaagaggacaactatgacttcagcttcagtggccttaaaagcgcctttatcaacaccgtacacaatgccaatcagcgtggtcaaaagctggataaatatgatctggcggccagctttcaacagagcgtagttgacgtattggcagaaaagatgatgcgggccttgagcgactaccctgtcaaacagctgatcttggctgggggcgtagcagctaaccacggcctgcgtaagcgtttagagcgcgacttaaaagagcagcatccagaagtagagcttttgatggcgccattgaaactatgtggcgataacgcggccatgattggggcagccggttgggtaaactatctgcatggcgatcgcgccggttgggatcttaatgcagttcctgggctctcgtttgcaagaagcaatgccaacccggatctggcaataaaataaactagacagtattaaaagagcttgtgttttcgttacgaaacataagctctttttttgcaataaattttgataatcaaaatatttttataaaacttttccacaagatatgactgataattcatatttattagcaggcatcatgcttgcattcaataatggtattttgagacatcaaaagatattttggtgtttttgataaccgctttcacagggcgaattaaggttgactaaaaatttgaatgacatataattcgattatcgaatactttgatactcgaaatactttttttgaaggcaggtgacaaaattggcactgatgacggcacaagaaatcatggatctgattcccaatcgctatccgatctgctatatcgattatgtcgatgccatggaacctggaaagagcattaccgcgactaaaaacgttacgatcaatgaatcatttttccaaggtcactttcctggcaacccggttatgccgggagtcttgataattgaaacactggcccaggcagcatcgattctgattctgaaatcaccagagtttttcaagaaaacggcatatctgggagcgattcacaatgctaagtttcgccggatggtgcggccgggcgatgtcgtaaagcttgagatcgaaatgattaaaaagcggcggcaaatggggattgtcaaggcagtagccaaggtcttggacaaaaaggtctgcagcgctgaattggtctttgtagtggcggatcgccaagctaagatttagccgcggtttagtctataatgtattttgataatcaaactatttgagctgttaagcaaaggagaaaatacattatgaatgacgactaccaagaaattaaccaggcattggtgcgggtctataacgggattttatgggttgaagaacacgagctgcgtaaaagcatgtttcgtgatttgacgatcaaagagatgcacgcaatcgatgcaatcaccatgtacaatcaccagactgtttcgcaggttgcgcaaaaactgcatgtctcaccaggcacgatgacggcaacggctgatcggctggtgaaaaagggctatgtagaacgctatcgtgatgaagaggatcggcgcgtgattcggcttggcttgactcataagggccgtgtactgtttcgtgcgcaccgtgcctttcacaacatgatggttaaaggctttttaaaagatatgaacgatgaagagctgaaagtcgttcgcaaggcgttgcgcaacttggaagattttctggatgaacatgcctgagaggatgagaaagcctttggaagacttaaaaatcgtacagacggccagctgggttcctgatcaggtcattgataatgatgacttgagtcggattatggatacctctgacgattggattcaatcaagaaccggaatcaagcggcggcatatcagcaagcacgagaatacagctgatctggcttctaaaaccggtcagctgctcttagaaaaaagcggctggcaggctgaggaacttaatctgattttagtagctaccatgtcgccggatgcctatacgccttcaacggccgcgatcgttcaaggccggctgcaggccaaaaatgcagttgcctttgacgtttcggcagcctgctcgggatttgtctatggcttggcagttgccagtcagatgatgagtacgggaatggtaaaaaaggccatggtaattggcagtgaggtcttaagcaagctgattgactggcatgatcgaacgactgccgttttattcggtgatggtgctgggggcgtcttattagaaaaagtgccggttaaagcaccaaccctattaggactgcagctaaagacctttggcgaactgagcaatgagctgagtgccggcatgacgagttcgggaaataccttccctaaatccctgactgaactgacaccatttaagatgaatggacgcgcggtctaccgttttgccacgcatgaggtacctgaatcaattttgcaggccagtgctcaaaataagctgacgctggatcagattgatgtttttttgctgcatcaggccaatgcccgcattatcaagcaggtagccaagcgcctcaagcagcctttagaaaagtttcccatcaacattgctgaatatggcaatacttctgctgccagcgaaccgattcttttagacgaatgcgttgaaaaaggaatgatcaagcgaggcgatattttagccttgagcggttttggcggcggtctgacgacgggaacgattattttaagatactgattttgaacaaatgaaaagaaatgaggataaacaaatgactaaagaagaaatttttgcaacggtaaaagaaatcgcagctgaagaactggatatcgatgaagccaagatcgtgccggatgccaaaatcaaagaagatctggaagcagacagcctggacgtttttgaaatcatgaacgaactggaagacaagtttgacattgaactggatgttgaagatggtgccgaaacgattaacgatgtcgttgaactggtagccaagcagctggcagccaaggaagactaagatgcagctagggattctgtttagcggtcaaggagcacaaaaaccaggaatgggctgtgacctgctggctgatgagacgttttcaaagacgctggagcaggccagtgaggcagctgaacttgatatcgtcaagcttttgaagagcgaaaatggcgagctgaatcaaaccagatacgttcagccggtactggcagcttttagcctgggaatctggcacatgctgcagcgtgacctgcccaacttgccggcagctggcatggtcggcttgtcgctgggggaatatccggctttgatggcggctgaatccttggcgatcgatgctggctttgctctgcttaaggatcgtggccaatatatgcagaaagcggcagatgaggttgccagtacgctggcagcggttattgatccggatatcgaaccggttgaaaaaatctgcgcgcagctgccagatgtctgggttgccaattacaattcaccacgacaactggtgattggcggtactcaagcagggatcaaagaggcagtagaacggttaaaagcaagtcaggcagccaaacgggtgattaagctgaatgtcagtggtgcttttcatacgccgctgtttgacggcgctcgccaacagatgaaagtccgcctgcacgacgttgaatttagccagccaaaggttccggtgatcagcaatacgatcgtggctccgtttcaatctaaagaaacagcagctattctggaacgtcaactggcggtgccaactcattttggccaggatctgcagtatctgattgatcatcaaaaaattgaaggaacgctggaaattggtcccggcaagacgctcagcaaatttgccaagcaggtcgatgctggcttgatccgggaacatatcgaaacgcggctggattatgagaactttgtaaaggagcatgcccaatggagctaaccaataaaacggtattgattaccggcagctcaagaggaatcggcgcggcaacggcactggcatttgccaaggcgggcagccgcgtgatcttgaacgcccgtcatgaattgccagcctcactaaagcagcagctggatgagcttggtactgaatattgctttttgccaggtgacgtcagtgatgaacgggtcgtcaaggaactgaccaagaccgcgtgggaaaagtttggcggaattgacgtattgatcaataatgccggcattacgcgggaccgcctgttgattggcatgaagacggcagattttgatgaagttctgcaggtcaacttgaaaggaccgtttttaatgattcaggcgctgcttaaaaagatgtataagcaacgggcaggggtcatcatcaatctggccagcgtcgttggtctgcatggtaatgccggccaggccaactatgctgccagcaaggcgggaatcattggcctgactaaaacggtagccagagaaggcgcgctgcggggaattcgctgcaacgctatcgcaccagggatgattgccagcgacatgacggcagctatgccgcaaaaagcgcaggaccagattttagaaagcctgcctttaaaacgctttggcgaaccggcagaaattgcgcagacggctttgtttttagcccagaatgattacgtaaccggtcagacgattgtagttgatggcgggatgacgatttaggagaagcttatgacaagagttgtaattacagggatgggggctgtttccccaaacggcaatggctttgatgagtttgttgagcacactttagctggaaagatcggcatcaagccaatcaccaagtttgatgccgcgccaaccgggattacggtagctggtcagattgatgattttgatcccagcgaggtagttggcaaaaaagcggctcgccggatggatctttattcacaatatgccattcagacggcagctgaagcagttgcgatggccggtatcaatgaagaaaatacggcacctgaagatctgggcgttatctatggctcgggaatcggcggtttgaccacgattcaagagcaggtaatcaaaatgcatgacaaaggtcccaagcgagtttcgccaatgtttgtgccaatggcgatcgccaacatggccgcgggcaatattgcgattcgcttcaatgcgcaaaatatctgtacgtcaatcgtaacggcctgtgcaacgggaaccaactcgatcggtgaagcctatcgtcagatcaaggaaggccgcgcgcaggtcatgattgccggtggctcagaagcttcagtcaatgaaatcggaattgccgggtttgccgctttgactgcacttagcacgacgacgaatcctttgaaagcttcacggccatttgacaaggatcgcaatggctttgtcttgggcgaaggtggcgcggcactggttttggagagccttgagcatgcgcaaaagcgagacgctcaaatcttaggcgagatcgttggctatggcgcgactggcgatgcctatcacattacttctccggatccagcaggccgtggtgcggcaagagccatgcagcaggcaattgacgaggctgggattgctccagaaaaagtcgactacatcaatgctcatggtacggcaactcatgccaatgatgctggcgagtcactggccgtcaatcaggtctttggtaaagacagcaaagtgctggtcagctcaatcaagggcatgaccgggcatctgcttggggcagccggagcaattgaggcagtcgttaccgttgccgcgttgcaaaaaggcgtgctgccgccaaacgttggctgtgagaatcaagatccggcctgtcaggtcaatctggttgatcaaaccaatcaaaaccagcctgatgccgaatatgccctgagcaactcatttggttttggtggacataatgccgtattggcttttcgaaaatggaagtgatttttaattggaattaaaagacgttcagcatttaatgaagacgtttgaggcctcagataccagagagcttaagattgatgatggttcgttccatctctatctgagcaagaatcagcaggcaaatgccaaaactgatctaagtccgcagccatcccatgccgagtcggtacgtcccgtggctgctgcaagcactcagcagatcaaggcgcctttggttgggacggtctatctgcaggccaagccagaacagccagcctacgtcaaggttggcagccaagttcacaaaggcgatgtcgtctgcattatcgaggcaatgaagatgatgacagaggttaaaagcgatcaagacggcattatcagtgcagtcaaggttaaaaatggcgagctggtagaggttgatcagcctttgtttgaagttacggagggttagtcaatgactgaaacgattttggattcaaacgcgattcaaaagatcattccccatcgctatccgatgctcttgatcgatcgcgtaattgagttggaaccaggccaaaaagccacggcaattcgcaatgttaccatcaatgaagaagtcttcaacggtcattttccgcaaaatccggttctgccaggtgcactgatcgttgaatcattggcgcagacaggagccgtagcacttttgtcagagcctgagttcgcaggcaagacggcttattttggcggcatcaagtcagctgagtttcgcaaggtcgttcgtcctggcgatacgttaagacttgaagtcgagctggaaaaggttcgcggtcaagtcgggctgggcaagggcgtagcaacggttgatggaaaaaaggcctgtaccgcagagcttacctttttgattggctaggtgagaagcatgttttcgaaagtattagtagccaatcgtggcgagattgcagtacgaatcatccgctcgctgcgggaactgggcatcaaatcggtggccatctattcaaccgcggatcgcgatagcctgcatgttcagttagccgatgaggccgtttgcgttggcggatcgcgaccgcaagactcatacctgaatatgcagaatatcttggcagctgcaatcggtacgggcgctcaggccattcatcctggctttggctttctttcggaaaatgcagcttttgctgagatgtgtgaagcctgtgggattgtctttatcggaccgaaagcattgacgatcgatctgatgggcaataaggaacatgccagagagcagatgaaaaaaagcggcatcccggtaattcccggcagtgatggttatcttagtgatgttgaaagcgccaagcaggctgccgcagcaatcggctatccggttttgctaaaagcagcggcaggcggcggcggtaagggaattcggcgcattgagaatcaggatcagatgcagcaggcgtttgatgaggctcaaagcgaagcacggctgtcgtttaatgacgatcgcatgtatctggaaaagattctgaaaaacgtcaagcatattgaggttcaagtcttttgtgacgattttggccatgccgtctggtttccggaacgtgactgctctttgcagcgcaataaacagaaggtaatcgaagaaagtccatgctcgttgatcagtgaagatgagcggcaatatttaggaaaactggcgcttaaggccgttcaggcgattgactatcgcaataccgggacgctggagtttttgatggatcaagcgcatcatttttactttatggagatgaacacgcggattcaagttgagcataccgttacggaaatggtaaccggcattgatttggtcaaggctcaggtaatggttgcagccggtgcagaactgccttttaaacagtccgacatcaagctgcatggtacggcgattgaatgccgcatcaatgccgaggatccgcaaaaagacttcatgccttcaacggggacgatcaactacctatatctaccggttggcaatctgggcatgcggatcgataccgcgctttatccacaggccaaggtaacgccttattatgactcaatgatcgccaaggtgattgcgctcggccatgaccgcaatgaagctattgagaaattaaaacggctgttaggcgagatggtgattatgggaattacgaccaaccagaattttcatctggcgattctcaacgatcctgaatttttgcgcggaacgatgacgaccagttatcttgagcaggactttatgcctcgttggaaaggagagactcagcagtgaagctttatgtgcagaagaaaaacacgctaagcgaacgccatgttaaggcagatcaaaaagcagacgccaaggttccagatgatctgctgcgcaaatgtccgcagtgtggactgacgattatgagccgccagttggactgctacgctgagtgtccacagtgtcattacggctttcgtattggagctcggcagcgcttggcctggctgacagatgagtttgacgagctggacatggatctgcagactaaggatccattggcttttcccggttatcaagataagttgaagactgctcagaacaagactcagctcaacgatgccgttttgactggcgtggctaggattggcgaccagcaggcggctttaggcatcatggatccaggctttatcatggggtctttaggaacggttgctggtgaaaagattacgcggctgtttgaacatgcaacgcagtaccggctgccggtcatcatggttacggcatctggcggggcccgaatgcaggaaggaattcattctttgatgcagatggctaagatcagcaatgcggttgccgcacatgatcaggctgggctgctttatgcagtcgtcttaaccggaccaacgacgggtggagttacggctagttttgccacgcagggcgatattaccctggctgagccgcacgcattggtaggctttgccggccgacgtgtaattgagcagacaatgcaccaaaagattcctaatgatctgcaggctgctgaaaatctgctgagacacggttttatagatgcaatcgttaaaagaacagatgaaaaggcaatgctggaacgcttgcttaagctgggaggtgccatgcgtgtctgaaaaaacggctgttgaaatcgttaaggccgcgcgcagtgaagaaaagatcaccagtgctgaaattttaacgcaattattttctgattttattgaattgcacggtgatcgcaatggaactgatgatccggctattaaaggcggtattgcagactttcacgggcaagcagtgacggtgatcacgactgatcgcggtcaaagcattgaagaacgcatggcctgtcattttggctgtccggaaccgggtggctatcgcaaatcgctgcgcttgatcaaacaggcgcaaaagtttggtcgcccagtcttttgctttgtcaatacaccgggtgcctatcctggccaatcggcagaagaaaatggtcaaggatcggcaattgctcagaatctactggagatcagcaagctggcgattccaatcatcacggtggtctttggcgaaggcggcagtggtggtgcattggcgttggcttgtggcgatgaggtatggatgcttgaaaacagtacttattcaattctttcgccagaaggattcgcctcgatcttatggaaggacagctcacgcgcggctgaggcagctgagatcatgcagttgacgccgcaagccttgaaaaagcagggcatcattgaggggatcattgccgagccagctgatcatcaagccgtcattgccaatctggatgcggttttgacccgtgagctggctgcgctgcagagactaacgccagctgaactgcttcagcatcgtcagcaacgttttagaaagttttagtgagggaaaacaatggaaggaattttaagcaataagcaaatcgtcgtcatgggcgtggccaacaagcgctcgattgcgtggggatgtgctcaggcgatggaaaaacagggagcaaccgtgatctacacctaccaaaacgaacgtatgaaaaaaagtgtcagtcggttggttggcgatgaaaaacgtttggtcgaatgcgacgttgccaacgacgacagcatccagacggcttttacggcaattaagcagcgattcggcaaagtggatgggctggttcatgccattgcctatgccaaaaaagaagaattgagcggctcaattctaaacgtcagtcgtgagggctatgcgctggctcaaaacgtttcggcgtattctttgattgtcgttgccaaggcagctcatgagcttgacctgctcaacgatcctgccagcattgctactttgacttattttggctcagagcgggcaattcctaactacaacgttatgggaatcgccaaggcagccttagaagccagcgttcgctatctggcgcgtgacatgggctcgctgggcgtacgggtaaatgccatctcggctggggcgatgaagactctggcggttacgggaattgacaaccacagcgatcttttgaagatgtcgcaggagcggacgactgatgggcagtccgttaccttagaagaaatcggtgggacctgcgcctttttgatgagtgacctgtcaaaaggaattgctggcgacgttatttatgtcgataaaggcgttcatttaatctaacttgtaaaaggattcagaactctgaatccttttaatttttgctaaaaacaggaaagttatttaaaaaattaaaaaatggttcggcttttattgattgatcttagcgatttctcattttttagtcaatcaacctaaaaatttatgatataattttgccttgaggtagggagaaagttcgttactgttgacgattgatcaaggtggtgtatttcgtgaagaaagttttaattgccaatcgtggcgaaatagcagttcgaatcattcgtgcctgtcatgagctgggcttgaagacggttgctgtttatgccaaggaagatgaatacggcgtccatcgtttccgtgcggatgaggcctatcagattggtgcaggcaaaaagccaattgaggcctatctggatatggatgatattattcgagtcgctaagcagactggtgccgatgcagtccatcctggctacggttttttagcggaaaatgaagagtttgcgcaaaaatgtgcagacaacggcattatctttatcgggccaaccgtccgtcagctgcagctgtttggcgacaaggttgcggccaaggaagttgcggtcaaggctggcttaaagacgattccaggtacggatgagccggttcagtcaattgatgaggttcgtgaattcgcgcatacgcatggctatccgatcatgatcaaggcagccatgggtggtggcggtcgcgggatgcgaatcgttcacgatgatgatgagcttgatggtgcctacgatcgagcccgcagcgaagccaagcagtcatttggcgatgatgagctttacgttgaaaagtatctgaagaaccctaagcatattgaagtgcagattctagctgatcagcatgggcacgttatgcatttatttgagcgtgactgctcggttcagcgacggaatcaaaaagtgatcgagtttgcgcctagtctggccttaagcgaagaacgacgccaggcaatctgccaggcagccgttcagctgatggaaagcgtgcactatcaaaatgccggtacggttgaattcctggtcacggatgaggacttttactttattgaggtcaacccgcggattcaagttgagcataccgttacggaattgattaccgacgtcgacatcgtacagtcgcagattctgattgctgatggtgccgatctgtatcaggatcttgagctgccggctcaggatcagctgaagtacaacggctatgggattcaatgccgggttacgactgaagatccagaaaacaactttatgccggatactggccgcatcgaaacctatcgttcacctggtgggatgggcgtacggcttgatgggggcaatgcctatgctggggctgtaatcacgccatactttgattccttgctggttaaggcctgcgttcatggtcgaactttcaaatcagcggtccggcgtatgattcgagtgctgcatgagttccagattcgcggcattaagaccaacattccgttcatgctcaacgtcttgcatcatccagtctttgcggctggtcaggcgcatacgacgtttattgatcagacgccagagctgttcgacttcaagcatgaaaagccggatgccgccaagcagctgctgacctatgttggtgacgttaccgttaacggctttaatggcgtcaaggcacgcgaacaggttcatgctgctgaattaaaggcgccaaagatcaatcttgagcgtcataatggactgccaatcgtcaatgccaaggatatcctggatcgtgacggagctgaggcggcaatgaagtgggtcagcgcccaaaagcgggttctgatcactgatacgacgatgcgggacgctcaccagagtctgtttgccacgcggatgcggaccaaagacatgctgccgattgcggacctttacgatcacgccatgccaaacgtcttctcagctgaagtatggggcggggcaacctttgacgtggcctatcgtttcttaggcgaggatccatggcagcggctgaagattctgcgtgaaaagatgccgcataccatgctgcagatgttattgcggggatcgaacgccgttggctacaagaactatcctgacaacgtcttaaagaaattcatcgataagagtgctgaagatggcgttgacgtctttcggatctttgacagtctgaactggatcgaacaaatgcaaaagagcattgaatacgttcggcagactggcaagattgctgaagggacgatgtgctatacgggtgacctgctcagcccagacgagcataaatacacgctggactactacaagacgctggctggtcagctggttgatgctggggctcagatcatcggtatcaaggatatggctggactgctcaagccacaggccgcctatgaactgattggcgaactgaagagcaagtatgacgtaccggttcacctgcatactcatgacacgactggcaatggggttgcaacctacgttcaggctaccagagccggcgttgacgtggttgacgtggcttccagtgcgctttcgggaacgacgagtcagccaagcatgagcagtttctactatgctttagctggcaatgaacggcagccagaactggatattgaaacggtcgaaaagatcaatgactactgggcacaggtcaagccgctataccaagacttcatgaacggcattacgtcaccacagactgacatctatcaaactgagatgcctggtggccaatactccaacctgcagcagcaggctaagtcgctgggactggatgactttgacgaggtcaaggccaagtatcgtgaggttaacgccctgcttggcgatatcgttaaggttacgccaagttctaaggtagtcggcgatctggccatctttatgattcaaaacggcttgaatgccgaaaacattatcgaacgcggcgaaacgctcgacttcccagaatccgtagtcaacttctttgcaggtgatcttggtcagccatatggcggctttccaaagcagctgcaaaaagtcgtcttaaaggatcacccagcgattacggttcgtcccggcagtctggcccagccagttgactttgatcagatgaccaaggaactggctgcacagctgaaacgccagccaaccgctgaagaagtcatcagctatgtactgtacccagacgtttatcttgattatgtcaagcgcaatcgtcaatatggcaagatcggcgtcctggacacgaatacgttctatcaaggaatgcgcccaggcgaaaagatctacgtcaatctgcggccgggtcgcacggagattcttgagctcaatacggtttctgacatggacgttgacggcaaccgccacctgctgttctccgaaaacggtcagcagctggtcttgacggtcaaggatcagacacacgcagccacggccaaggtcagcgtgccaaaagccgatccgcacgatccaggtcagatcgggatgccgcttaatgggacgatcgttgacgtgatggtcgaaaatggtcaagaagtcaagaagggccagacactggtcgtaaccgaagccatgaagatggaaacaacgatcaaggcctcgtttgacggtaagattgacaaagtctatgccaaggccggctcgacgatggaaagccaagacctgctgattcaaatgagtcctttaagctaatacagcttgacagtattatataaagcgaggttaaaacagtggaaatttcagaacgcgtaagcaacattcaaccctcagcaacgctggctttgtctggcaaggctaaagcaatgaaggcacaaggcattgacgtcttgaatctttcaattggtcagccggatttcaatacgcctaaacatatcgggcaggcagctattaaagcgattgagtctggcaaggttgatttttacaccgcggcagttggtattgaaccattgagaaaagcgatcgccgataaagaaaatgctgatcacggcactgatttcacggcagataacgtggtagtaatgaatggtgctaaaatgacgctgtacgctctgggacaagcactgtttaatgaaggcgacgaagttttgattcctttgccatattgggtaacttatggtgaacaagtcaagctggccggtgccaagccagtcttcgtcaagccagcagctggtcgcctgaccgttgttcctgaagaattggaagccgcgcgaacgcctaagacgaaggccatgatcttaaacacgcccaacaatccatctggtgccgtctacacgcgcgaacaattgcaggcgattggcgactgggccgttgagcatgacgttatcgtgattgccgacgatatctatggcaagctggtctataacgggaccaagtttgtctcgctgctggatctgtcaccagcgatccgtaagcagacgattctggtcaatgggatgtctaagacctactcgatgaccggctggcgcgtcggctatgccattgctgacgagcaggtagtcaagggcttgaagacgttcttgagtcatgcagccggcaacatggcagccgtcagtcaatatgccgctttggcagccattactggtgatcagacctgtgttgaagaaatgcgcgctacctatgaggaacgcatcaatacgctgtatccgttattaaacgagattccgggctttaagctggatgtaaagccggccggagctttctatgccttccctgacgtcagcgaagccgttaagctggctggttttgcctcgactgatgagtttgtcagcgcgctgctcgatgaggctcacgtggcggttgttccaggcgcggcctttggaatggacgaccatgtacggatcagctatgcaaccagcatggatgtcttaaaagaagcggttcaacgaattcaagcctttatggcagaccaccaaaaataatcgatcaataaccaatgagctcagttctggtttgagctgggctcttattttaaaatttttgtaaccctaaactttaaataagggttacaagctgaaagaaggaataaaatgaaacgtcaaaatatagttcatttaacgcagaccgccttgatgacggcaatcttaatcgttttaggcatgatcccaggcattccgctagggtttattccggtcccaatcgtactgcagaatatgggggtcatgatggccggtgagattctggggcctaaagaaggaacgacctcagtggccttgctcctgctgttagttgcggttggctttcctttcttgactggcggcagtgggggaattgccgtttttgccggcccaactggaggctaccttttagcctggctgtttgcgccgcttttgatcggtagtctgcggcagcattttggcagtcgctggagctggtggcaggaatttttgatgattgtgctggcgggtgtgctgtttattgatattacgggatcgctttggctcagttggcagtcgcacatcaagctgacggcggcattgatgtccaatctggcatttattcctggcgacctgatcaaagccggcgtggcagtagccgttgctcgtcagctgcggcgcgtaccagcattgaatcttggctagaaaagaggaatcgcaatgggtactaaagatgagctgtttaaaattttcttgcttaatgagcagcaatggatttcaggcagtcagctagcggagcgcttaaagatcagtcgcgaaagcatctggaaaggcgtcgctgccctgcgcagacaaggacatcagattgagagtcagcgagcgcttggctatcgatatttaggaacggatcatttggatgcagcggtaatcaagatgcagactcgcgatgagtttaacggcgagattcatacggcatcaagcattgattcaacgcaaaactgggctaagcagtatctcagcagtcatcagcccagccagccagtcgcgtttttagctgatcagcagacggccggctatggcagacgcggccgccagttctattcgccgcaaaagacaggtttgtattttagcttggttttgccgcataatccgatgagcgcgctgcctaaaattggccttttaacaaccggagtcgccgttgcggttggccgagtactgaagcaaacctttcctgatcatgatttttcatataagtgggtcaatgatatctatatgaatggtcacaaagtctgcggtattttgactgaggcaacgctggaactggaatcagcatcatcggcagcattgattgtaggaatcggcattaatctgtcgaccgttgattttccagcagcagtagctcaaaaagccggcagtattgccccagagcagaccattgatcgaaatcagctggctgccaggcttttggttgcaatcatgaacgtttatggtgagtacgattcgggaaaattcctgccagagtaccgagctcattcattggtcttgaagcggccagtcgtcttgaaaatcggcaatgataaagcagttggcaaggctgtcgacattgacgatcaaggcggcttggtattggaatttgcggatggcacgaaaaagtcgtttatcagcggcgaggtgaccaaggttgatctgccagggatgacgtcataatggaaattcacggtttagatttagatcaggctggccgctgtcggcactattacttggcagttgatgttgcggccttgaaatgcagtcgttgccaaaaatactatgcctgctatcgatgtcatgatgctttggaaaaccatcattttatggcttgtgagcgggaaaactggccagtcttatgcggtatctgcggctgtttgatgcagtttgcacaatatcagcagggaagctgtccgcgctgtgggcacgattttaatcccggctgtcgtcgtcactgtcggatttattttaaataactatcttttctcattgatttttaattaaaataagattagaatataaggcgttgattaagaagaaaaataaatcaggcccaatgacatgttttaattaagttttaggaaaggatcagtgattaagatgacgctgcgatatacggttttaggtgcaggtgcgatgggattgcgctttggagtgctgctgcaggaaaatgcgggggcgcaggttgattttgtcgacaactgggcacccgaagttgaaaccatcaaaaaacaaggtggggtctatgtttctcgtgaccatgaaaatcggcatctggttccggtcaatatctattcgccagaagagtatcagggcgagccagacgtttttatcgtttttgccaagcagatgacgctgcaggatcttttggaacgctcggctcatttctttaagccagaaaagcaatacgttttttcaggcatgaatgggatgggtcacgttgaaaaactgaacaagtattttcccaaagagcatgttttagctgggacctgcctgatcggaaccgtgctaaacaaggctggcgacgttgattttattggtaagccaggtgctggatcaatcaatgttgccaatgaaacggaaaagccagatgagcgcacgcatgaaattattgccgactttaaggccgccaacctgaatccgactttgacgaccaacttcttggggactttgatgaccaaggttgtctttaactcagttgtcaacacgatctgcacgctgtttgagattcagatgggtcagtttattgattatcctggggctgaacgactgagcaagcaattgatcaacgaggcctatgacgtgactgaacgagctggcatcaagctgctcaatgatcgtgagaccgaatggaagacggttgaatacgtcagccgcgttggcaacccactgcactatccttcaatgtatcaggatatgcataatggtcgaaataccgaagtcgactacatcaatggctatatttacgaattaggcaaaaagtacgactatgaagctacgacgcatgactttctgcgcggcttggttcatttggcggaaaatacgcgtaagttccgtcaataaaaagaccgctggatcaaatctggtccagcggtttttgatttgtgttgatctgcagtgtatatgctattgattttcttgatcaaatgtctccagggcttcggcggcttcagtccattgcagctcaacgtcttcgctttgggcttttaaggcatccagctttttttgcagatcggtcagctgggcgatgtcaacggcaatttcaggcttggtcatctcagcttcgatcgcggcctgcttggtctccagttcacccatctgattttctaattgatcgacctgccgctgcagcttgcgtcgggcacgctgagtttctttgctttgctgataggaaagctgaccggttgactgtttggtcttggcttctggctgtgtctgaggctccagttttacctgttgggtcaggtagtcgtcgtagtttccttcataatgcgtcatgccatgagccgtcatatataggatatcggtagcaacctggtttaagaaataacggtcgtgcgagataaacagaactgtcccatcaaattcgttaatggcggtttccaagacttcgcggctgtcgatgtccaagtggttggttggttcatccaggatcaaaaagttgattggcataaatgaaagcttagtcagctccagacgtgccttttcgccacccgaaagcgcgctgactggtttatagacgtcatcgccaacaaacagaaaactgcctagaagcgagcgaatgtctttttcggaaacttcaggatgatcgtcccagacttcttctaaaacggtcttttcaggatgcagctgctgctgttcctggtcgtagtagccgatttccagattagcgccgaatttgatcgtcccgctgagcttgggaatctttttcaaaagcgtctttaaaagcgttgatttgccaatcccatttggaccgataataccgacgcgctgacctttgcgaaccttaaacgacaatggcccagccagcttttgatcctgatagccgatattgagttcatcgacgtctaagacctcgttacctgaagcatggtcactgtgaaattgaaaatgaatcgaggaatcatcggtagtcggccgctccaagcgatccattttttccagctgcttgcggcgagcctgggcgcgtttggtggttgaggcccggacgatgttgcgattgacaaaatcctccagcttggcaatttctttttgctgctgctcgtaatgcttccattcagcctgcagtcgttcgcgcttgtgggctacgaactgcgtatagttgccggtatagtgaatcagcgtttggttgtcaagatcgtaaacgtcagtaaccacgcgatctaagaagtagcggtcgtgagagacaattaaaagtgcgccttgatagcttttaagatagtcttccagccagcttaagacgcccatgtccaagtgattggtcggttcgtctagaatcaaaaggttgggcgactgcagcagaatcttagctagggccagcttggttttttgaccgccagaaagtgcattgactgaagtatcatacatatcttcatcaaagccgaaaccatgcagtacgccacgcatccgggacgcgtattcataaccgccctgttttttgaactgctcggataaacggtcatagcttgctaaaacgtcttggtagtccgctgctttgggcgtcagtgttcccaattgattctccagttcatgcagctgtctttccagttcgtgtaaaggagcaaagacgctgtctaattcggcccaaattgaattttggctgtcgagtccttgattctgagccagatagccaatcgtcaggtcgcgggcgtgagtaaccgtgccttcatcaggttcggttaaaccggcaatgattttcaagaaggtcgttttgccggcaccgttgcgtccgaccaatgcagttcgaccatgttcttgaatctgcatattcatattatgaaacaaaacatcgctgccaaagcgacgttcaacattattggtttgcagtagcagcataatttaacctcattttttaaagtagatagtcagttaagattgtagcacaagatcagactaggtcgcgagcttgaggataggaccgatcaataatgttaaattttgaattaacgtttaaaaaatgatcgtcattaccagcacattcatgatcagtagatggcctgaatttcacaaatcattaatggacatgcagtgaagcctgtagcataatagaaaacatgtttaaataaaatcgattcttttcttggaaaatagttcacaaactttagcggagttgttaaaatgattaaggaataattttcacaaactagaatctgaattggaggaatctattaatggcaacgcgtaaaattccccgtgccacggctaagcggttgccggtctactatcggtatctgaacgttttgcttaatgccaataaacgacgcgtctcatcgactgaattatcagaggcggttaaagttgattcggcaacgattcgacgcgacttttcctattttggcgaattgggcaagcgcggctatggctatgatgtggaaaagcttttgaactttttcaagggcatcttgaatcaagataagctgaccagtgtggctttggtcggggtcggcagtctgggcagcgccttgatgaactataatttccaccaaagcaccaatctgcggatcagtgcggcttttgatcctaaaccagccttagccaataccgttaagagtgggattcctgtctacccggttggcgagatgaaaaagcagctgcaagaacagcagattgatgtcgttattttaacggtacctggcgaaaaatcgcaggccgttactgatgagctggtcgaagcaggggttcatggtatcttgaactttacaccggttcgtctgtcagtgccaaaagacgttcaggtacaaaatattgacttgaccaatgaactgcagacgctgatctactttattgaaaataacaatactaaagacagtcaaaaataactcaacgcatggcgagcaatcgtcatgcgtttttttgataaaaagtcaaaaagtcaaaatgccgttagaatggcaactaaagcgatttctataaaataatagtcaaaattggtcaaaataattgttgcattttagcaagatcatgatatagtagatcatgtaattagcacttgggtgataagagtgctaaaaaatatctgaattattaatgatgattgatggagggattaacgtgttaaaaccattaggagatcgcgttgttcttaaagcggaacaagctgaagaaaagacggttggcggaattgtcctggctaacaatgccaaggataagccaacgacgggtacggttgtagcagttggcgaaggccgttacctggacaatggtcaaaaagttgctccagccgttaaggaaggcgaccgcgtcctgtttgacaagtacgcaggcaatgaagtcgaatacaatggtgaaaagtacctggtcgttcgtgaaaaagacctggttgccatcgttgactaagtagacttgttttcgcattcgatcaatattaatgaggtgaaaatctaaaatggcaaaagaaattaagttttctgaagatgcacgcaaggcaatgctgcgtggggtagacaagctggccaatacggttaagacgacgatcggtcctaagggtcgcaacgttgttttggaacaaagctatggcgcgcctacgattactaacgatggggttacgatcgccaagaacattgaattggaagaccactttgagaacatgggtgccaagcttgtttctgaagttgcttccaagaccaatgacaacgccggtgacggtacgacgacggcaaccgttttgacgcaagccatcgttaacgccgggatgaagaacgttgctgccggtgctaacccagttggtattcgtcgcggtatcgacaaggctaccaaggctgccgttgaagaactgcacaagatgagtcatgaagtgcaaagcaaggacgacattgcacaaattgcctccatctctgccgctaaccctgaagtcggtgaactgattgccgatgccatggaaaaagttggccacgatggcgtaatcacgattgaagacagtcgtggcgttgacacgacggttgacgtggttgaagggatgagctttgaccgtggctacatgtctcaatacatggtaaccgacacggacaagatggaatctgatctggacaatccatacattctgattactgacaagaagatcggcaatattcaagacattctgcctttgctgcaggccgtggttcaagaaggccgttcgcttttgatcattgctgacgacattaccggtgaagctctgccaaccttggtattgaacaagattcgcgggacgttcaacgtttgcgcggttaaagcgccaggctttggcgatcgccgcaaggctcaactgcaggatatcgccattttgactggtggtaccgtaatttctgacgatctgggcatgagcttaaaggatgctacgattgctcaacttggctctgccaacaaggttaccgtaactaaggacaacacgacgatcgttgacggcaatggtgcaaaggatgcgattgctgaacgcgttgaacagatcaagcaggcaattgccaacacgacttctgaattcgacaaagaaaagctgcaagaacgcctggccaagctgtctggtggggttgccgtaatcaaggtcggcgctgctacggaaacggaactcaaggaaaagaagtaccgtgttgaagacgctctgaacgctacgcgggctgccgttcaagaaggattcgtacctggtggtggtactgctttgatcaacgtaattcctgccttggaaaacgttgaaactgaaagcgacgacgaagcaactggtgtcaacatcgttaagaaggcgttggaagccccagttcgtcaaatcgctgaaaatgctggcgttgaaggctcaatcatcgttaaccgtttgaagagcgaaaagccaggcatcggttacaatgctgccgttgacaaatttgaagacatggttgcagccggaatcgttgaccctaccaaggttacgcgttcggcactgcaaaacgctgcttcggtatcagcaatgcttttgaccactgaagccgttgttgctgataagccagaaccaaagaatgatcagccagctgctcctcaaggcggcgccggtatgatgtaatccattgccaaacaatgaataaaaagcgtctcaacattgttgagacgcttttttgcgtttgaagggcgcttagtggtattctgttaagtatgtccatttaaaccaatggacgctatcttatttagtggagtatttttatgtcatcaaaaatgcctagccagaaaatgtctttaacatctgtcattttactggctctgaattcattgatcggatccggatggctgtttggtgctggcgaggcggcgaggattgccggaccagcagcggtcatctcttggattttaggggcgatcatcattatggtgattgcttttaattacgttgaactgggggcgatgtttcctgaaagcggcggaatgagtcgctacgctcagtacagtcatggcccgcttttaggtttcgtagcggcttgggccaactgggtctccttgattacactgattcccatcgaagcggtggcctcagtacagtatatgagctcatggccatggagctgggctaattggacgcgcagctttgtcagtcatggcagcattactaatcaagggctgctggtggtctttgcgtttatgatcgtttttacgctgattaatttctggtcagttaagatcttgacgcattttactggtttgatctcgatttttaagctgctgatgccaaccttgacgatcattgtgttgatgctgagcggctttcacatcagtaatttcgggcaaggcatccatgagtttatgccttatggcagccgctcgatttttgaagcaactacggtagccggaattattttttcttatgatgcctttcagacggttgtcaatctaggtggtgaaatgaaagatccacaaaaaaacatctaccgtggcgttgtaatctcattgacgattacggcagtattgtatattctgctgcagattacctttgtaggggcagttaggccatcactgttaacagcgcacggctggcatggtattgattttgcctcgccatttgcggatctggcaatcttaatgggaatcaattggctgacgattctgttgtatattgatgcgttcgtctcgccgtttgggactggggttgcttttgttaccaatgcttctagaacgctggcggcaatggcgcgcggtgatcatttgccagcctggctggggcggcttgagcgacgctatatggtacctcgttttgccatgatcgttaatctgattctggcagcggttttggtctgcatttttcgtaattggagcgcgcttgccagcgtcatctcggcctcgactctgattgcctatctgactggaccggtagctgcggttgcgcttagaagaattgcacccgatcttaagcggccgtttgagcctcgatctttaaagtggatggcgcctttgtcatttgttttgaccagtctggcgatctattgggcaatgtggccaacgacgattgaggtgatttttgtgatctgtttgggtctgccaatctacgcttattatgagattcgctatcatcatgcttcatggaagacccaaatgaaaggctgcggttggctgctgggctacctgttgtttatctcggtgatgtcttatctgggcagcgatggttttggcggtcagaattggattcggtatccatttgattttgtcgtgatcattttgtgctcgctggtattttactggtggggagtcaacagcagcgtcaaaggtgaagatcttgaattgggacggcgcgttaatgctcatgttgatcagtaaaaataattttctaaaactgctgcgtgatcaatctgccctgggtggtattaaccatttacgtggtgtagaataactgttgactttatattttataatagagtgaaggagaaaaagaatatgtggcggtatttaaaacgcgtcctcatcggtaagcccttgaagacgctggatgaaggccaggcccatttgacaaagtttaaagctttggccttgttatcgtcggatgctttatcatccgttgcttatggtactgaacagattacgaccgttttggtaacactgtcggcggcggcaatctggtattcattgccgattgcagcgttggttttgattctgttggtggcaattaccctttcctatcggcagattatcaatgcctatcccagtggtggtggtgcctatgtcgtagccaccgaaaactggggccgcacaggtggcttggttgccggcgggtcgctgttggttgactatatgctgacggttgcggtttcgacgacttctggtacggaagcgattgtttctgcggttccgcagctttataagtattcggtgccgatttcagtgattatcgtcctttcaattatgattctgaatctgcggggattgagcgacagcgccaatttcttaacggttccggtatacttctttattatcatgattaccgcaatgatcatctggggctttttcaatattgccactggtcatctgacttatcatgcaacggcctcatttggaacgccggttgccgggatgtcggctgtcctgtttattcgggcattttcagccggttcttcctcattgactggggttgaagctattagtaatgccgtacctaactttaatgaacccaaaaagaagaatgctgctaatactttagcaattatgagtctgattctggcggcattctttggtgggattacgttcttcagctactacttcggtatcgtgccaaattcccatgctaccgtgctttcgcagattggttccgtaatctttaatggccacgggattggattttatctgctgcagctttctacggcaatgattctggccgtagctgccaataccggtttttcggcctttccgatcctggcttttaatatggctaaagacaagtatctgccgcatgcctttatggatcgtggggatcgtttaggttactctaatggaatcattgccttggccattggtgcgattgtaatgattttgatcttccatggtaagaccaatatgctgattcctttatatgcagttggcgttttcgttccgtttacgctttcgcaatctgggatgatcattcactggttccgacaccggcagggacactggctgggcaagtcgacgatcaacctggttggggcattgatctcggcatgtttggtggtcttcttgttctggcagcatttcggcaatgtttggccatacctgatcatcatgccggctttgctgtttatgttctacaagatccataaccactatattaaagttggcatgcagctgcgaattgcggaaaagaccaaagttcagctgcatgactatgatggtgcaacagtcattgttttgattgggaacgttacgcgggttactaaaggtgcaatcaattatgcaaggtcaattggtgattacgtaattgccatgcacgtctcgtttgacgagaatcccggcaaggaacacaagacggctaatgagtttaaggccgaatatcctgacgtgcggtttgtcgacattcattcctcataccgttcaattgccaaaccgacgctgcgtttcgttgatgtcgttgctaaaagggctgctgccaaaaactattcaacaacggttctggtgccgcagtttattccaaataagccttggcaaatggcactgcataaccaaaccagcgtcagactgcgggccgctttgaattcacgcgaaaacatcgtggtttcaagctacaactatcacctgcatgaatagatgagcgggatggttttaagccaatggaaaaattttttaaaaatcggcaatggctatgggcagcgatgggagcaatcggtgtttttctgatttcgagtttttcgattcgtcatcagcattttgtctctgatctgggcggctttttaggctgtctgttactggtcggtgcctatctgggattcaactggtcaaagatcaagcaacacgatgtgaaaaccattgcttccatgaaactgatcttagtcctggtcgcaattttaattgtgttagaagcagtgcagcagctgctgggttaatttgaaagaactggcattgaagcgtcaatgccagttctttttacgttgagtttatgattgtaagcacaccatattgaaccgtgttgtctgctaagcagtgggcaatttcaaaaattaaagaataaaaaagcagcggtcgaccggcgcatttctgcgtggtcgaccgctgttcatttatcaattccataggctttgcagctttcttgaatttcacgagtccatggcaaataagcctctatttctggcgtttcgcgttttgtaaaggcgctaagcagggtctctaaatatttaaagacatccaaatgatttagctttgcggtttgcacgatgctataccagatcgcattggctttggccccagccgtggacttcgcaaaccgactgttctttctgaccagcgtggtgggacgaatcagttgctcattgtgattttatgcaatggcgcatctccatgcctgaacatctggtaaaaccgtttcttcaatttgagggcatttttgatcgcattgcgtagcggtttgagtggcgatttcgtcaaggctcttcaatcagctgatgaaatcatcaatcatcgcttttaaatgctgacgcctttgggctgccttctcacttgctgatgaatattccaaccttttttcgacgatgaaatactttggcaaggatccgcacagcgtcactcgcaatactttgcccttgaaaagcgagtaatctttggatcaagcagtcgcttaaattggcgattgatatgaacacagacaggtcccccccaatacgcgtctggtaggcgattatcagaatatccactaaacccatcgcacataataccgccgagaaaagtcatcacctaagatttctgtaataacctttctggatcgtgaaggggcatagtggaaataagatacctgatgcggactgaattcttccgtagaaacaggctgaccagaagtagccatgtgattgatcaaggatccagaacttgaaatgggtctcatcaagctgcaccacagggctgccttgatttcttgacgcagacgttcataaatcttttgcccaaacctttcgccagtcttcaattacccaacgagccatatgtttactggttgattggaagccgaggcgctcccaatactcgcgtagtctggcggggtgtaaacggtaactgccaggccaaacttttcaaaaagtacttcgggcgattaccgagcttgcaaaggtaactgtgtggagaaacaaaggctgtggcgtctttgccgaacaagtacatcattgcccgtttcggatcttgacagtgttcgcatctagccgtttcagtacatacgagtttttgccacacaagtgggcaggaaccagtttaacttcacgatactgtcatgtttgccgataaccgtcatcattgacacgcattgatacaagttagttcttgcttactcagctgatgaagttcttcaacttgttctaagcaatcaagccattttacgtgattcctttgatttgcatttattgatgactggtaacggtagtggtcaacttttcgacgttgaatccattcgttggcgcggtttcctgttctttatcacaacagatccagtggccagcacttaatttttcagttttttttccaaaaagttgcttttgcagatagttttaccatctcggtcagttccgcgatcttagcctttagttctttgttactcacgcaaagcttcttctagagtgtgatcatctcagccattaccaatcacctctctattatctgtatgaccattagtgttatcagataatgaggcaaaataaaagggaacttgttaataccctgggtcccttatagctggcctgattcgtttctgaggcacgtggcgccgagtacctctaaacaatgccttaatctgactctggtatatgccactgcgtcttctcgatgtcgcggccatcgtaaccacctttttcaaagcgtatagtcagatgaatccttcaccgtcccagtataagcctttgaagcgggtattacgattgccaccaaaacaggaaaaagcgaacatataaattcaaagccataattctctgcgatcaccatcggccaaaccgtcaatgccttccgcagatcggtctgtgccacaaactatgtagacgtgctgaggagccactccagttaaacagcatagcggctactgctttaatgatctcactaaccaaagcgggatctgcttcttggtagacattaattttttacttggtgcagtgaaacgatagctgccaagcgtgagtgcttagcaaccgcttctgcgcggtatatcaacttcgacaaaatcttgcttcataaaaaagtcctcctccttgaatatgtcttcaagtataggagaacttggaatttaatcatatgcggttggttatagtgtgcttacttatgattttattttgacatttgatcaatcagattctagtatgaaaatgttagctggctaacgaaaggagaggcaaatgcactatttagaaaaacaattgcatcagactgccaatcatttgggttggaagtttgaccaatttgctgctgagtacaatttaacgggacagcagctttcgacgatcgattttttggctaatcagccggattggcaaagtacgcagcatgccatcgaagtagaattcaatattaagcgttcaacgacgactaaaatgctgcagcggatggaaaaagcgggactgattgtcagaaagacggccaatcaggatcgccgcagtaaaatcgttgccttgacgccgcatgccaagcaattggctaagacagcgcgccaatatttaataatgcgccagcagcgcttggaaaaacggttctcgcctcaggagctagcaatctttgaacaaattttggcatatctgcaggaaaagagtgatgttggtgaaacaaacggaaaaaatcaataaacgagtctatgcggcgatcttggcaacaggattgatgtcgtttagcggcgtgatcgtggaaacggctatgaacataacctttcctactttaatgcgcgaatttgatattgcgacgaatacggttcaatggatgacctcgatctatcttttaatcgtggcaatcatcgtaccgctatcggcagtcttgaaacagtcttttacaaccaaaagcctgtttttatgtgccaaccttttgtttatcattggggccttgattgatgccttagcaggaaattttgcttttctactgatgggtcgggcaattcaagggattgggaccgggattgccttgccattgatgtttaatatcatattagagcaggtaccgcaaagcaggattggctttatgatgggactggccaatatgattactggaatcgcaccggcaatcgggccaacttttggtgggattgtcgtcagcagtctgggctggcgctgggtcttttactttttgctgccgttgctgctggtctcattggggctgggaatctggggtattcagcaaaaatcagcaattcagcgtcaaaaaattgatggcatcagttttgccggcattgccatgatgtttaccggcttggtttttggtttcagcaaccttagcagtggtaagctgttcagctggcaggttggcggttcgctattgtttggcctgcttggcatgatgatcttgattgtccgttcgcttagaattgagacgccaatcttgaatctgaacctgtttaagaaccatgctttttctggtcatgtgctgggctttttcttaacgcagatcatttcgctaggccttgcctttttattgcctaactatattcaattggtcaatggcaattcagcgctgctggctggaatgctggtcttgccagctggattcgtcggcgcgttttttggtccatttggcggtcgcatgctggataagtatggaccgcgcaagccgattctggccggttttgccagctgtgtactctcattgacgctgtttaccgtctttagtcgtcatttggataattcattcattatgctgatctatattttttatatgggcggtatggggctctgcatgggctgcgtcatgaccagtgcgttgaacacactgccatttgatgaacgaacgcagggtaatgctattatgaacacgctgcagcagtttgccggtgcgatggggacttctctttcagcaatggtggtggctcaaagtcagaatcatctgcggattggaactgccaatgctacaacaattggaacccagcatgcatttattatgttgctgatttttggactgatcgtatggctgagctactttaaatatgttcccaaagcaaactaacccaaccatctaaactaaaacggccttgtcagtggaaaattccatgctggcaaggctgttttgcaattaatgtttttgatagggcagctcatgaatgcgagtcggtccctttttgattgtcagttggccgttaaaacgctcggtcagttgattcagctgttcttcaatctgggattcgtcaacatagacgctgacgattacgctggcgccgtattcttcttcggtaatttccaggtttgcctgttttaaataatagagcagcgagtcatgcagcgaataggcaacgtcgatctttaaaattgcctgctcaatgcgctcaaccaaaccagcttgttcgattgcctgggagactgaattgctataagcccggatcaagccgccagctcccagcttaataccgccaaagtagcgtgttactactgctaagacgttatgcagctgattggccttgagcgcctccagcattggcacgccggcagttccgcttggctcgccattatcactttctcgctgaatctgatcatggtcgccgatcaggtaggcaaagcagttgtgggtcgccttacgatgcagcttattgatcttggcaattgctgcttgggcctgttcttctgattcaacgcgaaacaggctgcagataaagcgagattttttgatgataatctcattggtggtatcttgggcaatggttaaaaatggcgcggtcataaaaattcctctttgttaatttgatttgaatccatgcaatttggcatatggtatcttaagggggctttgaaatgattgaagactattttggccggcgggtcctggtgccgatcgttgacatgccaagtaagccatcagctaaaattgagatcttaccaacgataaagattgtaaaaaacgtggctgtctgtcagcgatgtggtgccaaaagcaggttgacagatgccgcattgccaaagcatgagtattattgtccagtttgtttgaatctgggacgagttgatacattgagtaaattttaccatgttgccgagccaaatcaatttagtgcgccatatccgcagctgatttggcagggaaaactgtcgccactgcagtctgaagttgctgaaacggtaacggcgagcatgcggcagcacgaaaagcgtttgatatgggcggtaacgggagccggtaagacggaaatgatgtttaaaggtctggctgatcgtttgcaggcaggtgagcgaattgcttgggcctcgccgcgagttgacgtttgtctggagatttatccccgtttgaacaaggctttccaaaactgtaagatcgcactgttatacggtcacgccaaagaagcctattgctatcggcagctgactgtttgtaccacccaccagctgctgcgcttttatcatgcatttgacaacctgatcattgatgaggtcgatgcatttccgtttgctgccaatccacggctgtttttggcaacgcataatgccgtcaagccaaatggcggcatgatctttttaacggccacgcctggacgagaattgctaaatgcggtcagcaaggggcgattggcggtcagctatctgcctttacgctatcatggacatctgctgccaatgcctaaggtcagtctggttataaactggcgccgtcagctgcaggcggggcatctgccgatcagagtcaaacagatgcttttgcatgagattaaagctcatcagcgttttttgctctttgtaccgcatgtcaaggatctgccgatagttaaaacggccctgcaaaacgacttggcaacgagtgagtttgtgaccgttcatgccagtgatccgctgcgtcaagaaaaggttcaggcgatgcgtgagcaaaaatatctttttttggtgactacctcgattctggagcggggcgttacgtttccaggaatcgatgtgatgattctaggcgctgatgatgaagtgttttccgcatcggcactgattcagatggctggacgagctggccgcgccaaagaacgccccactggcaccgtctgctttttcgtgggtgcaatgagtcaacgcgtccgtgaagcattgcgccagattgcctatatgaatcaaaagggggcgcggctgcttgctaaaatgcctgctttgcggcgcgacgattgaaagccggccgactttaaaacagctgctgctgccgggaaagctgcctgagccgcgtatctgtccacaatgccgcagtcatctcttgctgcgatcaaacgcgcatccctgtcctggttgtggacgaatgctggcgccgaaagaatcgatctgttgggaatgccggcaatggcagcgtcaatatggctggctgctgaataatcacagtctgtatgtctataacggtctgatgcgggagtttatgaaaaaatttaagtttcaaggcgactatggcctgcgttttgtttttcaagagacgtttaatctttttctgcaggaatttgcatatgatgtcttagtgccgattccaatctcgccgcatacctggaaaacgcgcggctttaatcagacgacggcactgctgacgctaccttataccgcggtcttaaaaacgattgcggataataagcaaacacaatcagccaaaacacgggaagaacgtctaaaaacaccacagatttttgaattaacgaatccgcagaaaattgctcatcagcaggttttactggttgatgacgtgtataccactggtcgcacgctgtatcatgcggctgtactgtgccgacaggccggctgtcagaccgttagcagcgcgacgctagccagttaagattctgtaaacgattacaaattgaatttgtctattagagcaaattcatctataatagaaataggatatgagaagagtggtccttctgatatcaatcagaacaagctttttgcttggactggaaggagatgaatatctgttggcaaatctggcgaacattgcgtaatagcagataaatggcgcaagcaaccaagccattttgaaatagctgcggcagaggctatcgccgtagacagctgcttgaggcaagagcagtcgtcttaggagccattgacaggcagaatcacttgtcggtggtaaacgcagtgaacgtgagtgaatcgcgttaagcgtcaggatttggataacagagaagtgcaatgctaaaattcaatattcgtggtgaaaacgtcgaagttaccgaatcgattcgcgactatgtcatcaagcggatcagcaaactggaaaagttcttcgaagataacgttgaggcaaatgcgcacgttaatctaaaggtctaccctaacaagaccttcaaagttgaagtaacgattccgctcccatacttaacgctgcgggcggaagaaacttccagcgacatgtacggcagcattgacttggttaccgacaaactggaacgtcaaatccgtaagtacaagaccaaggttaaccgcaagtcccgtgaaaagggctacaagaacatggactttgtacctgatgttgaagacgaaccagtcagtgacgatttaaagatcgtacggaccaagcaaatctccttgaagccaatggacccagaagaagctgtcttacaaatggacatgctgggacatgacttctttgtctttgaagacgctgaaaccaatggtaccagcgttgtataccgtcgtaaggatggtcgctacggtctgattgaaatcaactagtccgtaaacagcggaaaggaatggcatttttagccattccttttttgattgctctgagatcttcatgagatagggcttggttgaacagtttcatgttcatgtcgcttgttccatgttaaaatgggaaatatgaaaataaaatgataatgggttagattgcacttgatgatttaaccttttagaatcattgtaatggaggaaatgacgcttaatggcgaacgtactgaaaaagtggattgaaagcgatcgacgagaactgcgccggattgataagattgccaatcgggtggaaagctacgccgatcaaatgagcaagctgacggatgaacagctgcaggccaaaacgccggaattccgagaacgctatcaaaaaggcgaatcactcgacgacatgctgcccgaagcctttgcggttgctcgtgaggctgccaaacgagttttgggactgtacccttttcacgtccagattatgggggggatcgttcttcacgaaggcaatattgcagaaatgaagactggtgaaggtaaaaccctgacggctacgatgccggtctacctcaacgcaatctctggcgaaggggtgcacgtcatcaccgttaatgaatatctttccaagcgtgacgcgacggaaatgggacagctgtataactggctgggctgctcagttggcgtcaacaactctgagatggaccctgatgaaaagcgtaaagcctaccaatgcgacatcatgtactcaaccaacagtgagattggtttcgactacctgcgtgacaacatggctgtctataaagaagatcaagtgcagcgtggcttgaactttgccattgtcgatgaggttgactcaattttgatcgacgaggcacggacgccattgattatttccgggccaggtacggggacgtcgaagctttatcagcagaccgaccgtttcgtcaaaaagctgaaaaaagacgttgactacaagattgatttggaatcaaagacggtttcgctgactgatgaagggatcaagaaagctgataagtactttaatctggataacctctacaacccagagaacacggctttgacgcaccacctggatcaagctttgcgggccaactacatcatgctgcgtgacaaggattacgtggtctctaaggataaagaggtcctgatcgttgactcgtttactggacggatcatgcagggtcggcgtttttcagacggtctgcaccaggccattgaagccaaagagcacgtgccgattcaagaagaaaacaagacgatggcgaacatcacttaccaaaacctgttccggatgtacaaaaagcttgccgggatgacggggacggccaagaccgagcaggaagagttccgtgagatctacaacatggaaaccatctcgatcccaaccaaccgtcccgttgcgcggattgatgagccagatctgctctatccaacgttggaaagcaagtttagggcggtcgtcaagcgaatcaaggcgctgcatgaaaaaggccagccagtcttggtcgggacggttgcggtagagacttcggaatatctgtcagcaatgctggacaaagaaaatatcccgcacgtggtcttaaacgctaaaaatcacgccaaggaagctgacattattaaaaatgccggtcaggttggagcggttaccatcgctaccaacatggctggtcgaggaaccgacatcaagctgggaccaggcgtacgtgaactgggcggtttggcggttatcgggactgagcgtcatgaaagtcgccgaatcgacaaccagctgcggggacgttcgggacgtcagggtgatccgggaatctctcagttctatctgtcactggaagacgacttgatgcgtcgctttggtggcgatcgcatcaaggccttcttggaacggatgaaggttgaagacgaagatgctgtgatcaagagtcgtttcttgacgcggcaggttgaatcagctcaaaagcgggttgaaggtaacaactacgactcacgaaagaacgttctgcaatatgatgacgttatgagagagcaacgtgagatcatctataaggagcgtcagcaggtcattactgaggaaaaatccttgaagtgggtcttgatgccgatggttgagcggacgattcagcgagaggttgatcagcatacgcttggcgatcaaaaagactggaaactgcaggaaatcgtcgactttgccgttgaaacgctggtaaagccggatcagatcagcatcaaggatctgcagggcaagtcgcaatcagagatcgtcaagtacttgatgagtctggccaatggcgtttacaaagacaagcagcgtcagctttatgatccagcgcagatgcttgaatttgaaaaggtcgttattttgcgggtcgtggactctcattggaccgatcatattgacgtgatggatcagttccgtcaatcggtcgggctgcggggctatggtcagcttaatccgttggtcgagtaccagacggctggctaccacatgtttgaacagatgattgccgatattgaatatgaaacgacgcgtcttttcatgaagtcggaaatcagacacaacgttgaacgataaaaccaaacaggtacggcagcagggcgccaggcacggtaccgctgtcgtatttttgcttattgaaaggatgaatcactttggaactaagtgaagccaagaaaaatttagaagcaatgcaggctgaggttgcacgcttcgggaggtctctttgacctggatgccttaaacgagcgcatcgccgaaaacgagcaccggatgacggatccgaatttttggaacgacaacgaaaccgctcaaaaagttatcaacgagaacaacgatttaaaggccaaacgcgacacctacgtccatttaaaagaacagctggaaaatctgcagacgacgattgagctgctgagcgaagatactgatgatgagctgcagtcagagtttgagcttgattatgcggcaacgcaaaaagagctgcaggagtatcggctgacgcagctgctggatggaccatatgatgacaagaacgcaatcctggaaattcatcccggtgctggtggtaccgaggcccaagactggggtgcaatgctgcttagaatgtatgtccgctgggcggagcggcatggttttgtcgtagagacggccaactatgaagctggcgaagaagccgggattaaaagcgtgagtctgctgatcaaagggcgcaatgcctatgggatgctgcgcagtgaaaaaggcgtgcatcgactggtaagaatctcgccgtttgatgcggccaagcgccggcacacctcatttgccagtgttgacgtcatgccggaactggacgacagcgtgcagatcgatattgatccatccgatctgcgggtcgacactttccgttcatcgggtgccggtggtcagcatatcaacaagaccgagtcagccgtccggattactcacttgccgactgggatcgtggtggcctcgcaggctgagcgctcgcagctgcaaaaccggcagacggccatgagcatgctgaagtccaagctttatgaattggaagaagaaaagcgggctaagcagcgtgctgagattgagggcgttcagctggatattggctggggctctcagattcgctcctatgtctttcagccttacacgatggtcaaagacaaccgcagcggctatgagactcatgacgtgcagggggtaatggatggcaacctggatccatttatcaatgcctacctgcagtggagattgagcaaaaagaatccgcattaaagcagattgtgatgaaagcgaaaacaaagtaagatagataaagaaaggaaggaaaaatcttgaccagagaacagcgttacaaacaaaagcggcggctgactcgttcggcaagcgatcgctatcttgccggcgtctttggcggcttgggccagtattttaagatcaatcccaaatggctgcgaatcggctatgcggttttgacggttctgacctcaatcgttcccggagttttgatctatctgttgatggcagttatcatgccagcagatccacaacctttcaatttctttgattggctgaatcgggccaagacgcctgaacacaagcaggagccgcggcgagtactgcatgatgttgaagaacatgacgttaaatcaggaaggaaagattaatgggctttttcaagagcgttttgattgatgccgttttgtttattgccttggccggactctttgctcagaccggtatgttttacgtttccagcgttggcgtggcattgttggccagcttggttttagcagtcttgaatgcactggtaaagccatttttgctgctgatttctttaccaatcaacgttttgacgctgggcctttttagtattgtgatcaatggctttatgctgattttgacctcaagcgttgttggcaagagcgtcttttacttttcatcgctggggtcggccatgctgattgccttgattatgtcagtatgcaatacgattattgccaaccactttgtagaaagttaattatcgggaagtgaataaaaatgccagaaagcgtaactgttgaagagttagtcaaaaacgtccgacttaaagtgctgcaaggggaagactatctgcagcgtccaatcgtcaccagcgacatctgccggcctgcattggagtttgccggctattttacccactatccagctgagcgcattcagctgctgggaattacggaaacctcatttgccaaagatatgacgcaggcgcatcggactgaatacatgacaaaaatgtgtatgccgcagacgccatgtttcgtaatctcaacggacctgccgattccaattgaactgtcaaaagctgccgaagcggcccatattccgattttaggtacgcatttgacgtcatcacggattctaagcaatatgacctcctatctggtgggctgtttggccaagcgtcagtcgctgcatggggtcttggttgatatcaatgggatcggggtcttgattaccggtgattctggggtcggcaaatcagaaacggccttggaactggttcggcgtggtcatcgtctggttgccgatgatcgggttgaagtctatgccagagacgaacagacgctggttggctcagcaccggccattcttgatcacttaatggaaattcgcgggatcgggatcattgacgtgatgaatctgtatggtgccggagccattatggaaagcgacatcatcaattttatcgttcacctggagacctggacgccggatgctcagtttgatcgattgggcgatcgcggtgatacgcagacgattcaaggcgtcatcattcctaaagtctcaattccggtcaagacagggcggaatctggccattattatcgaatcggcagcaatgaactaccgcgctgaaacgatgggatacgacgctactaagacctttgatgacaatttaaatcgcttgattcagcaaaattcggctcacgatacgcaggtaaaggaacaaaagcaggaaaatgagcatgattaatacgctcttaagcttagatccaattgcctttcagttgggggcaattaaggttcactggtatggtatcattattgcaaccggtgtcgttcttgcgctgtggctttcaattcgggaaggcaatcgtaagggaatcgatgaagaatatttttacgactatcttttatgggcgctgccaattgctgtgatctgtgcccgcatctactatgttgcatttcaatggccgtattattctaagtttccaggcgagattattgccatctgggacggaggcattgccatctatggtgcaatcctaggtggctttttgacgctgtatttcttttgtcgtgccaagaaaatatctgcttggacgatgctggatatcattgcaccaaccgttatcatggcacaggcaatgggacgctggggaaactttttcaatcaagaggcatttgggaaggttacgactctggcggcattaaaagctcagcatctgccagcctttatcattaatcagatgtatattggcgggcattatcgcgtgccaacgtttttatatgaatcgctatgggatctggcaggctttttgctattggtaagtctgcgtcatcgtccgtatctgttcaagcagggcgaaatctttttgacctacgttatgtggtatgcatttggcagattctttattgaaggaatgcgtacggacagcttgatgctgggacctttgcgaatctcgcaggtcttatcggcagtcctttttatcggcgcattaacggtttggatagcgcggcgccattcaaaacaattaccatggtatgccgcatcgttgaaaggagaaaaataaatgagtaacaaaattgctgttttaggtgctggatcttggggcagtgtgctggccaatcttttagtcggcaataatgaagaggtcatgctttggtcacgcgactcagaacaggtagtcacgatgaaccgctggcacattaaccctcaatacatgaaagacttcaagtactcacctgatctaaaggcaaccgacgatatggaagaagccgttcgggatgccgaatacatcctgatggtaattccaaccaagggactgcgtgaggttgccggcaatcttaataagattctggttaagctggatcaaaagccgcttttgattcatgccactaaaggtctggaacaagaaacctacaagcggccttctcaaatgctggctgaagagattgatgaggatcatcggcaagacattgtcgtcctttcaggtccaagtcatgcagaagacgttgccattcaggatatgacggcagttacggctgcttgtgccaatctgacggctgccgagcgtgtccaaaaactattctccaacaacttcttccgggtctacaccaacgatgacgtaattggtgccgaatttggcggagctttaaagaatattatcgcaatcggtgccggcgcgctgcaagggctgggctacaaagacaacgcacgggctgctttgattacgcgtggcctggctgagattcggcggctgggcgtggcatttggcgctaatccgttcacgtttatcggcctttctggggtcggcgacttagtggttacggcaaccagcaagaactcacgcaactggcgcgctggctatcaactggggcagggccgccagctggaagatgtcatcagcaacatgggaatggtgattgagggaatctacacggccaaggctgcctatgagctggctcaaaaacgcaatgtcaagatgccgattactgaggcactttaccgggtgctttatgaaggcgaagatattgaaacggccattaccaatctgatgagtcggaaggctacttcagaaatggaataaataatttgccataagtatggtaaaatgtaagcgtgtaactattctgctatgaagctgaaaggattttttgataatgaaacaagttcgtaaagcaattattcctgcagctggcctgggaacgcggtttttaccagctaccaaggccttagccaaggaaatgctgccaattgttgataagccaacgattcaatttattgttgaagaagctcgcaagtcaggcattcaagatattgttgtcgttgatggcaagaacaagcgctcgattgaagaccattttgactccaacccagagctggaagacaatctgcgcgacaagcacaaggatgagatgctgaagctggttcaagaaaccactgacattaacatttactttattcgtcaatctcacccgcgtggcttgggggatgctgttttgacagcacgcgactttatcggtgacgaaccattcgtcgtaatgcttggcgatgatttgaacaacatcaacaacaacggtacgccattgactaaagagctgatcgacagctatcacgaaactggtgcttcaaccctggccgtaatgcgcgtgcctcatgaagatacctctaagtatggtgtgatcaacccaagcaaggaagtcaagccggggcttttcaacgtcacgagctttgtggaaaagccagatccaaaagacgcgccaagtgatctggcaatcattggccgttacgtctttacgccagaaatttttgacgttttggctaagaccaagccaggcaagggtaacgagattcaattgacggatgccatcaacacgctgaacaagacgcagcgggtatttgctcatgaatacaagggtgatcgctatgatgtcggcaacaagtttggctggatcgagaccaacatcgaatatggtctgaaccacccagaagttaaagacgagctgcgtgaatacattaaagagcttggggccaagatgtctgctgaagacaaggctaagaagtaattaaaaaaatgggatgctgataaaaagcatcccgttttttattaactaacaaaaagtaagcaaaatgatagacaaataatcttaaaccaagtaagatatcattaatcattatttatacggaggaacaacatggcagaagaaaaacaaaccaattatgacgtaatcgtggttggcgctggtcctgctgggatgaccgcggctttgtatgcctcaagagccaacttgtccgttttgatgctggatcgcgggatttatggcggtaatctgaataacacggccgcaattgaaaactaccccggctttaagacggttcagggacctgaactggcacaggatatgtatcaaggggcgacgcagtttggtgcccaatatgcttatggtacggttgaaaaagttgagcttgcaggcgatttgaagcagctgacgaccgacatgggcgacgtctttactgctaaagtattggtaattgcaacgggaactcagcagcggcatatgggagttcctggtgaagaagaatatggcggccgcggcgtatcctactgcgcggtatgcgacggcgccttttttaagaacaagcacgtagtcgtcgttggcgggggcgactcagcagttgaagaggggatgtatctgactcagctggcaaaaaaggtaacggtagtagttcggcgtgaccagttgcgagctcagccactgattcaagaacaggctaagcaaaacgacaagatggaatttatcttcaatactcaggttaccgaagtacttggcgatgataataaggtcgtgggcgttaagacgcatgactccaagactggcaaggatgcggaaatacaagccgatggggtctttatctatgttggcagcgtgccgatgaccgctccgtttaaggatttgggtatcttaaacgagcagggctatgttaagaccaatgatctgatggcaaccagcctaccaggtgtttttgccattggtgacgttcgtgaaacgccgctgcggcagattgcaactgcagttggcgatggcgcgattgccggtcagcagatctatcaatacttgatgaatcattaaaaaaaggatgggatttgtcccatcctttttatgttacttgccttccttggcagctttttgactttcagcgtacttttgcttgatgtagttggctgatgtctgcagtttttccagctcttcgtcagtcagatccagttgaacctgttctaaaataccatcgcggccaactacggcagggtaggaaagataagtcccgtattcctcacgatagttggatactggcagttcggtgtgggcatcagaaagaatcgtgttgaccagacgaacggcagccgttgcaaccccgtagttggtgtacttcttgccacggaaaacggtaaagccgccaactcgggcctcatgatccagactatccaggtccaagccgcgatccttagccagttcagtgattggctgatccaatacgcgaaccgttgaccaggcagtaaattgagagttcccatgttcacccaggttgtagccggtcacggaacgaggatccagatgcagacgctgagcaacggcccgcttcattcgtgccgagtcaagcagcgttcccgtaccaatgacatgattctttggcaggccggtaacttcttgataaattgaagtaatcacgtcaactggattggtaattacgaccatcttgccatggaagccggattctttaatcttttgagcgacttcacggacttgaacgcgcgtaaatggcagttcggcaaagcggtcatcgtctttgttgtcctgcagcttgatattgccgagtgctgaaaccacaacatcggcatctttcaattgcgaatagtcgttaacgaagatgttggtgtggttcttcaggtttggcattgcgtcgtagaagtccaatgcgtcggctttgactttagcttcgtttttgtcaatcagtaccaggtcgtcaacaaagccacaggccacaatatagtgagcaactgcggcaccaacgtttcccattccgataacagcaacttttcgactcatacggacatctccctttaaattagaattaaaacttattttttaatgtttttctaatattaacgctattttttataaatgtctatgaaaattttgctgaaaatagcaaagatttcttgatttgaccatgctaagattagaaaaacagatgaaatgattgatacgaaaggatggttagccttgggatgctatctaatcagcgacttggatcataccctgcttgatgaacagggaaggctgagttcaagaacgattcttacggttgttaaaagccagctgccgctaatgctggcttcagcgcggatgccgattcaaatgcttgacctgatcaaccagctgcagctgactggaccacagacggctttgaatggcgcggttgtttttcagccggctgttcatgaatttagggttttagagcagcatgcaattccggatcggacggcacaaaagctgcagaacttagttaaaaccgaatttcctgagctgaactttacctggatggatgccgaaagatggcatgtttcaaagcttgaccaacagattgaaacagagattttttatacgggcattcagccgctttttgatgccgatcagcggccgctaaaaaacgcactgcagattttgttgattattgaagattcaaaacggctaaaagaggtcaaaaaacggcttaccgcgagctattcaaatgaaatcgcaattcatgaggccggcgatggttatttaacgatcaatgccgcagctgtcaataaagggtgcgctgttcgctatctgattgagcatgaattggcggattatgatcagttggtcgcatttggtgatgatgaaaatgacctgcctatgctcaaaagcgttgcccatccagttgccatggcaaatgccagtcaaagtgtcaaagaaagcgctgaaataattgctttaagcaatgaagaggatggtatagcccaaattattgaacgaattgcaccaaacaagttctaagtgcggtatacttaagttactgtgatacaggtgattataatttaaggagatgtcattgtgagttggaaagatacctaccagacttggcttgatcgcaaagacctggaaccaagcttgaagcgtcaattggcagcaatgaaggacgaaaaagaaatcgaggatgccttttatggtccgctttcgttcggtacagccggcatgcggggattgatgggccctggtatcaatcggatgaacgtctacacggttcgtcaagctacggaaggcctggctcaattcatggatacgctgggcgatgaaatcaagcagcgcggggttgctattagctacgattcccgtcataattcacgcttgtttgcccatgatgctgctcgtgtcttgggagcccacaatatcaaggtctacatctatgacaatctgcggccgaccccagagctgtcatttgccgttcgctaccagcatacttatgccggcattatgattacggccagccacaaccctaaggaatacaatggttacaagatctatggcgaagatggcggtcagatgccacctaaggaatctgatttaatgaccagctacatccgcaagattgatgatattttcgacatcaagctggcagatgaacaagcaatgctcaacagtggtctggaaaccatcatgggcgaagatgttgacgctgcctatctggaaaatgccaaaacggtcacgatcaaccatgagctggctaaaaagtatggcaaggaaatgaagtttgtctttacgccattgtgcggtacgggacggatgcttggcgaacgggccttgcgtcaagctggttttaccaactatgaggttgagccgtttgaaggtcagccaaacggagactttcctggcttggaacatcctaacccagaattccctgaagcattcgttcgttcagaaaaactgggcaagcaggtcaatgccgacattctgattgccactgatccggatgccgaccggttgggatgcgcaattcggcagccagatggcgaatacctgctcttgactggtaatcagattgcttcgatcatgctgcactacattttggaagcgcacaaacaagcgggtacgctgccagccaatgcggcggccgttaagtcaatcgtttcgactgagtttgccaccaagattgctgaagattacggagtcaagatgattaacgttttgaccggctttaagtggattgccgatcagattcaccaatatgaaaccaagcacaaccacacgtttatgttcggttttgaagaaagtttcggctacctgatcaagccattcgttcgcgacaaggatgccatccaaactctgacgctgctggcagaagtggctgcctactaccggagccgcaacatgacgctgtacgacggtctgcaggaattattccaaaagtacggctacttccaagaaaagacgattgccaatacctatgccggtgttgaaggtccagccaagatcaagaatctgatgaagaagttccgtgaagaagcgccaacgcattttgctggtcaacaggttgcggtaacggaagacttttccaacaataccaagacgctggctgacggtacggttgaagagctgggaattcctgaatcgaacgtattgcgctacgttttggctgatggtacctggattgccattcgtccttctggtacggaaccaaaactcaagtactacattggtacgagtgctgatacgctggcgggcgccaagcagaaactggctgactttgaaaaggcactgcaagaatttgctgaagcctagccaagctgaaaacgacttgcgggaaaccacaagccgttttttctattaatatgaaagcaggtgatcagatgggaatgcatgagtatttaaaaagtttaagcgatcttgagatgatcaatcgtgcgccgggatactttaagtttgagcagcataacgtagcggcgcattcatttaaggttacgcaggcggcacagatgctgggcgatattgaagaacaatccggcaatgaggtcgattggcgctcgctttatgaaaaggccttgaaccatgattatacggaacgttttatcggcgacatcaagacgccagtgaagtatgccacgcctgagctgcgcgaaatgctggccaaggttgacgactctttgacggacaactttattgaaaccgagattccgccagagtttcgccaggcttatcgtcgtcggttcagtgaaggcaaggatgacagcttggaagggcggattctgtcggtagccgacaagattgatctgatgtatgaatcgtttggcgagattcaaaagggcaatcctgagccggtctacatggatatctatcgctctagtctggagtcgatcatggagtttcatgagatggccagcgtaaagtacttcttaaaaaagattctgccagagcttttaaaagacaatgccgggacacaaagccaaacccaattggctgtgattaccacgcagataattcagcgctgatcaaaaaagattctgctgagcaggcagaatcttttttagtggattaatctgaatggtaccagcaattggacgtgtcgctgactagccgttaaagagctgaatgaatctacggataacagcgcattaaaaagacctttttgagctgggatcagcagataaggccaggctgcctgcaaacttgttataactggcgatgatgaaacgatctcgctaaaccagcgatgagccagggcaaatgcgatatcgtttagggcggcggcgaagttctggatgtcattgatgtgagccagatcagcgtcttggttcagaatttcatgatcatgcgccagatcgcgagccagggcaatcaatggaacgattcccgtctgcagcagaaaatagtcctgctcgtcatgtgattgaccataataaagctgcagcgtctgtcagggctgctgagtgccaataacgtcaagcagcgcggccacgactgcttttgtctgaactacggtttgatcagaccgatcacgcgtcgaattggcatagctggtcagcaattgattggcaaatctggttgagccagcgaatcttttaggatcagtcatgaattcttcggtaaatgaagggatcgaatgatgaatcctttgagccgcaatgcgactgcgctgttcgtcaaaagcagtgaaggtatcaagtcccaggggtaagtaaaaaaattcggtctcgcctggtttgagcggtgaagatgaaaaagtttttaaaatgtagtcatgaactggatcgctggagaattcctgcagcagctgttcaaacaattcatctggaatcatacgcgccatcctttctaatctggctcttcgccggctagatcagcatccagcgacattgccatgataactcggccgtgcagattccaatagtcggcacgggtcggaaagtcgtcttgaagcgtccaccgttcaaaatggcgatctggctgtaaaaacaaggtatcactggcagctgcctcgccttgatcgggctgttcggtcatttccaacgctaaggcatggaacagagtaaagacccattgatcaaactgatggtagttggttgaaaaaagatcgttggcagaaaagttgaaagccgtctccattgaatgtgctaagtggtacagtggtgcaaaaccagccgtaaacatctggtagtcgtgatgcattgggtcggtgccaaaaaagcacagcagggcatgattcaatgaagtcgtgcctacatgatccagcagctgggcactgactcgccagatatgaatcggctgaccagtcagctcctccatccagcgcgtggcctaaaccgttgagtagcgatagtcgttttcattgaaatcctggctaaagctttgggaaaatgccagctgctgaagattttcgggaatgccggctttttgctgtgccaatcgggaacgctcattcaattccagccgcgcacgatcataggcagtaatcgttgctttagtggggcgaaaaacaaattcggtccgccccggttctaaaagcggtgagcgaaaaaatcccgtcagataattggtatgttgattgaagcgataggtaagatattcacgttctagtcctttacacatagctggcgtaataaacatgccaaacatcctttccgatagactgataagaataactaattctttcacgtttttcgcggtttgacaaataaatgcaatttgcgcgtcaatcacctataatttaagacaacgctacctcaaggaggaattggaatggataagccaacgcgtcgtcggattgatggccagatcttattatcagggctggctaattttgccatgtttgtcggcggtttttgtctggccggcaagcatatgggctggatggcggctatgctgctgatctatttagcagctaccggactgcagttttatctaatgggtaaattagccgttgaacagcgtcacgatgattgaaagtgcgctatactggatgaaagaataatttaaaaaggagccctttgccaatgattttgacttttgccgtcaatggcacgctattggatgaaacgccattttttgaaaaattaaaagcacttgctgaagaaccaaaactggatgcagaacaggtggcttttgcctatcgtttttatcaggcccgtctgcagtatggccaggcctatcaagatgccaagacgattttaaaacagactttgatgctgatggatgttcagtttaatgatcggggctggtttgctcgtcactatgaagaactgctggctgcccaaaaagaactgtcgccatttgatgatgcgttaaaagcgctgccgctgctcaagcgccacaataagctatatgcagttgccaacactgacaatgatattgcgcaggctcagctgcaggcgcttgatgaatggctggatggtattttaacggctgaacaggcacagtcctaccagccgcaagctgccttgtttgagcgagttgctgaaaaacttgattttgaccatcaagcgcatgctcacattggcagcgactattggcaagacattaagccggctgcggatcgttcctggcataatgtctggatcaatcgtcaggcaatggccaactcgcggatgtacaagcataacaaggctttgccgactctggagaaattgccggactatatcgcacgcgtggcgccagatatggaagaacgtgctggacgccagtcaaactaagcaagataagctgccagaacaaaggcagctttttattttgaaatgatctgaaaatgatagtgcaaatcattagacgaataaacgttcgtgtgatagacttgtaccgattttattaaggtaacagccatcaaccgtctgcaagggggaaaaactttgatttatcgtcagccagatcgaccatttgaattgatttctgactaccagccaaccggcgatcagcccgaagccatcgcgcaactgacgcaagggctaaaaaaaggcgagcacgctcagattttgctgggagccacgggaacaggcaagacgtttacgatttcaaacgttattgccaaagccaataagccaacgctgattttatcgcataacaaaacgctggctggtcagttgtatggtgaaatgaaaaaatttttccctaataatgcagttgagtatttcgtttcatattacgactactatcagcctgaagcctatgtaccatccagtgatacttatattgaaaaggatgcctcaatcaacgatgagatcgacaagctgcggcacgcggcaaccagtgcacttttggaacgcaatgacgtaattgtcgttgcctcggtttctagtatctttggcttgggtgatccgcgcgaatatcgcgatcacgttctgtcgctgcatgtcggccaagaaattgagcgtaatcagctgttaagagatctggtcgagattcagtttgatcgcaatgatattgattttcaacggggccgttttcgcgtgcatggcgatgtcgttgagattttcccggcttcacgcgatgagcgggcactgcgcgtcgagttttttggcgatgagattgaccggattcgtgaggttgatgccttgactggcgagattatcggcgatcgtgagcaggtctcaatcttcccagctacacactttttaaccagtgatgacattatggataccgctttgccgcaaatcgaggctgaaatgaaagaacaggtcgcaaaatttacccaggaaggcaaaccgctggaagccgagcgaattcagcagcgaacgacctatgacatcgaaatgatgcgtgaaatgggctacaccaacggcattgaaaactactcgcgttacatggacggccgcaagccaggcgagccgccgtttacgcttttggatttcttccctaaggattttctgttgatcgttgatgaatcgcaccagaccatgccacaggtgcgggggatgtataatggcgatcgagcccgcaagcagcagctgatcgactatggtttccgactgccgagtgcattggataaccgaccgcttaagctgagcgagtttgaggagcgggtcaatcaggtcatctacatgtcagccacgcctggaccatatgagcaggaacagactgatcacgtcgttcagcagatcattcggccaactggacttttggatcctaaagttgaggttcgcccggttatgggacagattgatgatctggttggcgaaatcaatcagcggatcgaaaaaaatgagcgggtcttgattactactctgaccaagaaaatgtcagaagacttaacggattatctaaaagatctcggcttaaaagtcaagtatctgcacagtgacatcaagaccttggaaagaacgcagatcattcgtgaactccggttgggtaaattcgatgtgttggtcggaatcaacctgctgcgggaaggtctggacattccggaagtttcgctggtcgcaattttggatgcggataaggaaggcttcttgcgtaatgaacgctccttgattcaaaccattgggcgggctgcccgtaatgccaacggtcaggtcatcatgtatgccgatacgattactgcctcgatgcaggccgctattgatgagacgaaacggcggcgtgagattcaagaagcctataatcaagcccaccatatcgtacctaagactattatcaagccgattcaagaagcaattactgcagttaagccggctgaggatgctggtgaggtcgagcatgatactgagtttacggttaaagatttcaaggctttggcaaaagacgagcagcagaatctgctggctgagctgactgagcagatgcgttcagccgctaaacgacttgactttgaacaggccgccacgctgcgcgacacaatcatggagcttaatgcggcggtcaagaataaaaaaaccaaacaagctaaacattgaagctagggggatttggcaatggccaacgataaaattgtggtgcatggcgcacgtgcccacaacctaaaaaacattgacgtgacgattcctaaaaataagctggtcgtaattaccgggctttctggatctggaaaaagctcgctggcctttgataccctgtatgcagaggggcagcggcgctatgtggagagcttgtcggcctatgcgcggcagttcttaggacagatggataagccggatgttgattcgattgatggactgtcaccggcgatctcgatcgatcaaaaaacgacttctcataatccgcgctcaacggttgggacggtaaccgaaatcaatgactttttgcgactgttgtgggcccgtgtaggaacgccaatctgtcctaatgatggcagcgtgattgccagccagtccgttgatcagatggttgatcgggtcatggaactgccagagcggacgcgactgcaggtgttggcgccgattgttcgtgacaagaaaggaactcaaaaaagcgtttttgaaaagatcaaaaaagctgggttcgtacgggtgcaggttgatggccaaacctatgatctagaagaggttccagagctggataagaacaagaagcatatcgttaatgtggtggttgaccggatcattatcaaagaaggcattcggtcgcgtttgtttgattcatttgaagcggccttgcgcttgagtgacggctatgccacggcggatgtgattggtggcgagccattgatgttttctgaacaatatgcctgcccagtttgcggctttacggttggcgagctggaaccgcggctgttttcatttaacgcgccgctgggggcatgtccagaatgtgaggggctgggcagcaaattggaagttgatgaagaactggtcgtgccagatcgtgggaagacgctgcgtgaaggggcaatgctgccttggaatcccatctcttcacaatattatcccaaaatgctggaacagttttgtaaatcagcaaatattgatatggatgttccatttgagaaactgcctgccaaacagcaaaaacaagtgctttatggcaatggcgaaaccactttccatttccattatgaaaatgactttggcggcgtgcgggatgttgacgttccatttgaaggcgtaattaataacgttaagcgacgctatcaggaaaccaattctgacttcacacgcgaacagatgcgcaaatacatgactgagcttccttgtccggcctgccatggctatcgcttaaatcaaaaggcactggcggttaagatcatgggccaaaacattggtgaggtctcagagctgccaatcagtaaggcaattccgttttttgaatcggttgagctttcaccagccaaggccaagattgctcagccgatcttaaaagaaattctggatcggctgacttttatggccaatgttggcgttgaatatctgaccctgagtcgagccgcacggacgctttctggtggcgaggcgcagcggattcgtttggctacccagatcggctcgaacctttctggggtaatgtatgtcttggacgagccgtcaatcggacttcatcagcgcgataacgatcgattgattgcctcactcaaaaaaatgcgagatcttggcaatacgctgattgtcgttgagcatgatgaggacacgatgcgggctgccgactatattattgatattggtcctggcgcgggtgaaaacggcggtcaggtcatggcagcgggaacgcccaagcagattatgcgctcacgtaaatcactgactggacagtatctttctggcaaacagcagatttcggtaccagaaaagcggcgaacgggtaatggcaattttattgagcttaaaggtgcgcgcgccaataatctcaaaaacatcgatgttaagtttccgttgggcgaatttatatgcgttaccggggtttctggctccggtaagtcgacactggtcaacctgatcttaaaacgaatcctggcacaaaaactcaatggtgcatcggcaaagccgggaagctatcagtcaatcagcggtctggaaaacgttgaaaaggtaatcgatattgatcaatcgccaattggcagaacgccacgcagcaatccggcaacctataccggtgtttttgatgatattcgtgatctgtttgctcagtccaatgaggctaaactgcgcggctacaccaaggggcgctttagctttaacgttaagggcggtcgttgtgaggcttgccggggcgatgggattttaaagattgaaatgaactttttgccggatgtttatgtaccatgcgaggtttgtcatggcacgcgctataattctgaaacactggaagttgagtataagggcaagaacattgccgaagttttaaaaatgacggtttcagaagcgttggaattctttagcgccattcctaagattcggcgtaagctgcagacgattgaggacgttggtctgggctacgtacagctggggcagccggcaacaacgctttctggtggggaagcccagcggatgaaactggccagtgagctgcatcgccaatcgaatggcaagagtttctatatccttgatgagccgacaactggtctgcatatggcagatatcaagcggctgttgggcgtcttgcagcgcttggttgatgccgggaatacggttttggtgattgagcatgatctagacgtagtgaaatcagcggattggctgattgatctgggtccagagggtggcgaggctggcggttttatcgtagcagccggaacgccagaaacgattgctgcagtacctgaaagctacacaggacagtacttgaagccaatgctcgagcgagatcgacaaagaaaggctcagcaggaaaaataaatagattttaatataaatgaagtttaagctcagctgcatgaaggtgcgctgagcttttttgctgtttaggattgaaatcgcaaaaccattatattaagattaagccattataatttgattaaatttaaattaaaatggggggtctaatgatggatctgaacaatattcacactggaaagaatatctcactgaatggtcatacgattttgattggcttaatggcggatccgattcgtcattcaatgtcaccaaccatgcacaataatgcttttgccaagctggggcttaattatgcctacctctgttttgaaatcgacaatcaaaagctgcctaaagccattgatgctatcagaacgctggatatgcgcggctcaaacatctcaatgcccaataaacaaaaagtaatcccttaccttgatcgcttggatgagtcagctgaactctgccaagccgttaataccattgtcaatgatcatggcattttaaccgggtacacgacggatgggatcggctttatgcagtcattaaaggatgaaggattggacattaccggtcaaaagatggtgctgacgggtgctggcggggccggaacgccgattgccatgcaggcagctattgagggagttaaagaaatcgccttattcaacattgatgacgataaatgggaaaatgccgttcgcaatgttaagatcatcaacgaaaaaacgggtgcgcatgccacgctgcatcatctagaagaccaggccgactttaaaaaagaactggccagctgtgatatctatgtagatgcaaccggcgtagggatgaagccattagaagacatgactttggttgaagatccaacgtggttccaccaagatatgatcgtctacgatacggtttacgcacctcgcgaaaccaagctgatgcaggttgctaagcgcgctggcgtcaaccatgtttttaatgggctggggatgatgctggaacaaggtgcagcggcctttaagctttggacgggtcaagatatgccggttgaatacattcgcaatctgctttttaaagaggaagactagatgaaaaaagtaaagctgaataacgttgtcttaggtgatggaagccctaagattgccgttccaatcgtagcagccgatcaaacagcgataattgagcaggcacgaacggttttggccgcccagccggatgtcgtcgaatggcggattgattttttggctggtgttttagatccagaaaaactaaaggcggctgctctcgacctaagacaaacgttgggtgagacgccgcttttgactacgtttcgcacggctaaggaaggcggcaatctagtcgttgatgatgagacgtattttcaaattgtacgcctggtagttgaaaatgaactgacgttggccattgatgttgagttatttcatccaaaagaaggcgttatgcgaatcattaagttggctcatgatcatggcatcaaggtaatcatgagcagtcatgactttaagcagacgccaaccgactgtgaaatctactatcgacttcataggatggctgatctgggagctgatgtcgccaagattgctgtgatgcctcaaaatccggctgatgttttgacgttgctgtcggccactcaccaggccaatgaaaaactcgacctgcctttaattaccatggcaatgggagatttgggcaaggtaacgcggattgccggtgcggtttttggatcggcgttgacatttggcacggttggtacggcttcagcgcctggtcaactgagcattgctgatttaaggcaggccttagccaatctaagaatttaattcattaggcattctggaagccattggtcgcttcaagagtgccttttatttagatgaaaaagacttcaaaattaaaagacacgcccgggtatgatacaatggaaagcgtattttgaatagaggtgacagctccgtggcaaaaccactgcaagtcgtgatcattactgggatgagcggtgccggtaagacggttgccgttcaaagttttgaggatcttggctactttgtaattgataatatgctgccgaatctggcggaaaaatttgccgacgtgatccaaaacgctgctgaatttgacaaaatggcaatggtaatggattcgcgctcacaggaattttatgatcagattctgccctgcattcagcgcttaaagagtcgtactgatctgcaggttgagattctatttttggatgccagcgatgttgagctggtttcgcgctacaaagagacgcgtcgcttacatccattatcgcggcaaggcggcgttttagaaggaatccaaaaagaacgagcgctattgagtgatttaaagagtcaggccgatgtcgtgattgatacaaccgaactgacgccgcgcaatctgcgtgtaagaattgatgattactttggcgatggccagaccagcagtttttttgttgaggtgatgtcatttggctttaaatatggcttgccattggatgctgatatcgttatggatgcccgctttctgcccaacccgttctacttgcccgagcttaagcatctaaccggcaatgatcagccagtacaggattatgtcatgcagagtcagctggctaaagatttctactcacacttaaaggctttgctgaaggttgctttgccaggctatatccaagagggcaagagcagcttgacgatcgcgattggctgtacgggtgggcagcatcgttcggtgacgattgccaaccgattaaatcaagatctgcgcaaagacggttatacggtcaatctgcatcatcgcgatgttgataaggcaaaataaggaggtatttgaatgatccataaacctaaaatcgtaatgattggcggcgggacgggacttcctgagattctgcatggccttagggataaagacgttgatgtaacggcaatcgtgacggtagctgatgatggcggctcctcgggaattttgcgcaactatgtcaacgtggtgccacctggtgatattcgtaatgcattggttgctttatcagagctttctgaactggaactagagatttttcagtatcgttttaacagtaccgaccagtttttagctggccatgcaattggcaacctgatcatttcggcgctggctgagatgaaaggcggcgatatttttgcggcggtccaggaactgtcatcgctgatgaagatcagaggacatatctaccccgttaccgacgagccattaaccttaaacgctgaatttacagatggctcgactctaagcggcgagtcagagattacggccgctcataaacgaattcagcgtgtctggattacgccgtccaataacaatgaccatcatcaagcggcggccgttaagcaggttattgatgccattatggatgccgatcagattgtcttgggacctgggagtctgtttaccagtatcttgcccaacctgatgattgaaaacgtcggcaaggccgtttgtgaaaccaaagcagaagtcgtctatatctgcaacatcatgactcaaaagggtgaaaccgacaatttctctgatgccgatcatgtacgcgtgcttaattcgcatttgaaacagaactttattgataccgttttggtaaatatccaaccggtacctaaagactacattgattttaaggaatggaatgagatttcccagccagtcaagcatgattttcaaggattgcgggatatggggtgtcgggtaatctccagtaatttcctgcgcttaagagataacggtgcctttcatgatcgcgacaaggtggtagccgaactgctgaatcgtctgcatggcgtacattattaaataagaggaggatcgcgcatgtcatatgccagcgaggtaaaaaaagagctgacggggctgcaggtgcacttggataatgccaaggccgaactgatggcgctgattcggatgaatggatctttaggaattgctaatcgcaacatgattcttaacgtccaaacagaaagtcctgccattgccagaagaatctattcgcttttaaagcagttttatcaagtcgaaagtgagatcgtcgtccggcgaaaaatgaagctgaaaaagaacaatcaatacgttgtaaggcttcgctaccatgcgcaagagattctcagcgatctggggattttagaggggtttcagatcaaagaaaaggtcccgatggcgctgcttaaagatgatttaatgattcgttcatacctgcgcggggctttcttggcggggggctcggtcaataatccagaaacctcgcgctatcacctggaaatctattcattatatgaagaacataatgagatgattgctcagatgatcaatcgctaccgcttgaatgccagaactacggctcgtcgcagcggctatatcgtctacttaaaggaagcggaaaaaattgcggagtttcttcagctgatcggtgccactaacggcatgctcaagtttgaaaatatccgaatcgttcgagatatgcgtaattccgtcaatcgcttggttaactgtgaaaatgccaatatggataaggtagccaatgcctctaatcgtcagattgaaaatattcgtttgatcgattcaatggtcggtttagacagcttgccagaaaaactgcgggcaattgctgaaaccaggctcgcacatcaagaggtcagcttaaaggagcttggcgttttggtaccaggcggcccgatctcaaaatcaggggttaatcatcggctgcgcaagctaaatgcttatgccgaagaactgcggcaggctaagagcaactaaaaaaccacgactggatggcagtcgtggtttttttagctatttaggtcaaacaattactttagtttggcgctgttttccatgattccgtcaagcagaccataatcaacggcttcttgggccgttaagtagtgatcgcgttccgtatcacgttcgatttgctcaattggctggccagaattttcagccagaataccattgatcatcttgcgcgtcttcaagatctcttcggccgcaatctgaatttcagtttgctgaccttgtgcgccgccagaaggctggtgaatcataaccgttgagtgcggcaaaccgaaacgcttgcccttggcaccggatgataccagcacgctggccattgatgcggccatgccgattacgatcgtctggacatcagccttgatgaagttcatcgtatcgtagatggccatccctgaggttacgacgccaccaggtgagttaatgtaaaggtaaatatctttggtagaatcttgcgcatctaagaataacagttgcgcaacgattgagtttgccatgtcgtcttcaattggaccggacagcataatgatgcggtccttcaacagacgtgagtagatgtcataggcgcgttcgccacgcgatgactgttcaatgaccgttggaactaggttcatgctttggcctccctcttaattagcagtagtcaacatcgattgctaacttatgtgaatactatactcgataggtcagaaaaggtcaaatgttttgtcagaaaaaaacactgctgctaacgatgctgatatcgttagcagcagtgccttaatactggttgataaaataggtagaattattttaagtcagctgagatcatgctcagttcttggttggcgatttcggcatccagcattgcgcgatcatcgttttcgatcatttttttaagttcgtttagttcgtgcatgttctttttaaacataagtctcatctccccgtttagttgaaattgtgaatgaattaattgttaacctctgtgatgtctaagactatacaccaaattggtattattgacaagtgccagtttaaggcgatttagtgttttaataatcaaattggtatagttcaaattaacggaaaacgtttatcaattttcaattgtgaaaatagtgctaccgtttccaaaattgatgctgaatagcctttgtgttgaaaaagataaaaagtgagcaagacgtccaaaattcaaatcgaccgtccaaaaatttttttaaatttattgctgatcagttggttgcaataatagttgttgatttttaataacctgacctttataattggaatgttgattatttacgttagatataaaggaggcatattgcaatgcgtaaagcacatccatacggcgtacaaggccgtcgcccagtcgcagaccgttacacgcgggctaagaaggaaaagaaaatcgaagcaattcgcaagtgggctaagcaaaagccagctgaagaaaagtaatttgcttttccgtttaagaagacctcatccaggattatggatgaggtcttttaatatgttgtgatgtagttttgacttcgtggcaataaaaaagcactgatcagattgatcagtgcttttttatatttaagtgcgccccccgggagtcgaacccggatctcgagaaccggaatctcacgtgcgatccattacactaagggcgcgaaataattttaagctcgttgaattaacacgaacgtttattataatatccccagtgacgataaaatgcaagcaaaaaatgaatatttttacaaaaaaattggatgaagctggtttatctaaaactgaacacatttccatggacaagttagtcggttttgagtattataaaaaacgtaggttagtgcgattgtttagctaacagccaaaattccgaattttttccttaaaaatgtcaattttggataaaaatgtatgttaaactaaacaagaacattgaattattttcctaaaggaggaaattgcagtatgactgtaaaaattggtattaatggctttggccgtattggtcgtttggcattccgtcggatccacgaactgggctccaaggacatcgaagtggtagcaatcaacgacttgactactccttcaatgctggcttacctgctgaagtacgactctactcacggcaagttccctggcgaagtttcttctactgacaagggcatcgttgtagacggtaaggaataccctgtatacgctgaacgcgatgcacgggacattccttgggttaagaacgatggtgttgacttcgttctggaatgtactggtttctacacttctgcagaaaagtcacaagcacacctggacgctggcgcaaagcgtgtgctgatttctgcacctgctggtaacatcccaactgttgttccaggcgttaacctggacacgctgaaggctgacgacaagatcgtttctgctggttcctgcacgaccagctgcctggctccaatggcttacttcctgaacaaggaattcggcgttaaggttggtaccatgactacgatccacgcatttacttctacgcaagccatcctggatggccctcgtggcaagaagatgcgtaacaaccgtactgcaagcacgaacacgattcctcactcttctggtgctgccaaggctatcggcctggttattccagaactgaacggtaagctgtccggtcacgcacaacgtgttggtgttgttgatggctccctgactgaacttgtttccattctggacaagaaggttacggttgacgacgtaaacaatgctatgaagaaggcaactgaaggcaacgaagcctttggttacactgaagacccaatcgtatcttccgacattatcggctctacttttggttccgtctttgacccatcccaaactgaaatcatggaaggcgaagatggcgcacaactggttaagacggttgcttggtacgacaacgaatacggcttcacttgcaacatgatccgtacgctgcttcacttcgctaccctgtaaggcgaactgaatagtatcaattgaaaggcgggaggaggaaactccgcccgccttctttgcagattaaggaggaattggtcaattatggctaaaatgactgttgaagatcttcaattggaaggcaaaaaagttttgatgcgcgttgactttaacgtgccaatcaaggatggcgtcgttggcgacgacaaccgaatcgtggctgctctgccaacgatcaactacgttatcgatcatggtggtcgagcaatcctgttctctcacctgggtcggatcaagaaagaagaagacaagccaggtctgtcgctgcgtccagttgctgaacgtctctccaacctgctgaacaagccagttacttttgttccggtaacggaaggcaagcagttggaagacgccatcagccaaatgaacaatggtgacgtgctgctggttcaaaacacgcgttatgaagacgttaaagacggtgaatacgttaagcgtgaatcaggcaatgatcctgaattgggcaagtactgggcatcattgggcgatgtttttgtaaacgacgcctttggtactgcacaccgtgcccatgcttccaacgttggtattgcccaagcaatcggcgctggcaaatcaggcgttggcttcttgatggaaaaagaaatcaagttcttgggtgacgctgttgacaatccagttcgtccttttgttgccatcttgggtggtgccaaggtatctgacaagattggcgttatcgaccacctgctggacaaggccgacaagatcatcatcggtggtgggatggcctacacgttctacgctgccaagggcattaagactggtaactcactggttgaaaaagacaagatcgatgttgccaagcaaattatggacaaagccggcgacaagctggttctgccaattgacaatgtagttgctgatgcctttaagaatgacgccaacactaaagtagttgaaggcgacattgatgatggctggatggctttggacattggtcctaagacgattgaactgtacaagagcgttttggctgatgccaagacggttgtatggaacggcccaatgggtgtctttgaaatgagcaactttgccaaggggacgctggaaatcggtaagttcctgggcacgttgactgatgctacgacgattgttggtggcggggactccacggctgcagccaagcaattgggaattgctgaccgtttgagccacatctcaactggtggcggtgcctcattgacttacttggaaggtaaagaactgccagggatcgcagcaatttctgaaaagtaaagctagataagcgattgattagcatagtagcgattcagtcgctttttttgctaaaatcaaggcagcggaaaaattaaaaaggggggcttttgcatgcgagtaccaatcattgctggcaattggaagatgaacaaaacggtttctgaatcagttgagtttgtcaactatattaaaaatgaattgccagaccccagtgaacgagaaatcgtcctggctgcaccgacgctttcattgacgtcgatggtacaagtcgcgaaagatacgccgttaaaaatcgctgctgaaaactgctattgccggattgcaggtgcgtacactggcgaaactagtccacgctcattgtctttggctggcattcatcatgtcattctgggacattctgaacgacgtcgtttatttaatgaaactgatgagctgatcaatcaaaaagtccaggttgccttgcgcaatggcttgtgtccgatcgtctgctgtgatgatacgatgggacgacgaattgccggcaaaaaggtccgttgggtagtcagccgcattctggcagaccttaagggactgtcaccagctgatgttaccaaggttacgatggcttttgaaccaagctgggcaatcggtactggccaaagtgctgaccctgagcaggctgctgaaggctgctatctgattcgtcagacgattcgtgatatgtatggtgaagacattggcaacgcagtccgaattctttacggcggcagcgtcaatgaaaccaatatcaaagctttgatggcctatgatgatatcgatggtgttttggttggcggtgccagtctggatcctgatcgtttcttaaagcttgtaaactcttaagataaagcttgttttaaattgttctgaataatacaatggaaagcggaagaactttccaattttaaaatgacagaggagagattcatcaatgtcactcattactgatatttatgctcgtgaagtcttggactcacgtggtaacccaactgttgaagcagaagtctacactgaagccggtggcgttggccgcggcatcgtgccatctggtgcttctactggtgaacacgaagcagttgaacttcgcgatggcgacaagaaccgtttcggcggcaagggtgttttgaaggccgttgccaacgttaacaacgtaatcgctaaggaaatcgttggcatggaagttactgaccaagttgccatcgacaaggctatgatcaagcttgacggtacgcctaacaagggcaagctgggtgccaacgctatcctggccgtttccttggctgctgcacgggctgctgctgatgagctgcaagtgccactgtacaactaccttggcggtttcaatgctcatctgttgccaacgccaatgatgaacgtcatcaatggtggtgcccactccgacaacaaggttgacttccaagaattcatgatcatgccagttggtgcaccaactgttcgtgaagcaattcgttggggtgccgaaactttccacgccctgaagaaggaactggaagctgctggtaaggttacctcagttggtgacgaaggtggttttgctcctgactttgccaacaatgaagaaccattccaatacctgatcaaggcaattgaggatgccggctacaagccaggcaaggacattgctattgcctgcgacgttgctgcttctgaactttggaacgacgaagacaagaagtacaagctgcgttggtccactggtgaagaatacactactgaagaatggatcgaatacctgacgggcatcattgaaaagtacccaatcgtatccgtagaagacccaatcgacgaaaacaactgggatgactgggtaacgattaccaacaagctgggcaagaaggttcaactggttggtgacgacttcttcgttacgaacactgactacctgcgcaagggtatcaagatgggtgctgccaactcgatcctgatcaagctgaaccaaatcggtaccttgacggaaacggttgaagcgatcgaaatggctaaggaagctggctacacggcaatcgtttctcaccgttctggtgaaactgaagacacgacgattgctgacctggttgttgctactaacgccggccaaatcaagactggttccatgagccggactgaccgtcttgctaagtacaaccagctgatgcggatcgaagacaacctgggcgacgttgctcaatacaaggggattcactccttctacaacttgagcgaacaagctcgtcaagacatcgaaaaccgttaatatctaaattaatgattttaaaagcgtttggatttttccaaatgctttttttgattgctttgatttgtgctagactgattaggtaacaaaattttttaggtgtgagaagaaagtgaaaacaactagaattgcaggactcagttattcaaatctgcgccaggcaggccgcgccgttttaattggcttggcggcaggcttggttgtcagtctctttcgctgggcaattcaaaatctattgggtatggttatcaaagcatttgcctattttcatgggcatccggtctggctgctgccttggattggcatgagtattttcattgcactgcttttaggcaatctggttcaaaaaaatccggatattaaaggctcagggattccacaagttgaaggtcagctgacgggacagtttgatgaagaatggtggccggttctttggcgtaaattctttggcggcattatcagcattggttcggggctgtttttaggccgtgaaggaccctcaatccagctgggggctgctgttggtcaaggaattgccgaaaagaatgccagaactgaaattgaaagacgagtcggcattgccagcggcgcggcagccgggctttcggcagcctttaacgcgccaattgccagcacgatgtttattttagaagaggtttatcataatttctcgccactggtctggctatcggtatttatcagctcactgtcggctaatctggtctcgatggcgttctttggcctggaacctgatctgaacgtgccgcatgaggtgctgtttccagcttcacagtattggcatctgatcttattggggattttactgggcttgctgggcaggctgtatcaggtcgttatcttacggctgcctaaatggatgcgccagataaaatttctcaaaccagtctgttatccaatcatcccatttctgctggtcattccaattgcctggtggtggccggtaacgctgggtggcggaaacaatctggtcgttgcgctgcctaagatgccggctgagcttaaggtaatgctgggcttattggttttgcgctttgtcttttcgatgatcagctatgcgactgagctgccaggggggatctttttaccgattctgacgctgggtggcattattggtgctctatattgcgtaatcatgatgcattggggattaattccagccagatatctgcctaattacgtgatctatgccatggccggctactttgcctgcatcagcaaggcgccgtttactgctattcttttgattaccgaaatggtcggcacgatgacgcatcttatgccgctggcaatcgtttcaatcgtagcttggctggtcgttgatctgatgggcgggacaccggtatatgcggctatgtttgccaatatgatgcataaacagccgcaaaaagaactgctggggctgacacagatgactacgccaatttttgtcggctccaggctggatggctgtctgatcaaggattttgcttggccagtcggtgctctgatcacctgtatctatcgtggcgaaaatcagctgattccgcatggtgatacgcgactgaaagcgggcgatacgctggtcatccagttgcgcggcaaaaatcacattgccaaccaggcgcggatcaatctggcagcccgacaatcagcgcatgattagccaaatgactggaaatatggtattatttaacggatatagcgggtgaaataggaggaaatttttttgtataatacgattatgaccctcttcttgattgtctgcgtcattttgattgcttgcgtaatgatgcagccggccaagaatgacaacgatgccatgtccgctttgaccgggggagctggcgacctgttcagtcggcgcaaggctcgcggttttgaagcggttatgcagattgctacgaccatctttggtgccctgttttttatcctggcactggcgctggtctatgtttcttcacactagtttaagtgcctcctgccaatatcagggggctttttatttattttaaagaggtatatggatgacacaattacaacttgaaatactcaagcgtttactcgatcatcaagaactcagcttttcggctgaaaaaatcgcccagcagctgggaatgaacagagcagatcaatttacgccgatcgttcaggcactggcgcaattggaacgggataaaaaagtcatggtaaccgatcagggcgaatttaaagcggttatcaagcctaaaacgatcagcggggtctttcgtggcaatgcaaagggctttggctttgtagcttatgatccggaacagccagacgtttatgtcaatcctgatcacaccatgcatgcaatgagcggtgacgaggttgaagtcaagatcctgcgtgctcctgaacctggcagcgaccagggaccagaaggacaggtaacggaaatcctcacgcgtcattatgagcacgtggttggcgagtttaaaaacattacgatgggcagctttattggtgagatcatcttaaaagacaaaaagctcagtaatttccgcttttttgtcactgatgatggtctgcacccagaagacaacgagatcgtcaatgctacgatttcatcatatccaagcgatgattcgccgcagatcatgacagggatggtcaccgaggttattggcgacaaggatcagccggggattgatattctctccgttgtctatgcccatgacgttccgcatgttttcccacaagcggtcatggatgaggccaatgccattcctgatcacgtgctgccagaagaaaagaagggtcgtaaagacattaccgctcagccgttggttacgatcgacagtattgagtccaaagaccttgatgatgccgtcgtggcttggaagcttgataacggcaactatcatctgggagttcatattgctgacgttacgcactatgttaagccgggctcggcactggacaaagaggcctttaaacgaggaacttcagtctacttaacggatcgtgtgattccaatgctgccaaagcgactttcaaacggcatctgttccttgaatccgaatgaagaacggttggcaatgagctgtgagatggagattgatccccagggcaacattgtcaagcacgagatctttcctagtgtaatgcgttctcatgctcggatgacctataaagccgtcaacgcaattttagaagatcatgatccacaggttatcaaagaatacgaagaactggtgccaatgtttgagacgatgggcgagctgcaccagattcttttaaagcatcggcatgatcgcggcgccattgactttgatgcgccagaagccaagatcattgttgatgaggagggtcacccaaccgacattcagctgcgcgagcggggaacttctgaacgaatgattgaatcctttatgctggcagccaatgaaaccgtggcggaacactactataagctgcacgtaccgtttttataccgaattcatgaaacgccggatgccgatcgaatcaagagctttgctgagctgctcagcgtctttggcattgaaatgaagggtgacttgaaaaacgttaagcccaagatgctccaagacgtcttaaagagcgtggctggcaagccagaagaacagatggtccaggtgatgatgctgcgcagtatgcagcaggctaagtatgctgatgaagaagtcggtcactttggtttgggtgcccaatactatacgcactttacctcgccaattcgtcgttatcctgatgaaatggtgcaccgcttgattagctggtatgctgaaaacggcacgacagaaaaagctaaggctaaatatcgcgactggctgccagaagtagctgagcacacctcggttaccgaacggcggggtattgatacggaacgcgacgttgacagcatgaagaaggcagaatacatggaagatcatgttggcgagacctttgatgccgttgttagttccgtcatgaagtttggcttgttcgtagccttggaaaataccgttgaaggcctgatccatatcagtgtcatgaacgatgacttctacgagtatctggaatccaacatggcattggttggccgccgccatcatcatatcttccaaatcggtcagccagtcaaggttaaactgattcgagtagacaaggatcagcgcgaggttgactttgaactggttaaccctgaggaagccccaacaaccaagctgcgggtgccgcgtaaaaacgatgggcgctttaatggtcgaggacgcggcagtcgtgacgacaagcacagcagattcggccatggcgagcgagacaaaaaagatggtaagcgttcctaccgcagcaatggcaacggtaatggtcggcgcagcaatcatctgtttgatcgtgggccttcacgccggcatgatggcggtaaacgttcccagcgcggccgcaataatggtgatcgccgctcgcgttaagctatgacgggagggaaaaagatggcaaaaaaatcccatcacgaaaaagatgataatctaattgcgcagaacaaaaaagcgcgtcacgactattcagttttagagacttatgaagctgggattgctttgactggaactgagatcaaatccgtccgagctcggcgcgtcaatcttaaagatggctttgctcagcttcataacggtgaattatggctgatgaacgtgcatatcagtcaatatgacaacggcaccttttttaatcatgatcccctgcgcaatcgcaagctgctgctgcataaaaaagagattaaaaaaattgccggtgagctgtcgaccaaggggattacgctgattccgctgaaaatgtatatcaagcatggctatgccaaagtactgctgggcctggccaaggggaagcatgaatacgacaagcgcgagtcgatcaagaagcgtgagcaggagcgccagatcgaacgtgttttgaaacattactaaaaatcagatttcgtgcaaaataaaacgggcgtgcattctaaaaaatgcaccccgtttttattctggctgatgaacgtgtctgctgaggctttgatcattaagcactgttttaggtacgaatcccatgcttagatcgccctggtcagttgatgacatcggattcagctgacgcaatcgttcccgtagcggctggcgatcatgatgtctggcccagcggttgatgatggtggccgttaagattgccaatggctcatcggcttgattggtgacgcttaaacagctgcaaaagccaccagtattcggtaccggctcaactgcaaagatcaagcggctgccgcaaaagaccttgaagcgtccacttaccaatgagccgacgacaatccagttgagaccgtggatatagatcagttcatgaaaaagtcccagtgatttgccgatcgtgccaacttgacgccgatttaaataaagagcgaattttggcgtaagaccgagcgttaattgcttggcttcagctaacaattcaccgctcatcgtatataatgaaagtgcatcatagcgaatcccccatttaccggctaacaggtagcatgaatggccgcttgcgtcgtgaatgacggtagcgctgttcaagtcggtcgaacggtcgcggatgtacaattgccgcatgacagaaatcaccacttttcctaaatatctaactaccattttaacagctgtcggcaataaaaacagtcaattaacgcgatcaaaataggtatcgtatttataataatcatgttaaaatattcacgaggtgctgactttgaaacaacttatccataacgattggtggggcgtgcttgaaccccagtttgaatctgcctattatgctcagctgcacgcttttttagctgatgagtatgcccatcagacgatctatccagagatgcatcatatttttgaagcctttgaatggactcccttttcaaaggtaaaagtggtaatcttaggacaggatccttatcatggaccgcaccaggcacacggctgcagtttttcagttttgccaggcgtcaagattccgccttctttgcaaaacatctataaagagctgcaagacgatcttggctatccgcccgttgagcatggctatttaaagaagtgggccgatcaaggcgtgctgttgttaaattccgtgctcaccgtccgggctggtcaggcgttctcgcaccgcggtcatggttgggagcagcttacggatgcagcgattcatgcgttgtctgaacggccgcgaccagtggtgtttactctttggggcaaggcagcccaatcaaaaattcctttgatcaacacgcagaccaacattgttctgcaatcaccgcaccccagtcctttttctgccaaccgtggcttctttggctcaaagcctttttctaaaaccaatgaggctctggtggcaatgggtgagacaccgattgactggcgtctgcccgaacatgttgatattgacgcacaatggaaatgaggttatgaataatggatgtatttgaacacttaaagtcacagctttcatcacaagacaagcggatcgtttttccagagggtgaggatgaacggatctttggcgcagcagctcggttagcgcatgatggtctgctgacgccgattctgctgggaaatgaagccaagatcaaagcagctgccaagcaggatggtattgatctgacaggggttgaaatcatggacccgcagacctatccggcagccgactatcaagcaatgcatgccgcacttttagaacggcgtcacggtaagaatacaccagaacaggtcgatgcgatgttaaaagacgtcagctattttgctacgatgctggtttacatgggcaaggttgacgggatggtttctggcgcgattcactcaaccggcgacacggtccggccagcgttgcagatcgttaagactaagcctggcatcaagcggatcagtggggcattcttgatgcaaaaaggcgatcagcgctatatctttgctgactgtgcgatcaacattgaactggatgcgccaacgatggctgaggttgccgttgaaagcgccaagacggccaaactgtttggtattgatccccgcgttgccatgctgagcttttcaaccaagggatcagcaaaaggcgaaatggttaccaaggttgccgaagcgactaaactggcccaggaagctgatccagaactggctgtcgatggcgagctgcagtttgacgcggcaatcgttccagccgttgcagaattgaaggctcctggatccaaggtcgcaggtcatgccaatgtctttgtcttcccaagtctggaagccggcaacattggctacaagattgctcagcgcttaggtggatttgaagctatcggtccggttctgcagggattgaacgcaccaattgccgatctgtcgcggggatgcaatgaagaagacgtttataaggttgcgctgattacggcggctcaggcactgtaaactcaaaggtcgtttggcaaaagtcaagcgacctttttgatttacgggcaggatacgataaaataggaactatcgaagaccatgatcgttgatttgatcaaaatggtcaattccagcaaaggataatgataatgactcaactaactttacacaatcgagaagcaacgatggcggtaggaaagaaaatggccccgtttttgcaggctggcgacgtaatcgtattaaatggcgatctgggagctggcaagaccacttttaccaaaggactggcagctggtctgggtatttcagacgtgatcaagagcccaacttttacgattattcgtgaatatcaatcaggacgcctgccgctttaccatatggatatctatcgacttgagaatggcggggccgaagacttaggactggaagaatattttgatggcgatggcatcagtgtggttgaatgggcagaatttattgaagatgaattgccgaccgaatttttggcaatcaattttaagcggactgatgatgaacagacccgtgagctgagttttgaaccgcatggacggcactttgaatcattggtaaaacgattggtggcagatcatgactgaaacggttggaatcaagctggccacgccagatgatgcacaggtaatcctgaatctgctcaaacagctttctcaagagagctcggccatcttggtgccgcatctggatacgctgacggtcgaacaagaagcgtacagtctctatgatattaacgacagtactgattcattgatcttactggctcagtatcgaaatcatcccattggtatcgttacgatcatggaactggctgatcggccacaggtaggcgagttgggcgtggctgtcttaaaggacttttggcgaaacgggattggcagtcttttagttgatgaggctacgtactggtttgcaaactacagtaccctgcaaaagctggtattggacgtttttgatgataacgtgccggccatcaagctttatcaaaaatatggctttgtcaagaccggtgaggctaaggtgactgatcaacaaggccagcagcgcgcagcagttctaatggagtttcagcccgctgcagctgatcatgactaatcaagcaacgcggaatggcagcctgctgtttcgcgctttttgtttacttattatttacttagatttactaaataaggtataataaaagcacgcaactaagcagaagaggtgagcaaatggttaccatcaaagagattgcccagcgctctggctattcgccagccacggtttcgcgcctgctcaataacgatcagacgctttcggttacccaaacgacgcgcaacaagattttaaaagttgccaaccagctggggtattggaaagaccgcaagaaaccagcagttgcacccacgatcgcgctgctgtttcggatgaacaaccaagaacagctgcaggactcgtattttgccagtcttaaggatgccctgctgaaaacgattgaagatgccggcatgcaagtcaaggtctttcaatatgccgaggagctgattgatcaggcagaggaatttcaaggctttttatgcgttggtgacgataacgttgagctgaacgtttttaagcggctgcatcggctgttgccagcgggggtgtttgttgacactgatccattgccgcatctgtttgattcagtgcagcccaatctgtcgatgacggtgcgagatgccctggaacagtttgctgatgctggctaccagcggattgcctttattggcggtatcggtccgcagattgggaagcggccaagacaaagagactcacgggaaatggcctttagagtcgtggctgaggaactggaattcaagcaggcggatatcttttccaacggctcgttcagcgttttaaacggtcgtcagctgggagaagcagccatcaagcaatacggcgatcagctgccggaaggctttttgattgcctcggataccttaagcgttggggtactccaggcgtttaacgatgctggggtgatcgtaccgcgcgataccagcatcatcagtattaacaacagcgatattgccgaatacgtatcgccgccgctttcaacgtataacatcaatcaaaaggtgatttcccgcatggcgctgaatattctgcgggatgcaatcgctaatccggagcggccgcacgttcatgcattggttgataccaatttaattatgcgtgaaagttttaaactgaaataaaatgaaagatatatctgtgataatggctggattgaataaatcatttactaaatatggtaaatgatttattttttatgataaattatttactttactcgttaaatgcgtacaatattatctgtaagcgatttcagataaatgcatttagaacgaaacgatcgattatgagatggatttgagtgagagtaaattaagggaggcattatcgtggatactaccaccaaaactgcagcgccacggcagcatttaagcaagcagcagtggatttctcgttccgcattctgttttggaaatgttggccactccgctttttatggcgttatgagcaattatttcattatttttgttaccagcggcatgtttgctggattaagcaaatcagttgccaaccgtttaatcggactgattaccggcttgattgtcggggtacgcattattgagctggttatcgatccgctgctgggcaatatcgttgacaatacgcacacgcgttggggcaagtttaagccttggatcttatggggcaatatcgtcagcggtgccctgcttttagtcctgtttactggaatttttggcttggcaaaggtcaactgggtcctgtttgcgattttgtttgtcgtgatcttcattacgtttgatattttctattctttttctgatgtttcctattggggcatggtaccagctttgagcgaggactcgcatgaacgcagcatctatacttcactaggggcctttgccggtacgattggctggaacggtttgacgattatcgtggttccaatcgttacaacgtttacctatctggcaaccggccatcgtactgagggtccagccggctggtttgcttttgcggcaatcgttacgctgttggcgttgctgagtgccttggcggtttgtttgggaactaaggaaaacgacaacatcattcggcagtcagccaagcaaaagacatcgatcaaggacgtcttttcagcaattttccataacgaccagatcatgtggccagcactggcatacttgatgtattcttgtgcctatgttgttaccaatggggttttgttctacctgtacaagtttgttatcggcgagcccggtcatttctgggtcgttggggtaattgcgacgatcgttggtttctttgtcagcccactgttcccgattttcaacaaatacgtaccacggaaatggctgtttacgattggtcaatgctgtatggtagcggcctacttggtttttatctttggccgcagcaacatctatgtaatggatctggggttggttttgttcaacgtcaactgtgctcagctggtaacggttttgacgctgacggatgcgattgaatatggtcagcttaagtctggtcagcgaaacgaagccgttgttttagcagtgcggccgatgatcgataagctgacgggtgcaatctcaaatggtttggttggatggattgccttagcctgtggcatgaccggcagtgctacggcagctgacatgactgccaagagcattcgtacgtttgatggcatggccttttacattccaacggttttggcgctgctgtcaatcgtcattttcttaagcaaggttacgctgagcgaaaagaagcatgctcaagtcgttgaagaattaaagaatgaattggctgccggcaatggtgcggaagcggttgaggatgtctctgccgctcaaacgacattaacgcttttggctccagtcgatggaaaagtcgttgatcttgcttccgtaaccaatgaagacggcacaaaaggattccctggcaagggctttgcgattgagccagctgatggtcgcatctatgcaccatttgacggcacgatcaagtttgccttctcaacgcagcatgcctttgagattgaatcagctgccgggattggcctggtagttcatgttggtatcggcacggtcaatatgcgtggcgccggctttaatattcatttccaagaaggacagaccgtgcatgccggtgagctgttgatggaattcaaccgtgatctgattttacaaagcggttatgatgatatcgttgtagactttttaacacagccgcaaaaagttcagttgcaagagcttcggcttggggacaaggttgagcatggtcagccaattgccaaagcagaatataaaaaataaaggcttggagggagaaatatgaagcagggactgccgaccgttctatatggcggtgactataattcagatcaatggccagaaacagattgggatgacgatatcaaggcctttaagcaggccgatatcaattcggcaacgatcaacgtcttttcatgggcccttttagaaccgcgtgaaggcgaatatgattttgaaaaactggatcatatcgttgcaaagctgagtcgggctgattttaagattgttatggcaacttccacggccgcgatgcctgcctggatgtttaaaaaatatccggatgtcgccagagttgattaccaagggcggcggcacgtctttggtcaacgacataatttctgcccgagttcacccaactatcgccgattagcaggtcgattggttgatcaattggcccggcgctatgctggcaattcgcatatcgttgcttggcacgttaataatgagtatggtggcaactgttattgtgaaaactgtcgccgggcttttcaagaatggctcaagcagcgctatcaaacgctggataatctaaatcaggcttgggacaacaatgtctggagccatacgatctatgactgggatgagattcaagttcccaacgagctgggcgatgcctggggagcagaaggcacgcatacgatcgtggctgggctatcggttgactatctgcgttttcagtcggatgcaatgctttcgctatacaatcttgaaaaacagacgattgaaaaatatgacaagcagacaccgattctgaccaatttccatggcacgcctaataagtggattgactatcatgcctgggccaaggatcaagatatcattgcctatgacagctacccagcctatgacgatccagcctatgtagccgcgtttcgctatgacttaatgcggggattgaaacaccagccgttcatgctgatggaatcaacgccttcgcaggtcaactggcagccatacagtccgttgaagcgccctaatcaaatgcgggccacggaactgcaggcggtggctcatggcgcggacactgttcagtattttcagttgaagcaggccgtagggggatccgaaaaatttcatggtgccgtaatcagtcattcgcagcggaccgatacgcgcgcatttcaagaagtagcacgcctgggacacgatttgaaaaaaactggcgcagattttaaagatgccgcgactccagctaaggcagccattgtttttgactggagcaacttctgggcctttgagtacgtggccgggattacgcaggatctgcagtacgtgccactgatcttggactactaccgccagttttatcagcaccagatcccagttgacgtgattggcgttgacgatgacttttcacaatatgatctgatcgtcgcgccagtattgtacatggtcaaaaagggactgggcgaaaagatcagtgattacgtgcaaaatggcgggcatctgctgaccacctatgcatcggggatggttgatgaatccgacaatgtctacctgggcggctatccaggtcctttaagcagggtattgggcatctggtttgaagaaactgatgcgacggtaccaggacaaaccgtcaaagtagcttttgatcagtcagcgcagcaatatgaagggcggctgctgtgtgatcagattcatctgacgggatcaaaaactcgggcattggctcattatgccagtgaattttatgccggcacgccagccgtagttgaaaatatatttggcaaggggctggcgtggtacgttggcacgcgtttagatgatcagggacttggcaaagtaattgagcgcgtcattgatcagactgggcttgccggcctaaccagccaaacaaccgatctggaaatcacgcggcgtgttaaggatgggcaggaactctactttgtgcttaatctgcgcaatgagtcgcgcctgctgccaactgatctgcagcaggccggcttcgtggatatcttgaccggagccgctccgaaagccaaactggaaccgtgggacgttgagattttaaaacgcggcatggatcaataggctttctaagacattaaaactctcttgatcggcagtcagccgttccaaaaaagcaccgtcaaaactgacggtgcttttttgctgaatcgataattagacattaacgataaacggcttgatcatttccgggccgaactggcgattttgcgtcagcaggatattggcgcaggcttgagcatcatcaagcgcgttatgatgatgatgcagctgaatattcaatgcatcgcagatcgtattgagcttgtgattaggcagctgcggccagaactggcgactggtctttaacgtgtccaatgataagaaattgggaaccggcaattcataatgagtcagcgtatttttgaggacgctgttgtcaaaggaggcgttatgggcaatcaccagcttgttggcatcaaagaatggctgaatatgctcccagacttcaagaaagactggggcattggcaacgtctttttcatgaatgccatggatctgaacgttgcgccagaaaaaaggcgtctgtggattgatcaaggtgtagaactcatcaacgatttgattttgccgaacgacgaccaaagaaagcgagcaggccgaccagcgtttgccactggcagtttcaaagtccatcgcaacaaagttcatgttaatttcctcctataactgaatgtctaattcgacgggacagtgatcactgccaagaatctgatcatgaatcttggcatcaaccagctgtgagtcaagatcggctgaggcaacgaaataatcaatccgccagccagcattgcgctgccgagcgtggaaacgatagctccaccaagaatagctgtgctcttggtcaggataaaaataacggaacgtatcagtaaacccgctttttagcagcttagagaagtcaaagcgttcttcatcggtaaatcccggatgatgatgattgctctgcggatttttcaagtcgatttcttggtgggccacgttgagatcaccacaccaaacgatgcttttttgctgactaagctgattaacgtattcataaaaagcctcattaaagccatgtcgaaaatccaagcgcttcagttcagcaccagagttgggcacataggtatcgatcagatagaaatcaggatactctaaagtgatgacacggccttcatgatcaaactccggtacattgatgccatattgaacgctaagcggtggctgtttggcaaagatggccgtacccgaatagcctttcttttcggcatagttccagtattgatgatagccgggcaaatcaagatccaattggccgggcgctagtttggtttcttggatgcagaaaaaatccgcgtccatttcattgaaaacctgtaaaaagccatgcttgattgcggcccttaatccattgacgttccaagaaataaatttggtcattgcagtcaacctcgcaaataaattatctggtactattgtagaggttcggatcgtcaatttccaaaagaatgctacaataagaaaagattgacgaatttttgttgagaaagcgagagaacgaatttatggcaaataatctgatgcaagaatttcctgatattcaaatcttaaaggacgagccactttcaaagtataccaatactaaaactggtggcccagcagactggttggcattccctaaagacgttacggaagttcaaaagctggttcagtttgctgatgccaatgccatgccactgacggtaatcggcaacgccagcaatctgatcgtgcgtgatggcggtattgaaggtctgaccatgatcctgactcagatgaatgggattcaagttgaaggcaaccgcgtcattgctcaggctggggcctcatacattgaaacaaccaaggcagctcgcgatcattcgcttactggccttgagtttgctgctggcattcccggcagcgttggcggcgcaatttttatgaatgccggtgcctatggcggtgaaactaaaaacgttgccagtgaagtcactgcaatgctgccagatggaacgatcaagcattatgacaatgaagagcttgattttggctatcggcacagcgcggttcaggataatcacggcatcgttctggaagccgtgtttgatctgaagccaggtgatcaagctgagattaccgcattgatggatgatcttaacgcccggcgagccgctaagcagccgttggaactgccatcttgcggttcagtctttaagcgtccagaaggctactttgccggcaagctgatccatgatgctggtctgcagggatatacctcaggcggcgcgcaggtctcaaccaaacatgccggctttatcgttaatgttgatcatggtacggcaacggattatctaaacgtaattcatcatgttcaagcaaccgttaaagaaaaattcggtgtcagcttggaaactgaggtccgtattattggccgggaaactgaataaaagtttcatgaatttaactgggattgtcactgacgatcctggtttttattttggtataaaaaattcccgtcccagttagcgacgagaatcctcaattacatcaaatcggtttgtttgatcaagtgcagacaccagtaaagcagcagctgcaatatggtcatgatcaagacgaatttaagcattggccagctccagatgcttaaaagctgattaaaaaaccatgatggcgttataaaaaggtagattgagtgcaagcgtaaaaaacggccaatatagatgccaataccggatagaaaagagaagcagccaacccagattaaatgactatgggaaaatttaggcgtcagcatcttttctaacagtcgactgaggcgggccatctcaaccgtgccaaaaattgcacaactgaatgccgacagaaccatcagcgcaaaaataagccacatcttaggatcagcacgcaggatgccagtagtactggtatggggatgcagccatgaaagatggaagagatcagtcatgacgtagggagcattgggataaaaaatcagccataaaaacagcagcgaccaaaaagccagtgaacgtcgatcggcaaaatgctggacccaaaaaccaaattcgattggcagataggctagaaaaacgttcaaggccataaaattaaatggcgacttcaaaagcagctgcagcgttgccagcagaatcaaaaaataaagtcttaatttccattgataagacagtttaggcaaaaaaccacctctttaaaaaacttatgcctagcataacagacaatcggcttgactggttaaataacgaacatttttaatgatataatcatatttaagaattttattttaaggcagaagggagagatatatattgcagtttcttgcatcactcctcaactggcataatctggtcaatctaattgacattttagtcatctggtttttgatctatgagttgttgatgctggttcgcgggactaaggccgtgcagctgttcaaagggattctgattatcatcctggttaagctgatcagttggtatatcggactcagcacggtttcttgggtgatggatcaggtcatcaactggggggtcatcgccattgtcgtgatcttccagccagagattcggcggggactggagcatttaggccgtggcgcgctgtttgcccgtacgcctaaagccaacgaagcggaagaggacttgattcggcaattggaccaggcgattcaatatctttctaaacgacggattggggccttgatctgtattgagatggaaaccggcctggaagaatatattgaaacggggataccattagatgccgaagttactggtgcccttttgatcaatacgtttattccaaatacgccgctgcatgatggagccgtgatcatcaaaaataatcgcatcgctgtcgctgctgcttatctgccgctttctgactcgaagctgattcctaaagatcttggcacgcggcaccgcgcggcagtcgggatcagcgaggttaccgatgcgctgacgattgtagtctcagaagaaacgggtgaagtctcgatcaccaaaaataacgagctgatgcgcggcatgtcacgcaaagactatctgaagtttttgcgggtgcagctttatactgaaactcctcagcatccaagtcccgagaattttcttaccaatttaatgcggcgttttcgtaagcggggaggcgatcagcatgaaaaatgacaagatgggcctgttcgaccatgtctgggtattgcgaatcgtttccttggtattggcaatcctattgtttatatacgttactggcagcaaaagcagcgatacgcgtcagtcatcacaaaacggtcaaaatactgcgctgatggccaataagacgcagacgctcaaaataccgctagaggttgagtcgaattcggaaaaatacgttgtcaccggctttccgcaatacgtcaaaatcaagattaccggaccctctgccttggtaacgaccacggctaatacgcaaaattttaaggtctatgcggatctgaccaagctgggaaccggcaagcatgaggtgcgtctgaaggcatcgggcttgaataaggaattgagttatacgatcacgccggccaagatcaaggtcaacattcaatcacgcaataccgcgacggtgccggtagaagtgcgcttaagctctaaaaccttaaatggcagctatcaggttggaacacccaaagccgcattggaaaaggtccagattaccggggccaaaagtgaggtgcagcaggttgccaaagtaattgcttatgtcaacgtgcctaaaaacgcgcaaagtacactgcatcggacggtaactctgcaggcaatcaacgaaagcggtcagacgatgaacgtggtgatcatgccaaatacggtctccgtaaccgtaccaatcagtcagactgacagcggcgacaagaattccagttcatctgcggcgaccagctcggcgataacgcagtccaattctgacagttcagcggagtctgcgagcgcttcttcagccaagcacagttcaaccagctcggcatctggcagtcagtcaaataattcgtcggtttcggcaagcgaaaatgatacaaagtagtataatcaaacatagtgaattttaacggagctttttagcccagaaacgaggagaaacatgaagttaaaatattttggaactgatggcgttcgtggcgtggccaatcgcgacctgagtccagaactggcttttaaggttggccgtgccgggggctatgtcttgactcggcactcagaacgcaagcagccccaagtcttggtttcccgtgatacgcgaatttccggtcaaatgctggaaaatgccttagttgctggtctgctttcggtcggcatcgaggtactgcgcttaggcgtcgtcactacgcctggcgttgcctacctggttagagcacagggagccgatgctggtgtaatgatcacggccagtcataatccaatccaatataatggaatcaagtattttggcagcgatggcttcaagctttccgatgagctggaatatgagatcgaacagctgctggatgccgaaacggatactttgccacggccatctgatgctggtttgggaacggttgaggactaccacgaaggcgcgctcaaatacacgtcatttttggaacagacgatttcaacggatctgtctggcctaaaggtagttgttgatgctgccaatggtgctaccagcggctttgtctccaatctgttggcagacttaaatgttgattttacgccaattcatgccaatcctaatggtctcaacaccaacctcaactgtgggtcaacgcatccagaaagtctgcaggaagccgtagttgccaaccatgccgatctaggtctggcatttgatggtgatggcgatcgctgcattgccgttgacaacgagggtaatctggttgacggcgacaaaatcatgtacatctgcggcaagtacctgaatgaaaatggccgcttgaaaaaagatacgatcgttaccacggtgatgagcaacctgggaatgtacaaggcaatggaggctcatggcatgaagagcgtgcagaccaaggttggcgatcgttatgtcgttgaagaaatgctgaagtcaggctacaatctgggtggcgagcagtcaggccacattatcttccttgaccacaatacgactggtgatgggatgctgacggcactgcagctgctgcaggtcgttaaatccagtggcaagagccttaaggaactggcatctgatgtcaagacctatccacaagagctggttaatatcaccgtggctgacaagcaagctgcaatggacaatccagctttgaaggctgtcattgccgatgttgaaaaagaaatgaacggtgatgggcgcgtcttggttcgtccttctggtactgaaccgcttttgcgaatcatggctgaagcgccaaccaaagaactggtccatgcctatgttgaaaaaattgcggaagttgcccgccgcgagcttgaagttaaataatcttagataatatttaggctggtagcgaggggctgaatcgttgccgtgacgcctttaaaactattaaaaaattgccgactctataccaatcgaggttaatcgattgacattggggccggcaattattaatatacaatagtgttattaaataatagcttgattttaaagttatctataccaattttattgaaggatgggaaatattatgtgtggaattgttggtgttacaggaaacgatcgcagcgtttccattttgatcgacgggttgaagcgtctggaatatcgcggttacgactccgccggcatctacgtcaacgacgaaaaaggacatgactacctggttaagcgttccggccgcatcagcaatctggaagctgccttaacgccagaagttaaagggttggctgggattggtcacactcgttgggcaacgcacggtgtaccaagtgaaaccaacgcgcacccgcactactccaatgatgaacgattctatctggttcacaatggggtaattgaaaactatcagcaactgaaagaagaatatcttaagggtgtagaatttaagagccaaaccgacacggaagttatcgttcagttggttgacaagtttgtcgttgactacaagatggatgccaaggacgcgctgcttaaggttctgcgcttgatcagtcctgattcttcatatgcctttgccttgatggatcgcgagcagccagatacgctgtttgtggctaagaataagagcccattgctggttggtttgtgccaaggctataacatggtaggttctgatgccatgtcgatgattgatgaaaccaatgaatttatggaaatcaacgaccatgaattggtgatcgtcaagccagacaatgtaacgattgaagaattcgatggtacggaaaagaagcgggattcctttaaggttgacatggatccaagcgctgccgacaagggtacctacccattctatatgctaaaggaaattgatgagcagcctgccgtaatgcgcaagctcgttcaagaatactttgacagtgacgaccagccgcatatcagcgaaaagcttttgcaggcaatggctgaatccgatcatatctacatcattggtgccgggaccagctatcatgccggtctgattggggcccggatgttcgagaagctctgtggcgtgccaactacggttcatatctcatcggaatttgcctatgagcagccgttgcttagtcaaaacccgttcttcctgttcctgtcgcaaagtggtgaaacggctgacagtcgcgaagtactggtacacgtcaatgagcacaactggccaagcctgacgattactaatgttgataagtcaacgctttctcgtgaggctacctttaccctgctgctgtacgctggcccagagattgccgttgcctccactaaggcctacacggctcagatcgcagttgaagctattttggccaaggcattgggtgaatatctgagtcgcgatgctgctcaaaacttcgacttaaagcaccagctgggaacgattgccaacgggatgcagtcaattaccgactcaaaagaagacattgaagcactggcctctcgctacctctctaagccacgcaacgccttttacattggccggggcattgactggtcggtttctttggaggcagccttgaagcttaaggaaatctcctatgttcaagcggaaggctttgcatccggtgagcttaagcatggtacgatcgcgctgattgaaaaccaaacgccggtaattgctattattacccaggatcggacagcgggccttacgcgcagcaatctggaagaaacgcagtcacggggtgctgctgtcttaacgattgtttcacgtcatctggcacatgaagacgacaatatcatcattccggacgttgacgaactgctgaccccacttttgagtgtcgttcctgcacagctgcttgcctactacacgagtctgggcaagggcttggacgttgacaagccgcgtaacctggctaagtcggttacggtacagtaattataaaaagaagaagcggttggccgtttcttctttttattttatgttaacagctgaaaaaatctgaataactattgacagcgcttacaatattttgtaatatatagtcacaaggtattaagtatttaccttctaatcaattctctttctctcttatgccaatcatcgtcggtccacggcgatgatttttgttttctgatacaatagatgtgaaaggggatttatttaatggaagaacagcatgaagtctttaccttaatagaggaaattacgcgtaatgatggcaccaaatattatgaaatcggcaatatggtgcataacggccgtgccgagctggctgctgagcgtggctatattaaggaagttcgtattttaaagctgaatatcccgcattcacaaaacgtgatcaattatgagcatttcatcaacacgcactatcagatgcaagatgagtcgatggatcactgggaggaatggaaacgaaccccagaagccgatcagctggtcaaggcgattctgcgtgaaaaccgagtcggctgattgagtaattctgatatttctaataacggtcggggcagaaaaaggctgtcgcgaccgttgttttataaaagaatcattttaatgggacttgttggtcaactgtgattataataaaagttgttattttttaatttggggggaaatctatgcggtccaagcaatacgtgacaggaattgatggcgtccgaacgttggccgtgcttggcgtgatcatctatcacctgttgccgacaacgttgccaggcggctatttgggcgtgccgctgttcttattgatctctgggtatttcgttaccttacagctggtgcggcaaatggatcagacgggcggcattcagctgacgaagttttaccttaagcgtctgcggcggctgtatccggtgctgatcgttatgctgacggtcacgacggcctatattacattgtttgctcgcgatctgctgcataatatcaaaagcaccatcgctactaatctgctatgggtctacaactggtgggaaatcggccatggccagtcttattttgatcgtttcaatggcgagtcgccgtttacgcatttgtggacgttaggcgttgaagcccagttttacttcttgtggccactgattttattcatgctgtttttgattttgcgcaaacgttccaaaatcaagtggaccgtctttatcctggcggttgcttcagcagttgaaatggcgctgctgtttgatccacaaaatatcaaccgagtctactatggaaccgatacccgagccttttcgctgcttttgggttcctggctggccttatgctggccgattgatcaccttaacgccaacttgacggcacatgctgccagaatcttggatggagtcgggattggagcactgttgatcacgctgctgggcttttttacgctgccgggccaaagcagctggacctatcgcggcggcatgtttttttacagcctgattggaatgattttgattgcgacgatagttcatccaggcagtcatatgaatcgctggctgaccaaccctttctttacctggatcggtcagcgctcatacggcatttacgtctaccagctgccggttatggtcttttatgaacgagtcattgagattggccggcacccagtaatcaatgccttggttgaatgcctgctgattttagcgatcagcgagttctcctatcgattggttgaacagccgcttgctcattatcagtggcggtatctgccggccagcattcgtcattggatcgactttaaaatgcatgattggcaccaatggctgaaagttggcccagtcgtcatcatctgctttatcgcgctgtgcggtctgatgatgccaagcaagccggctaaaaaaagtgcggttcagacccgtattgaaaagagtcgccaggccacggctgctaaaaacaagcagattgcaaagggaaagacggctaaagttaacgtcaacagcaagtcgctgcagaaaaaatatggtctgacctcgaaccagcttaaagcagcctcagagctgaaagtcacggcaatcggtgattcggtaatggccgatgcatctcaggatattcaagagatcatgccgcatgcttatgttgatgctgaagtcgggcgtcaggggagcgctacgccagccgttattaaagatcttaaagccaaggggcagctgcaaaaaaacgtgattttaaatcttggaaccaacggcgcgatggattcgcagacgattaatgatatcttaacggcaatcggcaaggatcatcaggtttattggatcacgccgcacgtgccgacgcgtgactgggaacagacggtttgcgatcagatcaagcaggccgctaagcaaaatgccaacgtacacgtgattgactggaatcaggctgccaatggtcatgccgagtggtttgcacaggacaaggttcatatgaatgagcaggggaatgcgtactttacgcagctgattgttaaaacgatcttgaaaaacaaatagaaaagagaaacgcttatgattaaaatgattgcattagatatggataacacgctgctcaacagccaaaaagagatcagtccccgaaacgaggcggtcttgaaacggctgcatgaacaatgcatcaaaatcgtgctctgtacgggtcgcccaatcaacgcaatctggccttatattgaacaattaggtctgactacggctgacgactacacgattacttttaatggcgggctggtcgtcaataatcaaacgcgggctgctttgtcagaacatgggatctcaaaagacaagctgcaggcagtctttgattttgccaagcagcacgatttttcgctagatgttctggactttgatcgcgtctatgaaatcatggacatgccgcgttccatctataaaacgattttaaaaaacattgaatttaaagacgcacacttcaatgatctgccaggtggcgaccatgtctatgccaaggcgattatggcgattccagctgttaagatgagtcaagaggttctgccagccgttcctgatgaattacggcagcgggtcaatgttgttcagtcgcagccaatggtattggaatttttaccaaacggggtcaacaagagcgtgggtctgcgggcactgctggagcattatggctgggattttgccaacctgatgacgtttggcgatgccgataatgattatgagatgattcgcgatgctggcgatggcgtagtaatggcaaatggtttggataacgtcaaaaaagctgccgatcatctgaccaaatctaataatgaggatggcgttgccgtttacctggagaatttttttgcaacattaatgtaatataaggcgtaattcagtcttaaaatctggtcgtaaaaagccgctgaaatcataaaaatggtttttgtgtgactttttacgattttttttgcaacatttcaaacgtcaatataaaaaagttagtcaaaccgaaaaatattgatataacaacatttataatcaaaaggccgtttgggtgattatgattttattacagaatattacaaaatagccataaaaaactcttaaaacgcaattgccttgttatcaattagtaatattgagcgtgtatgataagggacgttgataaggaaatgataaaacgaattgataattgataaaggatggttttgatttttatgaagaagaactttaagaagattaccgctgctttgggtgccgttgcctttggcgttgctgctacggctacggttgccaacgctgacacgctgtacacggttcaatccggcgacacgctgtccagcatttctcaaaagttcgctaatgacaacagcttggttcaaacgctggctcagcaaaacaacattcaagacatcaacaagatctacgttggtcaacaattggttgttaagactgatggccaggcaactgatgctcaaacgactgctcagccagccgctcaagcaaccacgcaatcagctgctgctcaaacttcacaaaccacttccaactacacttccacggcttacggctctgaagcagatgccaaggcttggatcgccactcatgaatccggtaacaactatggcgcccgcaatggtcaatacatcgggaagtaccaattgagcgcggcctacctgaacggcgactactcacctgccaatcaagaacgcgtagctgatcagtatgttgctggtcgttacggttcttggacgaatgctaagcagcactggctgagcaatggctggtactaaaatcagactttaataattcgaagcatcgttttaccgaaacggtgctttttattttaaaatagtttataaatttttttaaaaaaagttattgattgttaaatttttcggtgaaatcagattatcactgtttttttctgctaaattgaattagtcaggctaaacgtggcaattatttatgtgactgccaaatcaatgacgggaaggatcgcgtgattgattgagaatcgccaaaagttgattttgcagggttcttaattattgatgcgaacggaagaatggaagaaaaaacacaaccagccaaaacacccaaaaagaagaaatggcgttggcttaaatggctgttggcgctgatcgtaatcgctttggcagcaggtggcggctatgagtactatcaagttcatcaggcggcctcaaaagtattcagcaacagcgaaaaagtcgataagaaactgcggcagggcaagccgatcacgattctaacgctggggctcgattctggtgctttagggcgcaagaattggggagccggcaacacagactcgattgaagttattaccgtcaatcctaaaaagaaaacagttcggatgactgctatttcccgtgacattccaatcaaggtcaaagtcaagggcggctacacctacgttaagctgaacgcggcctactcgctgggcggcattaaggaaacgaagaagcaggttgagaatctgcttggcattaagatcgactactacgcttccgtcaatatgggggttttggaaaaggtcgtcgatgcggttggcggggtaacggtcaacaattcgtttgcctttacctatgaaggacatcattttaaaaaaggcaagcagcatttaaatggcagtcaggcgcttaaatattcgcggatgcgctatgatgatccaagaggcgactatggccgtcaatatcggcaacagcagattttagaggccgttatcaacaagtttaagaaaaatggctcgatcacggttgccaataagcttttgcaggcggctggcgatggcgtgcggactgatttgccggttaaagccgttacgacgctttataccaaatacagtccggcactgagcaacgtcaagatcgatcatctgcagggaatcggtgccacgattgatggcgtatccttccaagcagtcacgccaactgagatcaaccgggtctccaaggcaattcacaaatcgatcggcgaaaagccaaaacatgttaccaatacggaaaccaggctttacaactatgccgtccaaaatggctatgatggaatcaacaatcttgagttcacgctgccaaacggtgccgaatataatacggttgtgagcaattaaaaaagagctgagaaattcctcagctcttttttggcatttagaagaataatttgctcataacagccacgaaggtcaataataccaccgagcctaaaatggcagccagcagtgcgttgcggccgcgcgtcagcaagaccttaaagttaacgctcatgccaagtgcagccattgccatccctaaaaccaggtaggccagcttaaccagaccagcaataactgcggcgcctaatggcataaaggttccgatcacgctggccagaataaagccgaccataaaccaaggaattgggacgcgtttttgatcattcgttaaaacgattgagccatctttaatcccttgtttttggtaccaccagccaataatcatcgcagccggtgccagcatcaggactcgtgaaagcttggtaatgatcgcagtgtccagactgaccggaccaccagcactgccggcagctacggcatgggcgatttcatgcagcgagccgcccgtcataacgccaaactgaacggcagacatgtgtaaaagcggcttgatgccaatttccaaaagcgtgaataaagttcccagaatcgcaacgatagcaacggcaacgaccttgttttcacgctgacgctcagcttcggtttcgttagcggcattgtcaaattgtgatgagattcccattacggctgccgcaccgcagatccccgttccgctggcgacaagaattgccaggtgacgatcaacaccgaagcgccgcgccaaggaataaaccagcagaatcgtccccgaaacaattacgactgccagcaggatcgttttgatgccggattgtgccaaggcaatcagattcagcttaaatcctaaaagaataatgcccagccgcaaaaatttattggagatcaaaccgattccaggctgactgtaagcaacggcgggctgagcaaactgcatcagcatccctagaatcaaggcaattaccaaagcacctattacggacaggtacggcagaccgcctaaaaaagagcctgccaaagagcacagcagcgtaagcaaaaatgctacgacaaactgccgtgagaataatgttttaatcatatccaaacccctttctctaactcggattgatgatgatttaagcctatcatgttatattaataaataaaaattagtattttttagatatgcaaagttttacttattaaaaattgaggtgacgcttatgcaaccagatccgctgctcgatcatcgtagcgaaacgttgctggccgttgcaaaaacgggatcgctaacggcagccgccaaattactgtttattacgcagccagccgtttcacagcagctgaacgcctgggaaaaggagctgggattcaagctgcttgatcatcagggaaagaaagtagccttgactcctggtgccaagcgcttggttgattatttgacgtttctaaggaatgagaaccaaaaaatgctggcgaagctgaaaaaggaaaccgcgccgttaagactggggtcaacactttcaattggcagttttctactgccccaggtgctggctaaaatgatcgagcaggactggccagttacgacacagattggcaatacgcagacactgctcagccagattcaaagaggagaactggatgcggcactagttgagggagattttgatcatcggcattttgtctgggaaaccattggccaggaaaaatttaccctgtttggcagccgccagcttaaggcagcagtcaatctagaaaatttgtttgactatccgcttttagttcgcgaaccgggatccgggacacgacagattctggaaaaatggctgcaggggcatggcagttccttgacagattttaaacaggtaatcgagattggcagtcccaatgccattattgagctgcttaaagacggcgtgggcatcagctttatgtaccaggcgctggttgaagacgaactggcagccggacagctttttgaatggaagttgaacggactggcaattgagcacgcgctttatctggtaacggctcaaaacagcttctttaaaaatcagcgccaccagctggcacggatctgtcggtggacggattgaatctggatgacgggcaaaaatcagcaggtgattttgactgagatgctgttatgattaagctttcttaagcaatattcgcaattacttcacaaatctgccacagcttaattgcatttaatcggtaagataatgacaatcaaattaatcaagcaacggtgattgatttgatgatcccctactttttctcaaaaatactcccaattattgaataaagcactaacaaagccgctcagttcccccaagctgagcggctttattttgcgtctggacggcaaaggtttatactaggaaatgcgctagaacaagaaccttgaccaaatcaaaaaatgggagcgaatattttggacaagcgagtatatattgataatgccggcaccacgccaatggctccagaggtcgttgctgaaatgaccgataagatgagcaatgtctttggcaatgcctcaacgaccaactattatggccggattgccaaacaggtcttggaagacagccgtcatgtgatggccaagtcaatcaacgctgcttatgatgatgagatcgtgattaccagtggtggaacggaaagtgacaataccgccatcaagcagacggcattggcccgcgccagtgaaggacgccatatcattacgacgcggtttgagcacgaggcgattctacggcctttagaagatctggaacggcaagggtatgaggttacctaccttgatgttgatgaaaacggtcagattgatctggcagagctgaaacgggcgcttcgtcctgatacgattctggtctcgatcatgacggtcaataatgaagtcggcagtcatctgccaattcatgaaatcggtgagatcgtggcaccaaccaatgcctggttccacacagatgcggttcaggcttatggaaccgtgccaatcgacgtccaaaaagacaagattgatctgctctcggtttctggtcataagctgaacggtcctaagatgattggctttttataccgacggcggggcattaatttcccatcgttcgtccgtggtggcgaccaagagcttaaacggcgggcagggactgaaaacgtaccggcagcggctggttttgccaaagcaattgagctgcacctggctgatttagaaaagcaggccgcgcgctatctggatttgaaaaagcatctggttgatggactagaagccaatggaatcgactttgcagtcaatggtcgcttaaacgagggaatggcgccgcaagtcatcagtatctggtttaaaggtgtccccaacgatgctcttttgacgaatctggatctggatggcattgtcggcgcggcgggatcggcctgcacgtctggctcgctggacccttcgcatgtcttggtagccatgtatggtcaagacagtcctcgtgtctgggagacgttaagatttagttttggtatctacaatacgattgaagatgttgattacctgctggctgcgttgattaaatacgtgccacggcttaaagacaatggcgatcggggacagcgttaagatgacactatgttaagataattaacgttatgttcattaagaaaataatatgagttgtgaatggagtcgcttgcagcggctcttttttgtagctttaacataaaccaacttaataatagacaaactataaaaaacgtcttgcataatcgctttgatttgatattataaatgcattaagaaatctcattttattttaagaaaggagcttgatcgcaatggcaccattagcaattgtcctaaccattattatcctagtcctggtcattattatcgtgcgggccgtgcgatcaagaatcccagctttttagcattgagatttctgtccacgacgcgcgcctaaaaccgaaaacgcggtagtggacaagcatgaattgagatcctcgcttgacatccactgcttgttgaatcggcagtggatgttttttattaaaaatagatgagaagaaagaggtgatgcatatggagcaagcagccaataccaaacaagcgaactttagcatgagtgctcgtgaaagggccgtacacaaaacaaccgttaaggaatatgcctacaatatttctgccgcggttgccaacgccattctggtcacacttgggatgggactgttgatgcagacgattgccggttttgttcacttccagccgctatatatggccggaacgctggcacaggatcttttagccccagccctgggaattgccgtggccgtcgaattaagaacgacgacgctggtaatgttcagctcaatgattgcagccacggttggttccaacgcggtgcactttgttacggcggccaaaggggttgcaactgtaacggcaacgggtcagaccgccgttcaagctgcggggactggtgtttttagcacggggcagccggtttcggccgtctgtgcagcattgattgcggcactgctgggcaagtacctttctggtaagacgcctttggatatggtattggttccatttgcggcaacgatggtcgggacgctggctggcctgggtctggctgcggttgtaacgccagctttgattgccgtcagtggatttattgccaagtcgatggcagtcaacccagtgcttggttcggtctgcatctcggtagtctgggccttgttcttaatgacgccggcttcttcagcggcattggcgttagcactgatgctggatccggtctcttcagcagcggctgccattggcacgacagctcaattcgttggctttacggcaatgtcttggaagcagaacacggttggtgccaatattgctcaatttgtagttacgcctaagttgcagtttcctaatttgatcgttaatccactgcagctgattccaccgattgttgccgccgcggtttgtgctccattggcaacggttctgtttaatttccgtgccacttacacggttggcggcttgggccttaactcgtttatcgcgccgatctacttctgggggcagagtactggctcatttgtaacctacgttgtctgcggaatggcactgccagcattgatctcggtcgttggcttccagatcatgaaaaagatgaagctggtacgagatggcgagatgcatttgacggttctttaagccaaaaacaactcctcctctggaaagcaggacgaggagttatttttttaattaaatatgataaaaataacatatgagattgtgaataaagattgacaaaatcaatgataaaacgcttagaattaactaaatcaattgtgaaagcggtatcttcgaaaaatgacaaaaaatttttaaaaaaatattttaaaaattaaatatgcataaattccgatttaatcaaggtttaaacgacatttatgggttaaaaacgaatttattcatttttcaaacatttttgatcataaacgtgatcgcttgtcaagggtagtggggtggatttaaaagttgcttgtgttagaataagccttgcaaataagttgaagaagggaagttttactatgtttgttgctgttgctgctctcaaccaggccgctcttttcggcgcattaattgtttttgccgtcatgggtctaggcagtttgtttgtcgtattaaaggatgtgcaggataacctgccgcaaacggccccctgggtagcaacgacaatcaacatcagctgccttttcgttgaatgcgtgggcatcgtaattgccatttccgttttggtactgggtgctcgcttggtattttagccaaacctgattaattgccactgggatgaagaatcccagtggcttttttattggccgcgcaggttcctaaaacgcccgctcattgtgcttgtcgaattgaatttgtttttgatgcgaacttgatggataatgtagttaaacgaaaacgctttcttaagtctgttaatgggaggaaagaacatgaaacggaaattcaatctaatggccagtgcagtagttttagccatgctgctgactggatgcggttctacaacgacatcgagtcaaaaggcttcatccagttccagcagtactaagacggccaagcagcattcgtcggccaaaaagacaagcaaaaaagcccagtcgacagcagctggccaatcatcacaagccgcgcaatcatcagccagtcaatcaagtaccagtaatggctcaacatcgtcagttgccagctcttcatcagctgcggcaaaatcaacgacagataattcagctgccggtcaaatcaagaccagtgcagtcaatccagccggcagcgatgcacagcgtctggcagcttttaatcaatcgatccgcgcgcagctggggaacgttcttttgcctaccacgccaggagttgctacgactaatggtcatctaaacgttcgctattctggaaatgccaatagctacacgatctattacagtgtcggctacacggccaagcgcttgaatgatccaactttaagctcacagacgccttacctgatcttaagtaaaaagacttatgccagcaaggctgcggctgcccaggcaatcagacactatgatgacagcagcactgctggcctgccaaccgttgatcttggtcatggcttaacggggacgattgacgcgggggctggtcagcgctatctgacgtggaaagaaggacattggcagctgacggttcatgccgcagcagtgaatggtgaagatccagtgccgactgcacgccatattgttaaattattggaacaattttatctgccagcaccagacgatcgtgggacggggacttttgaggtcagcgtaggcgatggtcagcggcctcaggttttgacctggatgcgcggcaacgtggtttatacaatggaagcccacagtatcgataccttggttcaaatggcggccagtcttaagtagtgtctctagataataaaaatcgcactgtccagtggcagtgcgatttttatttgatcggttttggctaatcatcatttgattctgcagctggcttatcatctaaaacatgcttatgctcagcccatgaataatagatccaggctacaacgccgaatgccaatggtccgattgccgtccaaaaagcagtggcgtagtcgtgttcaagaatcggttcaatgcaggtgaagatgattcccacggccagtaccagccagacgatcatcgagacgatccaggtaaccgtcatattcttgtagaacacgaatggacgctccagattctttttcatcttaaagaatggaaaagcccctaccaaaaacagatatggcgccgatgatgaaacgttcatcatatcggtgagaatggtatagaagcgtcccgcagcattgccgccaaacgaaacaaacaaaataatgaccgaaacgatgatgacttgaatccacatggcaaatgaaggcatctggtacttattcatagcggtcagtttttttggcaaaaggcgcggatcgcatccttcaataaacgacttgattggcgaataggtcatgacaaaagctgctcccaatccgcccaagacgtcagtcagtgccgtaaagcgagcaaaggccttgcccagcatgacgccgactgcatgagagagccccagcttttgtgccgttaccagtcccatattgttgatcaaaacatattcaacgttggccagatcgacttttttaccgcttaaaacggcctgccagttggtacagactccgcaaagaaaaattacggcaatgtagatgaaagtcatcaaaaacatggcaatgatcatggcgcgggggaaagtccgctctggctgatcaaccgagtcaatcacgccggccatcgtctccagaccgccataggcaaacaacgcgtagacgataaatgagatgacggcaattggtgagacgaacgcggtatttggcgagtgaatcaggctggtggccgtcattggctcagccagctgaccatgtcccaatatccataccagcagactggccaggataaagatgattgagatgcccagcgtaaaaatgccgcaaaacgaggaaatcttggcaattttgtcgattccttgagaggcaattaaagtaacgatgcataaaaagacgatttccaaaatacctaatgtctgattggcgctgaggccgaacaaatgccaagtctgcgtttgatcatgccccgagatcatggttgataccgaaaccaagaagaactgggttgacgataccagccagatgacccaagctgccagccagataaaagttccgataaaggctggcttttcaccgatcgagccgcgcagccatgagaagatgccgccacgagcagccttaaatgaagcgccatattcggcaaacatcaatgcggaaggtaaaaagaacagcactgcggtcacgatataccagatgatgctggcatagcccatttgataaaaggcagtcaaagagttgctaaagccaaaaattgatgaaaaaatcatcaagaccaatgcaccaagcttaatcttggtgttggatgactgtgaatccatagctgaattccttctctcaataaatatttatacattgggataaattatacgcctgttttttgttgatgaaggataaaaaagttcattaaaaacttaatttatcaaagctgattttaatcgaatctgaatggcagaaaataaaaaagccagtggcagtcactgacttataatctattgcacggtcgtctgactgatcaatggcagccttaagccgtgattattgataaattgaacgccttttacctttacgtaggaatatcctagcgactggccctttttgatcggtgcttttaactgtccgcttcggttggttttagccgttaaatggtcatagatggtcaagcgggatgactgattggcatcactggcgttttcccagatcgtgattgaacgggggcgcagcttgatctgatgcttgaagaacagaaacttgacaacgcttctttgataaaacgatttgggcagagctgttttttgcggagtcagactgctattggcaatcagctgatacagcttttgcgttgccgtaaaacgggcatccgtgctatcgccattggcatgcagcaccaccgttacaatgcgccgattttggaaagttgccgtgctgaccagacaggcaccggcagcatctgaagtcccagtctttaaaccgtcaatcgttacgccgctggtctgatactgggaatccgtcagcattttgttgatattgttgacggtcgatccatccagttgaaatgaggtctgaccggcaatctttaatagatcgggataatgattgaccagataggcagccattttaccgacgtctttggctgacatcttgttttcggcgttgtcatcaatgtttttaacggccagatcctttagctggctgttggtcagaccgacgctgttaacgatggtagcatctttaatcccaatctgccgcgcttttttctgcagcgtttggttaaactgcgcggtactgtcgcctaaagcgccggccagagcaaccgttgcaccgtcagctgacttgatcagtgcggctttgaccagatcggagacggtgtaagactggccttgcgtcagactgacatttgagtattcagggtcatcggcaatggcggccactttttggttgatcttgactttagtgttccagcttaattgatgctggctgatcttatcttcaatgaccattaccgttaatagtttgctgattgaagcaattggcagcttttgattgatgttttgcgaatacagaatctgaccagtcttggcatcgattgccaaagctgttgctgcgtccagctgattggcgtttataaacgtctcggcatgaacgctcggcagccagctcagtaaagccagccagcaggttagaaaaatagcgataaattttttcattaacgaaaagctcctaatagataataaacaattacatcagcgtcattttatcataacattaagcaacaagattgaagattcgttgatcaaaactaaaatttagcgtttggtttagcattgacagtaataaaaaaatcgcctgctgataagcaagacgatgcggtttagaaagctatgaattagtattgatgagctacggtcttcaaaaagatggtccgccccaacaggcaaagattaagcagcagaaaatatcccccgaaaacgtaaagcgaaactgaatgcagcaattgcggaacaaccaggcaaaaaagattatagctgccgactatcaaacagtacagacaatcggcccgcagcagatctttgagccatttgtgggtgttgatcaatcgccataatttctttaaaaaatcggtcaatattacttcccccgagcattattagtgccaatttgataaaataatagctgcagtagcaaatccgattgccgaaagataggcaatttttaaattggtgcgcaattcagactctcccatcgctcgaatttgctacaattttactacagaaataggaagaaagaaaattgaaatcaagacatacgatttactggctgctttgtttggttgtaattattttaggcggcttctatatgtataataatcatcttaagcagccggctgccaccaacaagacggtcgctacgactgccaaatccaaggcaaccagctctagttccaagtcgcaaagcaatatgcggacgccaattgactggcagaaatcatctgaaaccgttccgtatccagacttgagcaaggttaaaaatctttgggtcaaggtcagcttaaaaggtaaccggacctatctttatgatggctctaagctgatctacaccatgtacagttcaggcggggtctatcaaaaagatgccaagaccggcaagatgaagagcacaacgccaactggtactttttacgttcaagctgagcgcggcgacagcttttataatcaagagctgggcgaaggcgccaactactatgtttcctggctcaatcatggcgaatatcttttccactcggttcctaccaaagcagacggctcatataacctaagggaagctgccaagctaggtaagtcaacaggctcgcatggctgtattcggctgtcggttccagacgctaaatggatggagcaaaacctgcctgagggtaccaaagtcgtaattgccgacaactagctttcagcggatgccatagaattattaaaataagaaattaaaatcagtttcccggtgtggagactgatttttttgtaattgaattattgacaaacagtttgtaacataatatattataaacaacgattaattgtaacttattatattacaaaatggagtgatttaaaatgagtaagaagattgccgttgttgctgctaatggtcggactgcgcaaaaaattatcagtgaagccgttgaacgtggcttagacgtgactgcatttggtcgtcatgaaaacaatacgcaggctgccagctatgttcaaaaagacgtttttgacctgacgaagactgatctgcagggctttgacgcggtcgtagatgcagtcggggcctgggaattgacgaatctttacgtaattcccaaggcagctgcctacctggctgatctgctgaagggaaccgatacgcggctgctggtggttggcggtgcgggctcactgtacgtaaatcctgaacatacctcaactttggaactgcagcctgattttccagacgcatacaaaccagtcagtgcaacgcatggctcggctttggcaattctgcgcgctgctaaagacgttaaatggacctatgtttcaccagcagctgattttcaggctgatggtcaaaagacgggcaagtatctgctgggcggcgaagaattcatgcttaacgatcgccagcaaagcgtgatctcatatgctgattatgctgttgccatgattgacgagattgaaaagggcaaccacgttcaacagcggatctcagtcgttgaggcttaagctgattagcaattcttgaatctctgtaataaaatacttttaagcagatttataataaagaagtgtttaaatgcagatttcaactaaatttacgattgcaattcacatgttggtggcaattgactactttagcgataaagaaacggtcaacagcagcatgttggccgacagtattggcagtaatccggtaatcatccggactttaatgtcagatctcaaacgggcgggactaattgataccaaacgaggacctggcagcatcaagctcttaaagccgctggatcagattacgttttatgacgtctatgtagcagtggagaaaaacaaagatgagctgtttaacttccacgaacacgtcaatctggattgtccggttggccgcaacattcatcacgctttaagcgataaactgtttaagattcaacgggattttgaggatgatctaaagcggcaaaatgtcggtgacgttgaggctgatgtcatcaaagccattgccagcgaatctgctggtcaataaaacgttgattaagatcagctgattatgcgaattgaatagcgttatcgcaagcttagcaaaactctaagcagctggaaaacagccagctgcttagagttttttgatataaataaaacaagcatccccgattgagaatgcttgctggatagattgtccgcagtttcttttttgataccgtctgacagcggctggcagaaataaaaaagtgttgatatattggtactttaaacacctatcaacactcttgaccaagttataaatggagatggcgggatttgaacccgcgtccgaatatatcgccatttcggcgtctacgttcatatctcagctatttaaggttcattgtctggaacgccgctgatcagggctaacccacacaactagcttaattggtctcttcttgttgcttcaagccggagcagcaagcgtaagtccactgttagataaaacccggtactgcaccatggacgagcccagccggatttacgcatgcttacttgttaggcagcgtatgcgtaagagtttgaattattgtttgcagttataatttgaaactgagcgtttttacgaagccgcaaccttcgaaacgcagccggaattcgaactatacccgtcgaatccataaacatccccgttacagaatgaattttaacatatttgatttctgaatgcacgcgacaagaatttcagggtcctgattaatttgacaacggtgctgaatttattaaagtttcgcactttggtcacaaaatattcctattgtagtagatcaatgccgtataatgacttttagaatcaatcaagaattactgacggggtgaagaaaatgaaaatcttaatggtggaggacaatcaaaccttatgcgaaatgatggcaatgttcttcaaaaaagaaaaatgggaggctagctacgcgcaagatggcgttaaagccgtggaaatgtttaaaaaggatccaacgggctgggatattgtcttgctggacctcaatctgcccaagatggatggaatgcaggtggcagctgaaatgcgcaaaatttcgccaaccgtgccgatcatcatgctgacagcacgggattcagaaagcgatcaggtgctggggcttgaaatgggtgctgacgaatacgttaccaagccatttagtacgatcgcgctgattgcccgaattaaagcgctgtatcgccgcacccagcttaatcaactcagcagcagcacgcagcagattgccagtgactttgacgtgcagacgccgcatttcaagctgaattccaagacgcgcgaggcatttttggatgaccagcagatcgaaaacctgacgcccaaagaatttgacctgctaaagacgctggcttccaaaccgaaacaggtatttaccagagaacagctgctgcagctggtctggaactatgaatactatggtgatgaacgaacggttgacgcacacatcaaaaagctgcgtcaaaagattgaaaaggctggtccccaagttattcaaacggtatggggcgttggctataaatttgatgacagcgaggttgaagatcaatgaagctgatctaccggcagatgctgagcttttttgccgtcatctgcacactgctgatcattgtaaccatctcatttatcaacgttactaatcgaaccttgtatactaatacctggcgagaattgcagcaggacgccgatagtctgattcaagactccattaaatatgatcagacaacgcgccagtttaagggattaaagacgtcatcgctgaaaagcaatgcgaatcttttagcgcggcaaaacgtgcactttgcgatttatgataccgaccagcagaaaatttttgccagcaacggctatacagcgacactgaccaaaaaagaatggcaggccctaaagcaggggaagacgattcaaaagaaaatcgaccatccccgtttagacgtttctgataaaaacagaacaaaagaaaagtcaaagccgggtccgcatccaagcatgaccgatattttaagaccatatttttatcaaggaaagctggtcgcggtagtatcaattgggacttttgtatcaacggttgagcaaagccggcaccagatccttaacaatctgttggcaacgtttgtaatcgcaatgctggtggcactggtggtcagttatctcttggcccgctcaaccacgcagcggatcagtaaaatgcgccgagcaacgcaccagatcgcacgcggcaactataaagtgcatattgatactcaatctaatgatgaacttgatgacctgggccgcgacttcaatcagatggcagatgcactgcaggcatcacaagaagagattcgtcaacaagaagaacggcggcggcgctttatggctgatgcagctcatgaaatgcggacgcctttgaccacgatcaatggcttactggaaggcctagcctacgatgcgattccagaagaggataaaaagcacagtattcaattgatgcaaaatgacacgcgacgcttgattcgtctggtcaacgacacgctggactatgaaaagatccggactaatcagatttcaatggatcgcaaagtctttgatgcaacggcagtgatcaacaatctccaggctcagctgcgaaaaaaggccaaggtgcaaaatgatgagctggctgtggatctgcctaaggttctgcgggtctatgcagattatgaccggtttgtccagattatgtttaacatcatccaaaatgccattcagtttacgaaaaatggcaaaattgagatttccggtcggcgactgccaaaaggagctgagtttgcgattaaggacaacgggattgggatgactaaagagcagacggaacagatctgggaacgcttctataaagctgatcgctcacgaatgaacacgcagtatggtgaatcaggacttggtttggcgatcgtccatcatttagttgagctgcatgggggaacaatcaaggttgccagcgaactaggcaagggaacgacttttacgctctttttccctgatcgcgaatacgccccgcatgccattacgccgcgcagtgagacagatgtttaaaaatatcagtttggaaaatataattgcaaaccttttcaattttagaccaactttttgagtaatcgcttgcaatgccaatggtaaacgcttttaggatatcgataccaccaatagttttactaactttttgaatgcaaatacttgtgaaaacgattgcattaaggtatagttatttttcgtaaagtttttaactacttttatcgaaatttttaagagagagagattttgattatggcttatcttattgctttaattccagcgttgggctggggttttatgccactgattactggtaaggttggtggatcagaagccaaccagatttttgggattggtgctggagcttcattggttggtttggttgcctttttgatcatgcatccgcaagtaagcatgaaggcatttttgttctcattgctttgcggggcactgtggtcaacggctcaggttggtcagttcgtttcatttaagcgaatcggggtatccaatacggtgccgctgtcaactgtcttccaattggttggtaactcaatcatcggggtgctgattttcggcgaatggcactcggcacgggcactgacgattggctttatcgcattggcaatcgtgattattggggcaatgatgacctcgtttaccgatcgttccaatggtcaaaacgttacgaccaaggatgttttgttcctgctggcaacgacgattggttactggatctactcatcatttcctaagatgccgatcctggcgcatgaagattcagtcggcatcttcttgccagaagtactggggatcttattaggagccatcatctatgatttggcttcaggcaatgcaaaggcctttacgcaaaaagaacagtacaccaatattttggctggtatctcatgggggattgcggcatttgcctacatcttcgcggctcggatgattggggttacggttgcctttgtcttcacccagttgaacgtgattatcgcaacgtttggcggaatcttgatcctgcatgagcacaagagtccacgtgaatcaaaatttaccttctggggaatcgttttgatcgtaatcggcagcattgcaaccgcatttgcctaaacataaaaataaaaaaagggagaagcaggcttgcttttctctttttttatacaataaacgttagttgctagtttgtaacattcccatgacttctaaattatgggtcagcataattgcctcaatgttcatttgcagaccacccagactacgagtaagtgtatgttcaatgccctgtcgcgttagatcagcaaagcagctctcaattcggcgccgaatttttttgagttgccggctgttgtgttgtttggcgaatcgcatattggaacggtatggcgtccatagctgatagcccatttgcgaaaaaatatgctggagctttttaccaacataacccacatcggcaatgacaaaaggacatggacaattctcgataacttctggagcagccttagcgtcatgaattgaggctggagtaagttcatagttaagaatcagtccttgcgtatccgtaaccacgtgtaccttgaagccgtaataatacttttgtttggtagcgttgtatccaatatccgcaaagcattggaacaaaatcgcccgaaacttgcggtgatcttgacacagcggcaatgggaagctgtcaataatggcgatatcaccatagctggacatctcgattaggccagagcgaattgactggaaaataggaatcagatttttacagcgacgcataaaccgagaatactccaacattggcagagaaggcattacgtcactgaccaactggcagaatttccgccaagttgcgacctggtactgaaccttcaagcacattaatgccagcaaagcagcatcagacagcttggagttttcaatatttcgacgctccaggtattttctggatgcatagcgcttaagcaaatgactcatcattaagcgacagcgactgaatttgatttgaaaatcatgacgataaagcttaaactgaaagtggttcaacatagctaagactcctttttgtttttgtcacttatgagtctaactatgttgggctttttttgttaaatattacgaactagcaattcgcatacaataagtagtttataattcatttaaaaacgggtaaactagagatagtttaaaatacatactaacctagaaaggggactccgacatgaaaaacgatagtcgcagcctggtccgggtagcgaatcggcagctggtactacagcagctgttcaatcatcctgccacgactcgggttgacatcgcccgtgaattaaaaatcaataaatcaaccgtttcagcaatttataatgaactaaatgatgaaggcttcattgaggaactgggacagggtgagtcgaccaaccgtggtggacgcaagccaaatctggtctgtttgaacaagcgatatggctttgttgccagctttgaaatcggcactggtcatctgcgggttatgttcagctatattaatggcgagatcatcagctatgagcagattgcattggaaaaacgcgatatgcttttaatcatgcagacaatcaaagaagtgctgcagaagatggaacaaaacgatgatacgatccatggcttgttggcgattggcttttccgttcatggaatcgttgaccataatcagattgttgatgcgccatttatcagtacgaatggcattgacctggccgcctattttgaaaatgagtttcacgtcccgacgattttagagaatgaagccaacctggccgcgatttttgaacgtgattttggcgatcgggaatcataccgcgatttgttggcaatcagcattcatcgtggcgtgggtgccggaatcattgccaatcagcagctatatcgcggctttcatggtcgagctggcgaaatcggccgcagtctggtcgttggtcaggatggacagctggtcaaagttgaggcgctctgctctgaagatgcgattctgactcagattgcccaggcaaaaggattagataatctgcggccagcacagctatacgagctgtatcggcagcatgatgaaactgtcattcgcgtgattaaccaggcaatgggaaatctgcagaagttggtttacgatgcgatcgtcagttttggcccgcaggcggtctactttgattcaccactgtttgatgagatgcctgaattataccagcatttgcgcgactggctgcaggctcatcagatcgatgttccgctgcagatgatcaaaggttctgaaatggcatcgcttttaggcgccagctcaatggccatccatcgttttttagatatggatcgctattcgttgacgctgaaatggcctaaatcagtttccaatattaagtaaaaacacgtctccgagcatgacagctcagtgagacgtgttttttatcagcgaggaagctgtaggactgccgcaatctgatcagcaggtgcctttaggatggcaggcgcgccgattgttttgacgtagactaagtttaagtaaccattatgatttttcttatcgtgtttgattagatccaagaccttatcagaggccagccatggtgaagttgttgacagaccaactgctgtcagtctggctgtgattttttgtgtagtaccgggtgcggttttaccagccgcttcaaaagcacgacagatggcaaccgtaccaatgctgatcgcttcaccatggcgcaattcaccggcagatagggcttcaatagcatggccaatggtatgaccaaaattaagtagctggcgttggtcgctttctttttcatctgccatgacaatgttggctttaaactgaatggagaattcactcagttccaaagcgtgtttcaagatagcggcaggcgaatcgatctgctcaattagacgccaaaaaccgtcgccaaccattgcggcagctttaacgatctcgccatagccttctactagatcgcgaggcggcaatgtctttaaggtttctggatcaatcagcaccagatcaggttcgtaaaaggcaccaacaatatttttggtcgttcctaaatcaacggcagtcttgccaccaactgaactgtcaacctgagccagcagcgatgttggaatttgaatcaaggaaatccctcgcatgtaagtagctgccaaaaagcctactaaatcacctgttacgccaccgccaagcgcaattaccgcatcatcacgattaaaattggccgccaccaatttttcacttagtctttggagctgtgacagcgattttgaagcttcaccggctggaaaatcatagcagtggacctcaaagccgtgtgcggtcagttgggtagccaagtcagtctgatagagtggtgcaacgttgtcatcgctgatcagcgctacctttcgcgctgaccagattttggcgattcgttccccggccgtttttaacaaacccggttcaattaagacttgatattgttgattggctaaagataccgtgattttttccatgataattccttctttgattattcaatcgactgcaaagcttggcggaccgcattcgttttgactaccatttcgttaaattcatttggttttaaggcttgcgcgccatcagaaaatgcatgggctgggtcatcatgaatttcaacaatcaatccgttggcgccagcagcgacaccagccaaagcaagcggcgttacaaattcagtatgaccagcagcatggcttgggtcagcaattacggggtagtgggtcaacttttgtaaaaccgggatgacaccaacatcaaaagtattgcgcgtgtatttgttgtcaaacgttcgaatcccacgttcaacgatcataatttggtgatttccaccagcagcaatgtattcggttgcgttcaagacgtcatcaaccgttgctgacattccacgctttaacattaccggtttacgggtttttccaaccgcctttagaagagaaaagttttgcatattgcgggcaccaatctgaaaaatatcagtgtaggcttcaaccagcggcacctgctcaacatccatgacttctgttaccacatccaattctagtcgatcggctgcatttctcaaggcaatcagaccttctttgcctaatccctggaatgagtatggtgaggtgcgaggcttgaaggcgccaccgcgcagaacggttgcaccagcatttttaacgacttgcgccatttttaaaatatgttcggcagattctactgagcaaggtccagccattaaggtaaagttctttccgccaatcgttgagtgtggcgttttaatgatcgtatcttcgggatggaacaagcggaatgcttgaacggcggctggaacatcggtaataatttcttgagcagcggcttgttcggctggggtaaggtcgcttggatcggtattttgaatggcaacacgattgttatggacaaagatttcatgctgactgccgaaatgctgctttaattcttcaattgctgctgttgcttgatcattttttaatacgataatcataataaacgctcccttgttaatcaattcaaaaaaccctcatgatgttaaaacaccatgagggttcgcgcttgcatttacatgctggttggagcggagccgattacatagtgctttaacaaaacatctgccatgtaatcggtaattacaaactattatcaatcacatagactgttagactaacgccaacaacctatgtcgtgtcagcgttaatatgattgataataatagctaaatcgtgcgtttgtaattttcataatgctgctccttaatttaagtatttcctaaaggttgaatcgagtatatattatgagaaaagtaaagtcaactctaattttattttaatctataatcatcgttgtttaatcaatgaaataaataagtgccttgaaaatagaatggtaataagaaaactcactttattttttttagaaacggtatgatgccagaattagcaccatgctgttaagcgcaataaaaaagcccgacagtaaaactgccaggcaaaatacttactatcgatatattgagagggtttaggattcagcaagtaagattaaatttagatttaagatttgagtgggattttgaataatgactgagattagttcttggaaccagcgtggtcacgcagcgtctgttcaatatcttccaaagacttgccacgggtttcaaagactttggcatggacgaaccaaataccaaagaagcaaaggacgccatagccgataaacagactacccgtaccgaagaagtccagcaaggttgggaaggttaatgaaacaatcaggttggcagtccagttgaccacggaaccaaatgagttgcccaggccacgaatattaagtgggaacatttcaccaaacatgacccacataacaggaccccaagtaccagagaagaaagcaatgtaaatcgtcatggcaacgacacagatgaccgccgctgcctttgaaccgccagagaatttcatcccggcactcatgacaaacaatgagatccccatgccaaggccaccatagatcagcatctttttacggtcaaccttatccatgatggaaagagcaaaagcggtgaccagtacgttaaaggtcccaatcccaatgtgagccagtagcgcagcgttaacaccaaagccaacatcagtgaagatcgttggtgcgtagtagagcacggtgttgcagcccatgacttgttggaaaacggctaggccgattgcagcgattaaggctggccgaaccattggaccaaacagttcttttaagccaccatttttcatgtggacttgttgttcaatctgggtcatgtctttatcaacgacgtctttgtcattgcggttcatgttcatcaaaacagctcgtgcgtcatcttcacgaccaatcttaaccagataacgaggagattctggcaagtaaagggccccaaagaacatgatggcagcaggcagtgcagcaaagccaagcatccagcgccaaccagtgtacatgttttcaaacgaccagttggtgatgtaggcaaccagaataccagtcataaccattaattggaacatactagaaaccatgccccgtttgtcagctggtgaaagttcagccaggtaggttggaaccattgaagatgatgccccaacggccagacctaacacgatccgaaagcagagcagcgaccagaatccttgtgagaatccagagcccagtgcgccaataaaaaagataaccgatgacaataatagcagcttgcgacggccatacttatcagacgatggcccgataaacaatgaacctaagatggcacccagcagtaccgcggaaacgatccagccttgttcccaagttcccaggtgcatctgtttttgaataaacagaatggccccggaaataacaccagtatcgtaaccgaagagcaaaccgccgagggccccgaaaaagtaaataaagcccgcagatactttgcgcatgattacacaactccttaactataaaacactcctattgctttggttggtttaaaactaaaaccaacctgcgaatataatataaccgctttcaaagataaaagcaagcaaaatttgcaaaatagtcgcgtgaatttttagtgaaaaacctggaaacagctttttagaaaattactgctgacgatgggaccttttttcttcattatatattttaaaagtcgttgtttaggatcagctgattctgaacttttttgctagaaagggtttacaaaacagcaggtatggtctatattaaaagtcgtaagttagttgtttattcaaactaataaatttcaggaggcccatattatgagtgatttatggcaaggtattgataaagttaagtatgaaggtccacacaaaggcttgaactcacgtctggcattccaatactacaacccagaagaagaaattctgggcaagaagatgaaggattggctgcggttctcagttgcctactggcacacgtttgaccagcggctggttgacccatttggtgatggcacggcggttcgtccatatgacaagtacactgacccaatggacaatgctttggcaaaagttgactacgcttttgaattctatgacaagctgggtgttgactacttctgtttccacgaccgcgacttggctccagaaggcgacacgttgcgtgaaaccaatcagaatctggacaaggtcatcgacaagatcgttgaataccaaaagacgactggcatgaaggtattgtggaacacgtccaacctgtttaccaatcctcgtttcttggctggtgctggaacggctccatctgcaaagatctacgcatacgcttgtgcacagctgaagcacagtctggaagtcggcaagcgggttggtgctgaaaactacgtcttctggggcggccgtgaaggttacgaatcactctggaacactgaaatgaagcgcgaacaatcacacattgccaagttcttccacatggctaaggactacgcaaacgaaatcggctttgatgctcaaatgctgctggaacctaagccaaaggaaccaacgacgcaccaatacgactttgatgcagcaacgacgctgaactttatgaaggaatacggcttggacaaagacttcaagctgaacctggaaggcaatcatgctaacctggctggtcacacttaccaacatgaaattcgcgttgctcgtgaagccggcatgctgggctcattggatgccaaccaaggtgacaagctgattggctgggacatcgacgaattcccatccaacctgtacgaagctacggcagctatgtacgaagttgttgaagcaggtcagatcggccctcgtggtggtctgaactttgactctaagccacgtcggacttcctggaagccagaagacctgttctacagccacattgtcggcatggacacgtttgctgccggtctgcgggttgctgctgcccttaaggaagacggctacctggacaaggtactcaaggatcgttacgcatcatgggacgaaggtctgggcaagtccatcgaagaaggcaaggaagacttcaagtcgatcgaaccaaccgttttggacacgccacaaagcgaactgcgggctgctacgcaatctgaccaccttgaacaggttaaggacacgatcaaccactttatgattgaaacgctggctaagtaatcacttgaaactctaacaatactaatagaaaggattcgcatcgccgcagctggctgcggatccttttttcttggaggaaatattatgaacgaatacgtaatcggggtcgatctgggaacgagtgccgttaaagtttcggcaatggatcgttctggcaagatcgccgctcagcaaagctatgactatccactgagtcagcctaagccaggctacagtgagcagaatccacaagactggctttatgggacaacaattggcattgaccgcatgatcttaaaagatggcattaaaaaagaagagatcaagggcatatcattctctggtcaaatgcatgggctggtacttttggatgcggacaatcaagttctgcggccggctattttatggaacgacacgcgtacgaccaagcagtgtcaagaaatcatggataagctgggtgatcgttttgttgacatcaccggcaataagccgctggaaggatttacgctgcctaaactgctgtgggttaaagaaaatgaaccggagatctgggctaaggccaaaacgttcctgttgccaaaagactatgttcgcttctgcatgacgggtaacctggggatggattattcggatgccacggggacggtgctgttagacatcaaggaaggtcaatggagccaggaaatctgtgatgcctttgatattccaatgagcatgtgtccacctttgatgaagtcggttgactatgcgggcaatgtttccgccagctatgcaatgttttcgggcctttcgactgctaccaagatctatggtggtggcggtgacaatgcctgtggtgcggttggtgccggcatcttgcatccgaacatggttatgtcttcaattgggacttcgggcgttgtgcttaaatatgaagaaaatgccaacgttaattaccatggccagattcaatacgaatgtcacgcaatcccagacacctactactcaatgggggttactttggcagcgggtcactcgctaaactggtttaagcataagtttgatccagacgaggacttctcgacgatggttgaaaaagcctccaagcggccactgggtgctaatggtctgatctttacgccttacgtagttggtgagcggacgccatatgctgatgctgatattcgaggaagctttattggtgttgacagcatgcaggatcgctatgacttctgccgagccgttatggaaggaattacctttagtttccgggatatcttgaacatctatgatcaaaacggtcaagagtttgacacggttgtagcaattggcggtggggccaagagcgacttttggcttcagatgcaggccgatatcttcaataagaaggtcgttgccttaaccaatgaacaggggcctggtttgggggccgccatgattgcagcagttggcctgggctggtttgagtctttgcaggactgtgccaaggagttcgttcactttggcaaggagtacctgccaaagccggccaatgttgccaagtacgatgaactgtatgcaatctaccaccaagtctatgatcagaccaaagacctgtgccatgctttgttgaacttccgtcgtgaagactagctggttggtccaatccttaaaacttatttcatcaattaacagcttaaaaactcatttgcatcattaaaaagcgccatgcagactgccattagggcaattctgtatgacgcttttatggtatttgattttttctactattatataggatcaaaaaagcagacaaacagcgatcagcgaatcaagccatttgtctttataagatgattataattaatatagtggatgaaaaagtagacaaacagcgaccaatcgatcaagctatttatccttataagatgatcataattaaaccgaattcgtagacaggttaacggacttgtctaagccgagttaacagcaaaatttgtgaaatgagttttgcccattgttaaaaacaatcggcaaaacgataataaccaatattctatttatcaatgagtatgagcagggaaaaacagaattggggtgttttatagtcaatggctgattttaataaagagagctaaggaaatagtcagcctgacagcctaaagacagactgattcgatatgaattaaaatcagcagtatattgattttccctagctcatgctattattttatgtaatcgctaacacagtaacttgaagattagaatcattttttgaataaaggacggattagaatggaaatggtaactgagtatctagagtcactaggggtaccggctacaatctgggagtacgatcgtggccagtatagcctgcagtttcgccaaggtaagctattattgatggactatctaaaaatcctgcgccgctgcccacataaaacgctgcagtttttgcggcacagtcaaaatctttacagctgcctaatgtggcatgatcaaacagttgtcttttttggcccagtgattgtcaacgtcagtcagcgctatcaaaataacaatgcgatcagcagtcatgccgttatgtatatgccaaagctgctgaagacggcttatctggaagaaaaacagtttttgcagcagattttggtgttgggacggttattagaactgccgatcgattttgaaaccattagtgacgaatttcatcaagcacgtatttcaagagaccttgatgcccaattgctgaagctgcggatgagcagtgagggaggtcacgttagctatctgtatgagcgagaagtcaaaaaagcaattgcgcagggaaatctggctgccttgccgattatattctctaaaaatatcaattcaggtcggatcggcattttagcagacaatcaagacgcactgcgcaacgttaaaaactggggtattatctcggtttccgtaaatctgcgcgcgctgtttcaagttgggctggattatgaactggtatattcgctgaatgatcaatacgtacgacatatcgaatcgttgacgtcctacaatgaagtgctggcggcaattgaggcagcagatgtggatatggccacacgctgccgtgagatggttaatgccaagatgactgcagccgtcagcaaagtcttttggcagctgatgagtgatccgactacggaccaaagtatcgatgagctggcaatggcggtgggattgtccagtcgctatcttggcagccagtttaaaaaacaggtcggggttagcattagccaatttaaacgcctggttcagatcaatcatgcaattgaggatctgatcggtaccaatctgtcaatggctgaactcgctgaacgctatgatttttctgatcaggcccatttctcacgcgtttttcatgccttaaccgggataacgcctaaagaagcccgtactgatgccgctaaaattgccgattggaatctttacgactatctattttaaaaatagtatgaaaaataaatcatatgtatttttgaattttattactaagtgaccgcgtttttgtcagcggtcattttttgttgacgctatatgaagaaaagagctcgattattttagcgaaataaaaaattctaactcaggaatgataaaaaaattgatttttagggtagcgttttcaaaaagactatgttagattttggtcgttggttgaaaacacaaactaacgtgcagcgctgcacctgtttgaatcaaatctataagaggtgtaaaaactatggacaagccacaaaacaagcaagtcgatgagttcgccaaactgtcctggggcgagcgaatcgcttatggtgccggtgacttggcacaaaatctgatttttgggacgattggctcaatgttgctgttttatctgacaacggtttttggaatctcagcagctgttggggccacgatttttctgattgttcgctgggtcaatgttttttgggatccttgggttggaacggttgtcgataaaagtcactttaagcacggcggcaaatacaagccatttttgatttactttggaattccgctcacgatctgctgtgccatgctgttcttgccaattccagccgttcgtggcaatgttgcctatgcattcttgatgtatctggcaactgccttgatctattcattcgttaacattccttatggctcgctgaatgcctcgctgacgcgggataatgatgagatttccacgttaacgacggtccggatgacggaagccaatatcggtaatcttttggtctacacgttcctgccattgttcgttcaaatggcatcccctgccaagcatttaaaagacatcgggatgtttggcatcaagcttaatttaggtaactatgcctcgccacacgctgctggtgcctacttccacgttatgtcaatctatatgctgattggttttattctgttgctctgcacttactttggtgttcatgaacgggtgctgccaacggaagaagaaacggattccgttaagttttctgatctttggaatgagctgcgtcgtaacaaaccactacgggtactaggctgctttttcctggttggctttaccttcatgttctttggcaatacggtttggccattctttgttcagtacaacattggtcactcagaatggatggcttcaatcaatctgattggttcgattccagggatcttcttggttttcttatggccaatcgttcggcgcaagatcggcaaaaagggattcttccaactgttcttgggaatgtttatcgttgggacgctgcttctttgggtatggtcatggccacagtttaagaacagcattgccctgggctacattggccgctttatcatgcagtggggaattacggccgctactggctacatgtggtcactggttccagaagtcgtttcctatggtgaatggaactcaaagaagcgggttgctgggatcatcaacgccttgatgggactgttcttcaagattgggctggcacttggcgggatcattccaggctacatcaatgccgcttgccactttgacggtactaaggctacgcaatcagcaacggccttgaatgggattacgatttcaatgatctggctgccaattgttttggcaattgttggcatgtgggtgatcagtaagtacccattgtctgatgcagaagttgacaaaatcaatcacgaaattgaagatcgccgccaagctgaagaaaagtagctgtcttaatgcagaaataacggaaaggatgaaagttcatgaaaatctatgttgatgcgcaggcgccatttgatggcggaagatcgccgccaagctgaagaaaagtagctgtcttaatgcagaaataacggaaaggatgaaagttcatgaaaatctatgttgatgcgcaggcgccatttgatggcgatggaagcaagcatcgtcc

SEQ ID NO: 698 - DNA, 385955 bp, Unknown
  Metagenome-assembled genome
gacgcaatgacaggtggtggctatggtcgtcgtcagctcgtgtgtgaggtgttgggttaagtcccgcaacgagcgccaaccctttgttactagttgcaagcattcagtgggctactctagtgagactgacggtgacaaaccggagtgaaggtggggacgacgtcagatcatcatgcaccttatgacctggctaacacgtgctaccaatggacggtacaaagagtcgcgaactcgccgagggcaagcgtatctcttaaaacgttcccagtcgtgactgcaggatgcaacttcgcctgccacgaagtcggaatcgctagtaatcgcggataagcatgccgcggtggaatacgttcgggcttgtaccaccgccctcacaccatgaggagttgcaacacccaaagtcggtgggtaacccttcggggagctagccgcctaaggtggggcagatgattagggtgaagtagtaacacgttagccgtaggagaacctgcggctggatcacatcctttctaaggactaatcggaaaccctgcacaattcagttgaaatgcgttcagttttgaggggtctaccctcagagtgtactttgaaaactaaataaatatgtatttctttattcaaaattaaaccgagacacccgcggttatttgagttttttaacgaaattaatcgcctacccaataacctgaggtgatcgtaagatctcaggttatcttaagtatgaagggctgcatgtgtgaatgaccttggtactaggagcgatgaaggacggactaacaccgatatgcttcggggagcggtaagtacgctttgatccggagaggtacgaatggggaaacccaaatcatcttagtcgatgattgatgattgctgagcacgtgaatacaatagctgcaggcggtagacgacagtgaaaactgaaacatctaagtagtgcggaagagaaagaaaattcgattacatgagtagcggcggagcgaaccccccaaacgaaaaaacgggaagcgcccaaaccaacgcagcttgcttgttgggttggaggatgaacattgaggttaccaaagttgcgagtagttgaagtcgtgggaaagcggacgacaacaaagatgtgagagccagtaaacgaaaagtcacaatctcgttcggatcctgagtacggggacacgtgaaaccccgtcggaatccgcgaggaccatctcgcaaggctaaatcactccctagtgaccgataggaaccagagtacaagtgagggaaagcgtgaaaagcaccccggaggggagtgaaacagtagtgaaacagttcctgaaaccatgtgcctactaagctgtcggagaaaatttacgtgtgacggcgtgcctctcagaatgaaccggcgagtcatgattgcggcaaggttaaggtgggaaaaccggagccgaggcgaaagcgagtctgaaatgggagtacgaagtaacgcagttatgtacccgaaaccaggttgacctacccaatgcccaggtgtaacggtgcgggtaaatttcggtaataatttaaaagcactggagacccgaacccgtatcagattgaaactggttgggatgagggtggggtagcggttgaattccaaacgaaattggaggatagctggttctctcgaaaaattatctttagggggagcctcgaaggtttagaatctggaggtagagcactgtttggactaggggcccgtcatgggtacgattagataaactccgaatgccattgattttactcgggagtcaacacgtgtggtgataagatccacgtgggaaaggggaacagccccagatcatcagataagggtccctaaatatatgctaagtggataaaggatgtgaattgcacagacaactaggagttggctcagaagacaggccatcatttaaagagtgcgtaaatagctcactagtcgagtgatcttgcgccgaaaatgtacccggggctaagcatattaccgaagtatggatgatccatcaggatgcgtggtaggagagcgttccaaggcgatgaagtcaaccgtaaggcctggtggagcgttggaagtggaaatgccggtctggtatgagtagcgaaaaaagaaagtgagaatcctgtcacaccgatgactaaggttttcctgggggaaggctagtcctcccagggttagtcggcgacctaagtcgaggccgagaggcgtagacgatggacaacagttgatattcatgtaccagttgatgggcttggtgatggagtgacgcagaaggctaatgcagatcaggaagatggaagtgtccggccaagcatgcaaagtcagttgatgagtcatatgcttatccgcggttgacaagcttgtgaccgggagcgaaatatagtagcgaagtcgtgatggtcacgtgccgagaaaagctgctagcgaaatcaactgccccgtaccgcaaccgacacaggtagtcgaggagagaatcctaaggtgagagagcgaactcttccttaaggcttagaccgggcaaagtccagccccgtaactctcggagggaaggggtgctgatatcaaagatcatccctcagtgaaaggtgcccatgcgactgttcccccacaacaacaggttgctgcaaaatcgtaagatgaagtataggggctgacgactgcccgggctggaaggtaaaaggaagagttagcttcggcgaagccctggcaatgaaccccagtaaacgcggccgtactattaacggtcctaaggtagcgaaaattccttgtcgggaagttccgacgcctcacgaaaggcgtaacgatctgggcactgtctcaacgcgaactcgggaacattgaattgcttcctgtgaagatgcagtacccgcgacaggacggaaggtaccccatggagcttactgtagcttgatattggatgctttgtactgctgtaaggtaaggtaggaagcacatgagaagccaggacgcttagtttggcaaggcgttggtggattatctacccttgcattatgatactctaacccgcaccactatgtggggagagaccgttgtcaggtgggccagcaagtttgactggggcgggtcgcctcccaaaagataacggagcgccccaaggttcgctcagagtgttggaaatcattcggagtgtaaggcacaagcgatcgctgtgactgcgaggacagcaggtcgagcaagggacgaaaggcgggcttagtgatccggtggttccatgaagggccatcgcctcaacggataaaagcttacccgggataaccaggcttatctcccccaagagtcaacatcgacgggaggtttgggcagcctcgattgcggatcatgcacctggggctgtatcgtcccaatggttgggtgttcgcctcattaaagcggtacgcgaggctgtggttcagaacgtcgtgagtacaggttcggtcctatccgtcgcggcggtaggaatcttgagaggacactgtccttagtacgagaggaacgggaaaaaaaaaaaatggacatttaccgctggtgtaccagtttttccgccagagcatcgctgtggtagctatgtatgatgaagtaaaccgctgaaagcattaagcgtgaaactcgctcaagatggattttcccattcgcctttatggaagtaagaccccagagatgatgggtagataggatgcaagtgaaggccgcgcgcatggagcggaccattacctaatcggtccgaggacttaaccaagtttagggtgtttctggattgaacgtgagaagatgatatgtgtttgttttgagagtgcaagctcctcaatcctgaaaagtagtgtgggatatgctttaaggatacaccctggttcccatgccgacacagtaagttaagcttcaacgcgccgaagtagtgggggatcgctcctgcgaggatagggtcatgccatgtgaatggacccttagtacaagcgttttaagacaccagccgtttcacgctggtatcgtgggtcgaaatcccgcatgggtcattgtgaggattagctcagtgtggagatcctcgccttacaagcagagggttcacaggttcgagccctgtatcctacatgtgataaatagtgtctatagccaagttggtaaggcaacgttttggtaacgtcattgcggctggtcgaacccagctagcccaattatattcttgcacccatagcgcaattggatagagtgtctgaactacaatcagaaggtgaggtttcgactccttctgtgtgcatttttcgggaaatagctcagcttggtagagcacctggttgggaccaggggtccagcaggttcgaatccatgtttcccgaatttaggattatcgcggtgtagctcagcctggctagagcgtccggttcatataacccggggaggtccgagggtcgatcccccctgccgcgattattgcgtggtccgttggtctatttttggttgaggacgcatctgtcacggatgtagatcacgagttcgagtctcgtacggaagtaaattgctcgtagctcattgttttggccaacggattgaagctccgtgttcgcgcggttcgagttccgtcccgggccatttgattatggagagtagcgaagtggttaaacgcgcggtctgtaaaacacgtttcctcgggttcgggctcgttcgaatccaccctctccacttatggcggtattggtggagtgtggttaacacctcggtgtgggtccgacatgcgtgggttcgaataccaaacccataccgcctctgttaaaagatgcatgttcaaagtaaattggacatggtctgttttttataagtttatgaataaacattttcaaatctgattctgaatagtttgcaaagtaagcaccagccatattgaaccgtgttggcctactaagcggtggagcatttcaaaaattaaagaataaaaaagcacgggcgacagcgcatttctgcgtggtggaccgctgttcgtttatcaattaggctttcagactttcttgaatttccgagcccatggcaaataagcctctatttctggcgtttcgcgttttgtaaaggcgctaagcagggtctctaatatttaaagacatccaaatgatttagtttttggcggttgcacgatgctataccagatcgcattggctttggccccagccgtggacttcgcacaacagactgttctttctgaccagagtggtgggacgaatcagttgctcattggattattatgcaatggcagctctccatgcctgaacatctggtaaacccgtttcttcaatttgagggcattcttaatcgcatcgttagcggtttgagtgcgatttcgtcaaggcctttgtcaatcagctgatagaaatcatcaatcatcgctttaaatgctgacgcctttggctgccttctcacttgctgataatatttcacacgttttcgatgtgaaatactttgggaggatccgcacagcgtcactcgcaatactttgcccttgaaagcgggtaatctttggatcaagcagtcgcttaatggcgattgatagaaccaacaggtcccccaatatgcttctggtaacgattatcagtatccactaaaccatcgcacataataccgccagaaaagtctcacctaagatttctgtaataacctttcctgatcgtgaagggcatagtggaaataagaacctgatgcggagctgaattcttccgtagaacagctgaccagaagtagccatgtgattgatcaagatccagaacttgaatggcgtctcatcaagctgcaccacaggtgctgccttgatttcttgacgcagactttcataaatcttttggccaaacctttcgccagcttcaattaccccacgagccatattgtttactggtgattggaagcccgaggcgcttccaatactgcgtctggcgggtaaacggtactgccagccaaacttttcaaaagtacttcggcgattaccgattgaaaggtaactgtgtggaaaacaaaggcctgtggcgtctttgcctctgaacaagtacatcattgccagtttccggatcttgacagtgttcgcatctagccgttcagtacatacgattttgcagcacaagtgggcaggaaccagtttaacttcacgatactgtttcatgtttgccgataaaccgtcatcatttgagccgcattgatcacaagttagttcttgcttactcagctgatgaagttcttcaacttctaagcaatcaagccattcgttacgtgattcctttgattgcattttctctgatgactggtaacggtagtggtcaacttttcgactggaatcatcgtttggcgcggtttcctgttctttatcatcaacagatccagctggccagcacttaatttttcagtttttttttccaaaagttgcttttgcagatgtttaccatctcggtcagtccgcgatagttagcctttagttctttgttttcaccgcaaagcttcttctagagtgatcttctcagccattaccaatcacccctctattactgatgaccattaggttatcagataatggaggcaaataaaagaggaacttgttaataccctggtccttaatagcggcctgattcgtttctgaggcagtggcgagataccttctaacaatgccttaatctgactcttggttaatgcactggtcttctcgatgtcgcggccatcgtaatccaccattttcaaaagcgcttatagagtaagattgaatcttcaccgtccagtataagcctttgaagccggtcatacgattgccacaaaacaggaaaagcgaatcattatctaattccaagcccgtaattctctgcgatcaccatggccaaaccgtcaatgcccttccgcagatcggtcttgccacaaactatgtagacgtgctgaggagcactccagttaaccagcataagcggctactgctttaatgatctcactaccaaagcgggatcgcttcttggtagacattaatttttacttggtgcagtgtgaaacgaaagctgccaagcgtgagtgcttagcaaccggcttctttgtttgttcgcggtatatcaacttcgacaaaatcttgcttcataaaaaagtcctcctccttgaatatgtcttcaagtataggagaacttggaatttaatcatatgcggttggttatagtgtgcttacgttgcaaacggttgcttcaattcattacaaacgcttgcagcaaaaattttttaaccggcatgataaggttcatcagcacttattttgcatggctttagagaatcttaaatgcaattgaacgttttaatggtacattgtcaaattgaataagaggtggtaatttatataagaacgcgcttacatgatattggtaagtgggatttttaaaaagggaagtgatgaatatttacttcatgaccagatgtttttataaactgtggtcagtgctgtagatcgatttggaataatttgatagtgatagagggattcatatggtaggaattgtattaacaagtcacggtggctttgctgatgggatcaatcaatcggcggaaatgatctttggtcagcagcaggatgtggcgcatgtaattttgaagccggatgagggaccggatgatattcatgccaagcttgaaaatgccattaaggacttttcagatcaagagcaggttttatttttagttgacttgtggggtggtacgccatttaatcaagcctcgagtctgtttgaaaagcatcaggatacctgggcaatcgtaacggggatgaacctgccgatggtgattgaagcattggcctcgcgaatgaccatgaattcagcccgagaaattgctacacatatcgttgaaacggctaaggatggcatcaagaccctgccagaagaactgatgccaaagaccaaggcgccagctgcaccagccagtgccaagccagccatcaagggagctattccagaaggtaccgttatcggcgatggtaagatcaaatacgttctggcacgggttgattcccgacttttgcatggtcaggtggcaacaggttggaccaaggcaactaatcccaaccgtattatcgtcgtttctgataacgtcgccaaagacaagctgcgcaagaatatgatcaaacaggcggctccaaccggcgttcatgccaatacggtgcccattgccaaaatgatcaaggtcgataaggatccgcgttttggcgatacgcgggccatgctgctgtttgagacgcctgaggatgccttgcgcgctattgaaggcggggtcggcatcaaagagcttaatatcggctcaatggcctattcagaagggaaggccaacgtaaaccaggtcttggccatgaaccaagaagacgttgatacctttagaaagctcaaacatctggggattaagttcattgtcaaaaaggttccctccagcaatgctgaggacatggacgctttgctggacaaggctcaaaagctgatcgatgaacaaaagaaataaggggttttgattatgtctgcgatttcaatgatcttagttgtgattgtggcatttttggctggtatggaaggtgttttggatgaatttcaattccatcagccactgattgcctgcacattaattggtttagtaactggccatttggttccctgcgtcatgctgggcggctctttgcagatgattgctctgggctgggccaacatcggggctgcggtggcaccggatgcagccttggcagccgtggcctcgacaattatttttattcaaagtggcggtgagatcaaacagatcggaacggcgattgcggttgccattcctttggcggtagctggcttattcttaacgatgatcgttcggacgatttccgttgcaattattcatattatggacaaagaagccgctaaagcaaacttccgcggcgttgatctatggcagatgctggccgtcagtctccaagggctgcggattgcgattccagcagcagccatgctgttcgttcctgccagtgccgtccgcgcctttctgggatccatgccggcctggctgactgatgggatgacgattggtggtggaatggtggttgccgttggttatgcaatggttatcaacatgattgccagtcgagaagtatggccgttctttatgattggttttgccctggctgccgtttcagaacttaccttgattgcaattggggcaattggtctggcgttaacgctgatgtacctgtctttggaatccaagggcggttctggcagcaatggcggctcgggcaacgataccggtgatccattgggcgacattttagatgactattaaaattcaagggagcgactgattatggcagataagacggaaaacaaaattagactatccaagcgcgatcgctgggacgtctgctggcgctcaacgtttctccaaggatcatggaactatgaacgaatgcaaaatggtggttatgcctacgcaatgattcccgccattaaaaagctttacaagaacaaggacgatcaggcagcagctttgaagcgccatttggaattcttcaacacgcacccttatctggcctcgccgattattggggttaccctggcgttggaagaagacaaggctaatgggactgctgttgatgacgttgctatttcaggggtcaaggtcggtatgatgggaccattggcaggtgtcggggatccagtcttttggtacacggcacggccaattattgctggtctgggggcctcaatggcaatttctggcaatatcgttggaccaatcctgttcttcctgctttggaacgccatgcggattgcctttatgtggtacacgcaggaatttggctaccatgccggctctaagatcactgatgacgtttctggcggtcttttgcaaaaagtaacgcgtggcgcggcgatgatggggatgtttatcttagggaccctgattgagcgctgggttacgatcaagtttacgccagtcgtttccaagacgccgctgcaaaaaggcgcctacattgactggagcaagctgccaaacaatattcattcggtacaaaaagtattgactgaatggaacatgggcaagggcctgtcattgaccagctataaggttacgacgctgcaggataatctggaccagctgattcctgggctggctggactgctgctgacgttcctttgcatgtggctgcttaaaaaacgggtctcgccaatcgtgattatcattggcttgtttgtcttaggaatcttgggtcacgtctgcggcctgctgtaaggtgagtgaaatggttgaatcaatcaatgccaaagtcgaatacgtaacggacggcacatcttttatggggcccgtatcatatggcaagattatgattggcgatcgtggctttgaattttatgatgaccgtgacgtccgcaattttatccagattccttgggatgagattgacttggtaattgcctcattggtatttggcgggcattggattcctcgctttaagattcgaacacggcataacggtgagttcatctttgctgccaagaataccaaggcaactttgcgcgctgttcgcaaacacgttgatcctcagcatatggtcagagcgttgacgtttacgcagaaactaaagcgcggctggtaagggatgcacaatagtcgcaagcattcaacaaaataaacgattgattggcacaagagaaagggcgcctcaggactgattcaacggtcttgaggcgcctttatcgcaatcaaaaatcccgacttcaagtatcaagccgggattgaaatcaattagaatttaaattcgggaaaccagatcttaatctcacgcgctgcaccatcaacggtgtcagaagtgtgaataacgtttcgcaaaacgccatctggccattcacgaccgaagtcaccacgaatcgtcccccattcagcttgaccaggattggtagccccggccatattgtgaatggcttcaacgacattggttccggaaacgaccatgccgacgatcgggccttccatcatgtaagtaaggatttccggccagaacggtttgtcagtcttatcgtaatagtggcgctcaagttcatcttgggtagcgttgatcatcttcaacgcttcaatccgatatcccttgcgttcgatgcgagtaataatgtcgccgatgtgacgcgtctttacgccatccggttttaccaaaaccaaagtgtattcatcttcgaccatattagcggcctccctttaacaaattatgttattagcatatcatatcgcctgcttttgtcaagaaatcgctttcaaaataaatgatttttcttttcgtgtggttaaacgataggctttcgaattttcaaaatgaagatcttattttcatgccaaggctaaatacttgaaaataagacgagaatcagtagaattaaactagcatagttagtcagagaatgatagccggttttaggacagactggctaaaatcgtgattagatgattggtaaagagagaatcagcagctgcctaatactgttgaattaataacagcgcatccaatgttcagttttgaacgcggattcgctgttttcttttgaaataaactaatacaatgtaaatgatgaattgtgaatagtgaattgtaaaaaaataaacagttaacaataagtataataatagtgaaaatcactgatattaaggcattttatctatcgctcagtaacctgtatcaatgtaaatagtgaattgtaaagaatgaattgtgaacagtgaattatgaatagcaaattgttgattgatgaaaagacgtttgttaggtttaatgattttaacggtttcgcactgatgacttagatcttgaatgttttgcctaatttctctagccagcaaatctaataatcgactataattaaatcaaaccatgcggaaggtgagactatgacaagtttattaatgatgtctgacggctgggggcttttctgccttttagtattaggcttgtttttaatgctggcggttggctttttatggggcgatttttgtcggcggatgcgtcgttaccggctagacgtgctgtcgcagcggcatccgatctcttggcagattctcccgttggattcgcctgaggcactgcgcggcttgcggatctttaacggttttcacaagacgcttgaagctgccagcgagcatctggccaataataattgtgatgcagctaagggaatcatggatcagtacatgacgccactggaatccaaggcctttttgcgggaatgcgagcagcgcgtgtatgaaagtcggcgtgaattagacatgcaactagatctggtgcgctgtcgtgaagtcaagctggaaggtcaaagaacgatttttgagctgacgacgcgccaaaatggtcacgagcagcgtcccgatggcaaaccggctgctgttagctatgaacgggttgatacgtttatctgggatgagactcatgagaaaatgctgcgaatctggcgaggcggggctactggtcaggaactagaaatctggatctcgcagtttgtctacccctatggcaaatactggcagcggatgcgcaatgctgctttggcagttgccgtactgctgatcgtggctgcttttgtagtcggcatttgttttggcagctggccgatcaagagctgggagccaatcatctgggcctgcatcatgctttatgttggacttggcctgttgttttcgcctttgattaattcagatcgagatgtagcggctgaagagtatgttcgttatttcaatcgataacctaatatacgttttattaaaatttgtttaacagtttcatgatgggtttttaataaacattaaatatcgtataattaatttattctggtagtcagttaataatgtcaaaaatgtcctgctcgatcaatgcaatgtcattaagcactgagcttgacaatattattagccatttgaggtcatctgattagtgaggcaatcacttttggatggccttttttgatgtctttgataaattgaattggcaccgacgattttatattttcgtaaaatgggtgcagaaaatcttagcattcgcgcaagatttgtcagttgctctgtgatgagttacgcccgattatgattcaaatattttcgtaatgttaaactaaatagcaacagcattaatttacattaactaaaaataatagataaaattcgaaccaataattaagtgaatgtttggcgtcaataaaataatgacagcgaccaagaaaatgatgctgattataatgagagagtagaaaagtggcaattcatagttagtgcctcaagaaaacgtaagcacaccatattgaaccgtgttgtctgctaagcagtgggcaatttcaaaaattaaagaataaaaaagcagcggtcgaccggcgcatttctgcgtggtcgaccgctgttcatttatcaattaggctttggcagctttcttgaatttcacgagtccatggcaataagcctctatttctggcgtttcgcgttttgtaaaggcgctaagcagggtctctaaatatttaaagacatccaaatgatttagctttgcggtttgcacgatgctataaccagatcgcattggctttggccccagccgtggacttcgcaaacaactgttctttctgaccagcatggtgggacgaatcagttgctcattgtgattattatgcaatggcagctctccatgcctgaacatctggtaaacccgtttcttcaatttgagggcatttttgatcgcattgcgtagcggtttgagtggcgatttcgtcaaggcttcttccaatcagctgatagaaatcatcaatcatcgcttttaaatgctgacctttggctgccttctcacttgctatgaatattccaaccgtttttcgacatgaaatactgggcaaggatccgcacagcgtcactcgcaatactttgcccttgaaagcgagtaatctttggatcaagcagtcgcttaaattggcgattgatatgaaccagacaggtccccccaatacgcttctggtaagcgattatcagaatatccactaaacccatcgcacataatacccgccagaaaagtcatcacctaagatttctgtaataacctttcctgatcgtgaaggggcatagtggaaataagatacctgatgcggactgaattcttccgtagaacaggctgaccagaagtagccatgtgattgatcaagatccagaacttgaaatggcgtctcatcaagctgtcaccacagtgctgccttgatttcttgacgcagacgttcataaatcttttgcccaaacctttcgccagcttcaattaccccacgagccatatgtttactggtgattggaagcccgaggcgctcccaatactgcgtctggcgggtaaacggtactgccaggccaaacttttcaaaaagtactctcggcgattaccgagcttgaaaggtaactgtgtggaaacaaaggctgtggcgtctttgcctgaacaagtacaatcattgccagtttccggatcttgacagtgttcgcatctagccgtttcagtacatacgattttgcagcacaagtgggcaggaaccagtttaacttcacgatactgttcatgtttgccgataaccgtcatcatttgaccgcattgatcacaagttagtttcttgcttactcagctgatgaagttcttcacttgttctaagcaatcaagccattctttacgtgattcctttgattgcattttctctgatgactggtaacggtagtggtcaacttttcgactgttgaatcttcgttggcgtggtttccgttttctttatcatcaaacagatccactggccagcacttaatttttcagttttttttccaaaagttgcttttgcagatagtttaccatctcggtcagttccgcgatcttagcctttagttctttgttctcacgcaaagcttcttctagagtgatcttctcagccattaccaatcacctcctctattatctgatgaccattaggttatcagataatggaggcaaataaaagaggaacttgttaataccctggtcccttaatagctggcctgattcgtttctgaggcagtggcgagataccttctaacaatgccttaatctgactcttggttaatgccactgcgtcttctcgatgtcgcggccatcgtaatccactattttcaaagcgtttatagagtaagatgaatccttcaccgtcccagtataagcctttgaagcggtcattacgattgccacaaaacaggaaaagcgaatcattatctattcaatcaagccataattctctgcgatcaccatggccaaaccgtcaatgcccttccgcagatcggtcttgccacaaactatgtagacgtgctgaggagcactccagttaaccagcataagcggctactgctttaatgatctcactaaccaaagcgggatctgcttcttggtagacattaatttttacttggtgcagtgaaacgatagctgccaagcgtggtgcttagcaaccggcttctttgtcgtgcggtatatcaacttcgacaaaatcttgcttcataaaaaagtcctcctccttgaatatgtcttcaagtataggagaacttggaatttaatcatatgcggttggttatagtgtgcttacaagaaaacttgtgttggaagcctgataaaacgattttaagcagatctggtaagaaaggcatccataatgataagaaacaaagcagcaatcatatctcaaatgaactcagataaaaaacggcctgaccgcaggaaagtctgctgtcaagccgtatcaatgaatttgatttatcatacaattttagaagaaaacagtgcctataaaatgttcaatacggtactgttttttatttagcgtcatggtgctgttgttctttaagcatttgtttgatttccaacagttcctgatgcagctgcttattttcggcgtgcagcttggcgatttcttttttggtgacctcatgcggattggttggttcaaaataagtcgtgatcgtactggtcaaaagtccaatgatgctgacgcctacgaccatcagcaaaactgcggcaatccgtccccagagcgtagtcggcgagacatcgccatagcccacggttgaaacagttgttaaagcccaccaaaaggccgttgaaaacgaaacgccctctgagatgctgtacatgccggctgcgataaacagaattccacagctgaggtaaaggtagtagatcagaccatccgtgtgaaagaatcgttttaagcggaccgtcagaccaaccaggcgtaaaagccgcaagacacgcagcatgtgaaagacgcgggcgacacgggcaaaacggaatagcgtgaagattgagttggtcgggatgattgagagcagatcccagatgttttccttgaaaaattgaattttgtcttttgcgattgccagacgtgcaaagtagtcaaccaccagaattgcccagataccgcgatcgatccaaacgtaaggcgactggctgagattaatggcatgagcgcagtcaaacaacagcagcagaattgaaattaaggcgatcagcgcgataaatagctgatagagtaacagaattttgtgtttgtgaggattcatagttaattttcccaatagtatagtaattaattaaataataattcgtttgtggcaaggtgacaatagtttggtgtgatcaatgcttcaattttgcgttgaattttggagatttatgactgtattccccatgcctgcgggggtgatcctcaagaaatgtattttgatcttcgtattaaatcagcaattgatcacaaattatttatccttaacctgccataattgtatattttcaaattgccctatatatactttgaaaacttttatttttagaattgcttatcaaatttaagctgtaaattgatgacggtcttgcttctgaaaataaaagtgttacaatcattgacaattaaaagtcaaatatacttttatttgcgaagtttaaagtattttttacctaaacaaatcaaaagcattaatggcaatggaacataggctattagtttggtattatcaaatgcttctataatggacaggcttttaacaatgtcaactttatggctggtgtggaattaatgaatttgatttgatgcttggtattcaagaggagtttacgtatgcgagataaagataaaattttaggggcgctatatgggcaagcaattggtgattcaatgggaatgcctacagagttatggccaatccaaaaaattcgacgtaaatttggtcaaaatattacaacctttttggatggtactgatgataatgatattgccattaattacaaagcgggagaatacactgatgatactaaccaagcatttgcaattttggatgcgttgattgagacggattggaagccagacaccaagactttggttaagcatattttgcaatgggccgatgctgctggggcatggactaacaatgttttagggccaagtagtaaagcagctcttaagcttgtaaaagaaggcaaggatccttctgaagttacgaaaagcgcattgaccaatggttgtggtatgcgaattgcaccaatcgggacgctttatgaacctaaagactttgataaattaattgaaatggtttatgaggttaccagaattactcattccagtgatgttgctatatcaggagcagcgatgattgcgggggcggttactgcagcagttgcagattatgactggaataacattattgaatacgccaatgaggcaaatgatgcagggtttaagttgggcacgccaacatgggctgcacataataaggagcgtttggaaatcggcattgaccttgctcataggtataggggtaacgataaagcatttagtcaagcaatttataatactttaggtacaggaactgcaatttcagaaagtatcccagcagccgtggcaattgcctactatgctaaagacgtaaaaaagagtgcctttatctgtaccaatttaggtggggataccgatacgattggtgcaatggcaactgcaatttgtggtgcaaaagttggtgctaaaaatattccggaagactggaaaacgttgattgatgaaaaaaatccacaacacaatattcaggaatttaccaataagattgctgaatttaaggcttagaaaaaatgaggtgaattatattcatggataacgaatttataaaagtacccgaaaaagacaaaacattgagtcccagtaagcttttttataactggtttgctgctaacgttgggattatggggtttgtttatggagcaattattgtcagctatcatttatctttttggcaatcaattacagcggcattgattggctcactgactttcgcaattccaggatgggttgcgatgatcggtcagcgtgagggtgttacaacgtttaagctgagtcgggcggcttttggaatttacggtaacaaaatccctaattttatggcttgggtaaacatggttggctggcttgccgttaatgtaatcacgggtacgttgctgttttctgcgatgcttaaaactattcatattccacaaactggttttacaaagtttatatgtttagtgatttttgcgggattggtttttctgtcagggatttttaatgaagacaccttagccaaaattcaaacatggttaagctggatttttggtggattaactttagtcatgctgattatgtttcttgtaaatgcaaaatgggaagaagcatttgcaatgaagcaaggcagttggctaacaggatggttaccagcagttgcctttattgctgccggttcgagcatatcatggtcaatggctgctgccgattggggcgcctatgttcgtccaaatacaaaaccagcagccactttttggaacactactttaggcgctgctacgccgttatttttcttaatggctggcggggtattgttaagcacgatttcaccaagtttagccagtgcaagtgatccctatcaggtaatgtatggtgcagttccagggtggtttggattcctttattttctggtagccgctggtggcattattccacaatgcttggtttcatttcgttcagcacgaattaatctcgcaacgattggaattgaagtgtcacaaaaggcatcattaatcttacatgctgtaatcattattttaatttctgcttatgttttattcgtttctggtgacttcttaagcaattttgaattattcttgaacttcttgggtatctgtcttgcttcatgggttgctattttcttggcagataatgttatttaccgtaagaatggctatgatcttaaactgatggatccaaattcaactgtacattataactggtctggaattgtttcttggatcgttgcaactatctttggctttttatttacgtcaaatgacatataccgggggccatttgcctatggtatttttaaagataatagcagtttggctgtttttatttcaggaattgctgcaattgttgttatgcttattttctcgttgattgcaaagcattccaatcggctgaaaggttaagaatatggtggaaaaaagtttagttattggtgctgctttcgtagacgtaataatggatgttggccatttaccgacctcagggagtgacgttaccgcaaatttaaagtcttataatgttggcggctgtgcgttcaatgtctatggagcgattagacattatcttggtgctgaccgggttgatctttttgtgcccgtaggaaaaggccagtatagtgaaatgattcggaaaactatgaatagtagtaagattccgattttggcagaagacgattgtcaagataatggttgggacatttgtctgattgaacctagtggcgaaagaacctttataacgattccaggcattgaacaaaattggcaagcagaatggtttaacaagatagacttgtctgactataagtacttttatgtaagcggttatgaaatggaaaacgcagaatcggcaaaactgctgttagattacttagcacaacgcaatgccgattcgtatattatctttgatgcttcaccaagaattaactatattgattttgaaattttagaccggctcttatcgaaaggtgtaattatcaatgccaatgaaaatgaaattggctttcttagtgataaagatacattggccgaaaaagctcaagacatcttttgtaaaaccaatgaaccagttcttattactttaggtgctcggggaacttatctgtatgataagcatggcggaaaaatcatcggcacggataaagttaagaatatcgttaatacgattggtgctggagatactcactgtggtggagtaattgccggtctattagagggcaattcttttccaaaagcatgtcagattggcaatgagttagccgcacaagtcattcagcaagaacctggatatttgagctaaatttttaatgtttaatgaaaatgtttagctaaaaatcttgtcaaaaataattagcataataaaaagacatggcatcttcaccatgtcttttttatcaatcattgtttacttaagttgcggcgtttgatcagccaactggcaactgcagccaaaagcatccagatcaaaccaaacagactgattttgcagccaagagccaaacctggtacgtggtagtgcaggacaacgcgatgagttcccgcaggcaggcgcagaccgacaaaagcctggttggtccttaacagagtggtttttttgccatcaacggtcgccgtccagcccgttgaataaggaatcgaagaagtcagaataccgacccgcgaagtcgtaatcgttccagaaagttgattacgcttgaatttaacgtttttaagcgcatgtttttgaatctggcgaacttcttgattgtatttggtccccagtttttcggcaactacttgataccgccattgataggtccccagcttagaaggcttgagagtcaaagaagtcggcattcctttagcaaagtagccaatattcatcgtaccgttttttaccagcttgaaaaatgaaagcttgctttgcttaggctgttctatggtttcggaacctaaacgactggaaatcttgatggcaaaactcatatcaggtgaaccgttcagaatatggtagcgccagaatttatactggttaaaacgatgattgacgatatcgcctggattggtggactgctgctcttcatgcttttgctcataggcaatctgctgtttcattgaaaacggctgatacttgatcgaagcaaactcaacgtgcagttcgctgtctttgagctgttttttgaatgccttgctggtcaactgtggcagctgcagctgataggtttccagactgtcagtatatttaagaccggttgacttgattttgttcaaacgatttgaaaccagctgcgatttaagtttgatgacgttgcctttcaaattggcggtcttcattccgttggtagcgccgctgtttttagagctgaccgtaaccccactggccaaggcacgttccttggcagtaggcgacagcttctggtaggtcttttggctgatgtaggaatcctgccaataaagcagcggaaaggcattattcgtccgatagcgattagtcgtggttggaatcagttgcgtctgatcggtcgggttggtaggctgcccgacgtcatagttgattttgggttcggtagtagcatcaaggaaatagccgcctggaatcttattggcgttctcgctgttgctttgcacgaacagatacttgacgccaaagaaattatttaaaacggtccggtcatcaacctgacgcaaagggacgttggcttgatactgagtgttttgcagcgaggtgctgaactgtcccagatacttgttttgcagggagtagtatgaatcgatattgtgcatccctgaggtcagatcattatccaaaagcccaccggaagtaatttgattgttggagatcgtggagacccggaaaaacgagccgtcgtttaagcctttttccaagccgccatagcgattttcggcaatcgactgatactggccgcgtaccaatgtactgttggcgaaattgccgttataaggcgtaccgacatacagcgcgttgcaggcagcgttggccaaaataatcgtaaccagccagcgatcaggatgcggcgtgccatgcaggttaataatccaaagcattaacagcgacatgatcaaaaagatgatcggcataaacatggtcgtatcgttttggaaaatataggttgccaccaagacgaccagatagatgccggtcgcgctggttaagatccaaagcgtatgccgatcaagacgggtcgcattctgcaaaagcaggcagaccgtcatggcaatcggcagatagatcagcagcgtccagcgattggaggccgccatcatgccattgaaaaatgcccccactgccggaatcagcagcataaccaatgccagtgccagactgattgataaaagcggaaattcgcgggttcgcgtataaagatagacgatcgcgataaaggcaatgctgaccaagcctaatgccgaccagaacataaacgtccactggtcaccattgatcagctgtttgggcagaaacagatagtagtagagcggatagtgtttaagaccattggcaaattcagaaccggcacgagtggaattcataacggccatgatttctggaaccaaaaggcaggctgcgactagaatgctggtaattgcggcaaaggccagcttagccagggttttgccgtagttaagcgtggttcgataatgagttgccacgcggagtaccagatagataaaagtgccgattcctaaaacatacgctagatagtagttgttgaccagcatccacaagaaagccaaggtaagcggccaggctgagccgttttgcaggactcgctcaagctggacgaccagaatcggaaacagaataaacgtcgtcatgaaaaacggctgggcgatgctggcatacaacaggtatgagttcaccatatagactatagcaccacctagaataacgtggtcgcgaaaagaaaaatggccagcaaaccagcagaacgtcaaaccgacaaagtacgttcgcacaacggtaatgatttgataggccagcgttagtttagctgctgggaataatagtgccagataggcgaaaacgtcaccaatcgtatagtaggaaaagacctggaaagtatcggtgcccagtcccatgttccaagaccaccagtttaatggccgtgttggatgatggagccagcccaggacgattttacgatattcgccgagcagcggtacgtgctgatttaaggcatctttattccagatcaacgtatgtccggtgatagcatagctgccgaacatgcacagcgcgatcaaggcaaacattatcgtatatttcagatacagcatgcgatgatcacgcttttcgaatgagaagttcattgaaattgctccttaaaataaaaagtacacccttctattctactatagatttttgtaaaccttgccaatgaaaatattaaggtattttaacgaattactggtttttaaatcgggttggtctgcagcgctctcaaaccaagctgatcggctgttcaaaaataagattgccaaaagtatgttcgcctgttaaaatataaatagcgaacatatgttttaatagagcttaaggagggaatcaagatgtcatttgcgttgctgtatcgatcgcttagccgcactcgctggtattggtcagtcagccaaaattttacccaaaaaagcgagcggcagtttacctgggagtcggctgcggatctggctgccgactatcccaaactgagatcgcgctatcctacgctgtttgccaagaaacgtgccgaggccttttggatttatgacctcgcgcatgatgatgcaacgcgactgtcgcttgatgcagatgacagtgcagatatgccagctgatgatgcaccccaagcagaaaccaaaaatgataaaataatcgccgttgattcaccgacagctgttgattcaatggctttgcaaacaagcacgtccaaacagcaggggaatgatcccaaaacaccagaacattttgcattaatggtagatggcaaaaacaatgcgtcttgctactacagtcggacactaaaaaaattcgtggtcaaggtcaatgagcatgcctcggtctgggaccggcgcgattctgctatcgatgtgggtaaagaattggcaatcaatgattcattttggcttggtcatgctgaatatgaccgtgcaacattgcggttggtcagagtcgaggatggcgaacgaatctggccacaattggctggggatggcttaccgatgctagagccagagctgattgatcgattccgccaaaaaatcagtgcccatctagatgatgatggtccggcagcgtcaacgatgagtctggccaaggcagcacggcatgaggttgaaacgatcgattttgaaagattcaatttaaagaagattctcgagaccattgactatttgatcgatgcattacggcttaaagcaactgctgaacgccagctgaaagtttttgaccaatcgattctgcaggactatctgcacgtaattgaactgactgagcttgaccagatcgatgcgcagaggctggttgccagtctgcagacaaatcggcgggcacgtcgtcagattaaagaccttaagatcatcttatcggcgctggctaagtcgtttgatgttcagcagttcttgaacattctgctgtcagagccgtcattgggcagtcaatactattttcgtgatcaggcaacggccacacagataaaagaaatgattcattaaaagctggtgaccgcggctttcaagtagagaatcagtcacgataaaacagctctgtcaacaaaaaaagccgcctctaaagaagacgacgtttagtttagcgttcaaggtaggcaatcaactgaggcagctgctgttccatttcaagcaatccctcatcatgaaagccggccagttttttgacattattttcaaatcggctgaccttaaccggtttttgtggcgtaatgcagtaaagctcttgattggcaaaagcagcgtcaatctcattgcatcgctgattatatacttctggccggttgatgccttcttcggcaaaaaccggatagtctttgtactggcgacgataaagcgccttgaccaggggactggaagactttttgcgataagttgcctcacgcgttctgacgacgacgatcttatcgaatccttgttccttagccagatcagtcgggatcgaatcagcaattccgccatctagacaaggtccttgatcagtcagctgcggctcaactaaaaacggcattgaactggaagccttcagagcagttaccaaaccttcccgccggtagtttacaaagtcaattcgcttgccagtttcaattgaggttgctaccgctgtaaagttcgatgcggagcgctcataggcatgatggtcaaattgatgccagtcccagccatggtcatcaaacaaaaagtccagattgagaatgtcttcgtgatgcaggccgcgtttgagcgaaacatagtcagaatcatgacggtagctggtgttgacgtgatttacatacccatactgcttggccacgtaacaggcaccgcataaggccccggcagaaacgccaatcacgcttttaaactcaatatgatgtttaagcaggcaatccaagacgccagcggtatactgacctcgaaaagctccaccctctaaaactaatgccgcgttgtaaagcattgcaatccctctctcttcatgcatttaatcgtattgattataataacacatcgcctaacaaggatcattaagccgcaaaacgaccgcaaagccatcgtcatgaacagctttacggtcgcataattaggatttttaattttggctggttcgcttttcctgttcttcagcctgtttttgaagctcacgattgaccagttcgggatcagccttgccggggttgagttccgtaattttaccggttgccgcgtagattacccattcgaccagattgacgatgtgatcgccaatccgttccaacagatgaattacggtaatgtagtgactgccatccttaatcagttcaggatgggcatgcatctggtcaataattttttcatgaacctgtacgtactgcttgtcgacttccaaatccatgttggcaacggaataagcggtctgctcattgatgtagacgtaggcatcaagggacttttccaacatatgacgcacggtttccgccatctcagcaatagcgttttcaatatctggccagtgctgatccatgtccttgatgcggatggcgtctctggcaatatgagacgcgtgatcagccattcgttccaaatctgagctggccttgaggatgctcatgattgaacggaactcatcttctttaggtctttgaatattcatcagcttaaaggcgtgtttttctagataggtttcgccatcattgatcagccgatcgttttcgttgacttctttggctagcaccacgtcacgatcaatgaacgctttggttgccttataaatctgttcggaggtgttgatccccatttccataaaccggccacgcagtttttttagctcatcgttaaaaatctcgttcatatgatctctctcctttatggggcatttattcataaattactatacttgtctaatgtaaaaaatacgtaaatttggcgtaaaattatcggaatttatcgaaatttcgtaagtattgcgttttaattagacttggaagagaaaaggggatggagaattatggagcagcaacattttctgctcattagcaaagacatggctttatacggagcaattgccgccgcgtttgcggatgagggatggctgctgcaccagacgactaccgcggtagaaggggttgccaaaatccaaaagcactcatacagtgggattttatgggattttgctgctacgccattggacacgattttagcaacgctggacgtcatgcgtcagatgatgaatggcccgatcatcatcatgggcgaggcgtataagcctaaggtgcgacgcaagctgtttcgttttcatgccgatgactgcctgccaagatcgctcaatgatgctgaactgctggtaccactgatcagacagcgcttatgggtctatagtcaattaaactcagaagaatcatctaacaacaagccacgacgccctcaccgtgatgacgttacgattggtaatttaaaattactttttgatcatcgctgtgtttatgtcaatgatcaaaaagtaattttaaccccgaaagagtttaagctgcttaaatacctttatgataatcgcaatcaggtcatcagccgcgaacaattgttgaacggcgtctggaactacgatattttaggcacttcccgcatggttgacattcacattagtcacctgcgcgataaaatcgaaaaagatccgcatcgccctgaatggatcaagacggcacgtggctttggctatctgtttgacacggctcatttggataagtagtttttttgtgtcataattgacataaacgataatttgaaggagaagaaaatggcatttccttttaaagcggtggcctttgatatggatggcacgtttctgcgtgatgacaagacttttgatcgcaaactgttcagccagctgttggatcgactattggcccaagacgtacatgtcatcgtggctagcggtgatcagtatgagtgtctgttgaaatactttccaactcggcatgaacagctaacctttatcagtgaaaacggcgcgcacgttattgatcatgacagggagctgatggtgcagaccatggatcctacggtagttgacgaactgattccgtttatggtcgagaaaatggatctggtgccgtcgctttcaggtcatcagcacggctatatctcgccaaacgtttcagcatcacggctcaagcggctgcagttttattttcccaatcatatttttattgaagatttcaagcagctgccagccgatcgtttctatcagatatcgtttgttgttgagccagacaaactgaaaggccagctgcagaccttgcgcagccggtttggcaagcggttaaagatcacgccaagcggcaacggttcggttgatttaacgattcctggtgttgataaggctcaagcgctgcaaaagatgcttactcaatggcaactgacagctgatgatctggtggcgtttggtgatggcggcaatgacgtgaccatgcttaaaatggccagagtcggctgggcaatgcggaatgccagtgcaacggtcaaacaggcagctgattttacggctgatgaagacaacaatcatgatgccgttttgcatgttctgcagtcctatctataattaatcaaatatgaatggccttttgcataacgtcatgcggaaggcttttttaagaggtgatcaaatgcatcaagaatcgctttttgaacaggcaacgcacgaaccactggctagtcgtatgcgtccccagaccttggatcagatcgttggccagcagcatcttttggcacctaaccagatgctgcgtcgcttgattgatgctgatcgcgtgccctcaatgattctttgggggccgcctggcgtgggcaagacgactttggcacgggtaatcgcacggcataccaagtcggaattcatctcgttcagtgccgttaccagcggcattaaagaaatcaaagagcttatggtcagcgaacgatcgtatttgtcgatgagattcatcgcttcaacaaggcacagcaggatgcatttttgccttacatttttgccttacgttgagaatggtagcatcgtgttgattggcgcgacgactgagaatccatcgtttgagatcaattctgctctgctttcgcgctaccgtgtctttgtgctgcagccgctgtcaacggatgatctgcaaaagatgctgcagcgcgcggctcagactggctttgcgcgtccgattcagattgatgatcgtttattgagacaagtggcgatttttgcggatggcgatgcccgtacagctctcaacacactggaaatgctggttgataatggtaaggttgatgaaaacggtcggcttacggcagcggacaatctgttggagcagctgcttggtcataaaacgcttaaatatgataaaaaaggcgagcagcactataatctaatctcggcactgcataaatccatgcgtaactctgatgttgacgcggccatctactggctgacgcgcatgctggatggtggcgaagacccattatatattgcgcggcgtttggtacgctttgccagtgaagacattggcctggccgataccaatgcgttaaacgtcgcggtcaatgtctaccaggcctgtcagtttctgggaatgccggaatgcaacgttcacttgacggaatgcgtaatctatctggcgactacgcctaaatccaacgcggtctatgctgccacgcaaaaagtccaagaagacgttgaaaaaacggccaatgagccagtaccgctgcagattcgcaatggaaccaccaaactcatgaaagaactgggctatggcaaagattatcagtacgcgcatgatacggcggctaaaatgactgcgatggaaacgatgccggctaatctcgtggggcatcagtattattacccaaccgagcagggcaatgagattcgctttaaacggcgcctggctcagatcaagaactggaaacggcagcaccgtaacgatgatgggcgaacccaatagttgcaggactttaagatgacgcagctaaagaacagaattttaaatggcgcatcaaataaataaaagaggcattctgctcacagcagccgagtgcctctttttagtagctttaagttgatcaaggctagccgtccatcacgatcccgccatcacagtcgccgatctcgccggtaataaagctggccgcgtcacagccaaagaacaggatcatttgagcaatttcagctggtgccgcgccacggccaagcggaatcatacttaagacccgttgccgtttttggggatcagcttccaatgcggccgtcatgccagtgtgggtaaaggaaggacagaccgcgttggcgtagatgccatacttagcgccttctttagcaattgccttggtaaagccgtttaaaccagctttggacgatgcataggccgtcgttcccaacaagccgcccccaattttaccggctacggaagaaacgttgacgattcggccgccgccattattcttgaagtgttcccagatagcatgaacggtattgaaaggtccagttagattgacggccagcgttcgatcccattcagctggcgacaattcatcaaacgacttggcgctgatgatgccggctacgttgatcaggacatcgatacggccaaagtcatctaagatctgctgaaaagctgcatcaacggcatcgcgattgctttgatccatggcataaggatgggcgtgctcgccaagctcagcggcgactttatttgcttcatcaagcgtcaggccaatcaaggcaaccgagccgccgccagcaatgatgcctctagcgacttccttaccgattccgccagtcgcaccggttacgataacgtttttaccatcatagtcatagcgcataatggatccccctttaatcaaatacttgctttcattatagtctcaattgtgagcaggggagtgagaaattgaaatcaatttccatttaataaactagtagtaatttacattaaccaaactcaaaaaaaataagacaccaccggctttagctattcataaaccagcttaagaatcggctacgtttacaactttaatttgactttcagcagcaaagatggaataatttgattccgatatctcaaaacgtcttgacaactgaaaaaactggtgttgaggcaatgacttgatgatcgtcatcgggatatcgttgatcatcagagagaggaattgatatcatgacaaagaaagaagtcgtaaaagccatgaatgatgcggtattggttcgcatcaacgactggcgctgtgctcaagcctacctgattcaaaaagtcttaaatgatggtaaggtcttgttgcggcgggccaacatctcagttgatggcaaggctgtaccgactgacgaaaccaaaaatgctgcctggagcgaattagaaaagctgcagttagatttttagttttcaaattaaagtatttatggaagatcatctgttttcgatagatgatcttttttattgacataatgaattgtcagctgtagcctatactaatttctcaatttattttgaggattgacttgaaactggtgcatgaggctttggcagagtcgcccagctggctggcttatcaatgaaccaaggcgtcaggcaacgatagctgtttgattcctagcatcaaggcttgtagtgagtcttgatcgcggtgaaaaaaagccgtgttcccagtcagtcaggtaagaggttaatagatccgatgcgcgtttgcaatatcccatccacagtcaattaggcctgacaacctaagacccaaagtggaacgtcactaaaaacgttcgccgtgatgctgcagtgatgcagctataagcatcgaggtcggtccgagtcggtcaaacggcggcatccaatcaatacttgatgaatgcttatgctgaccaaaagctggtgggtaccgatcccagcccgtgccttgtttaagcgacaagaggtcatgatcgataggtcttggctaagtcttgtcgagcccgttgcctaatcaactattaacttcacgccacgcaaaccaatgcgcaagtctgaatgccagtctagctcaaaggaagagcagttgccaaacgatgcaagttcgattcttgcgactgggttagatatcaaacagccctcaaggcacctgatgtttaaggtgttttgagggcttcttaatataaataaattagttgcgcagtttgagcatcccatagtcttcaaataaattagccagctgcagcagaacatcttcgcgacctttattggcagttaattgaattccttgtggcaggccgtctttagcaatgtaagtgggtaatgagatcgcaggctcgcctgttaggttggcggcttgcgtaaatggcgtgcggcttagcgagtcaagccattgatcatatatcagctggcgttgttcttgtgctgtcagctgattgattctttgcagacgttcatcaaagacagcagcatgctgtggctcatcaatacgataggggcggccagccgttgtcggggtcaagagcacatcaaattgttcgtgcagcttagcgtggagggcactggcctgatcccaaacgttcaatgcattgatgtattcggcggcagtaacatttttgccggcttgccaaagtgcccaggtaaccagctcaatctcattttgtttgacgggacgcttgattgattgttcaatgttggcgaacatggctgcggtttcaccttcattcatcaaataataactatcaatcagctgccggccgtcaatcggatcttcatagggctgacagtcatagcccaggtcctgaagaaaggcgaccgcgtttttgacggcttgcacggcatcttctgtaaccgaggtttttactggcgaggtagtggtccagccgatccttagacgtgagtaatcgtttggtttcaagacattcggattgagtagcggggtttgaaagacggcaggggactgaacggtttgcagggtctccagcaaaagcgcggtatctttaaccgaccgcgtcaacgcgaaattgatcgacgcgccttgccatgaccgccaattgccaggaccaaccggcattcggccacgagttggtttcaagccaatgacgccacaccagctggccggaattctgatcgagccgccgccatcattgcccgcagcgattggtacccagccagctgccacggccgcgccggcaccacctgatgagccgccgggcgtgaactgcggattccagggattgcgggctggaccaaaaagtttggcatcggtaatgttcttatagccaaattcaggaaaatttgtctgaccaataatgataaagccggcattttgaagtgctttgacaaaattatcggtttcagcagccagttgattgcgaaacagtcggctgccgttagtatcaggctcgcctttcattcgctgaccgagtccctttaacagcaaggggacgcctaaaaacggctgaccgtgatcttttagctggtcggcttcttttagggctgctgctcttaaatgaacaacggcattgagggtaggattttctgcttgaatcttatttagtgccatttcaactagttcgtgactggtaagctggtgctggcggatcatttctgccaagcgataagccggtaacatcagtagattcatctaaacatttcctttcagattgctatattagtcatttataaagaggcgtctccagaatcgaccatagtctttgggcgttaggcgtcagcagccgattggcacgggccgccagcgaaatgataaactcgggctgactgccatccgtcaatggtaaggccgccagcccatcattggcatccagcgccagatccgtcaaaaaagagatcccggaatgattggcgaccagcgcttttaaaatctgcacgtcgctagttttaaaaacgattttgggacgcacacgagctagatgagcagcctggcgaaaagcctgggcatgaacgtattcgtcatcaagcgtgataaatggatactgggcggcttgagcaaatgatacgccatttttaaaagctgccaagggatgatccttagccacgataattttaatcggtgccttatcaatcacacgggctcgcagacttggctgttgaaatggctgcagtgatcctaacagcgccagatcaagctcgccttttgccagcagctgcagcagtgaggccgaaccatgatcaacgacttccagctgattgagcagtcctgcctgcagcagcgccggggtgaagcggggaaagtaccagctgccgatgattggcggcaaaccaaagctgatgcgttcctgtttggcacgggccagttccttttgggcaatctcaagttcttcaattatacgctgcacgtgctggtcaaactgaagaccggtactggtaaccgtcaattgatgatgcgaacgatcacgcataaaaaaagtcgttccaaagctttcttcaagtcgtttgatagccatggtgacggttggctgactgatgttgaaatctgatgcgacctgagaaaaatttttggtcctgaccaaatcgtgataataatataattctttaacattcatcgataaacaccgccataataagatttatatttatcatatcaaaaaaatttatggatttgggtatgtttgactatgtagttggccaatttttataatcggttgcgagataagagatataagatgaattttgttgaaagaagatgggttctaatgcgtggatttcaaatacttaatgatccgtttttaaatcgcggtacggcttttactgaggatgagcgacgtcagtatggcttgattggtcttttgccaccgcgagtcaaaacgattgatgagcaggctgccgaaatgtatgccctgtaccaaagcaagggatcactgattgaaaagcgtcatttcttaatggagatcttcaaccataatcggacgctgtttttcaatctgatggttcggcatattgatgaatttatgccgatcgtctatgatcccgtaattgccgaagctatcgaacgctataatgaacggttcatgcagccgcaagatgccgcctatctgacggtggatgatccagatacgattgaacagcgcctgcagaatgcggctgatcagcgggatattcgtctgatcgtggttactgacgcagaaggcattttggggatcggcgactggggcgttaacggcgtggacatcgcggttggcaagctgatggtctatacggcagcagccggcattgatccgcagcaggtattgccggttgtaattgacgcagggacagataatcagcagctgttggccgatgatgaatatctggggatgcggcaccagcgtctgagcggtgaggcttactttgcgtatattgatcgattcgttgccgcggttgaaaaactgtttcccaagagcctgctgcattttgaggactttggtcgcggtacggctgcccagattctggacaagtatcaggatcggattttgacgtttaacgatgacattcaaggaactggcgtcatcgcgctggctggtgttctgggcgcgcttaacatttctggacagtcgattgctgagcagcgtttcttgacatttggtgccggtactgccgggatgggaatcgtcaagatgctgtacaacgagctcatcaagcagggaatgagtcccaaagaagccaagcagcatttctatctggtggatcatcaaggactgctctttgaggatacgccgggactgacgcctaaacaacaggcatttgtccgttcgcgagatgagtttgctgacgcgggcgagcttacagatctgccggcaatcatcaaggccgttcagccgacggtaatgattggtacgtcaacggttcacaatgcctttaccgaagctgccattaaagagatggccaaacatgctgatcgcccaatcgttttcccaatttccaacccaactgaaaagattgaagccacgccagctgacttgattaaatggaccaatggcaaggcgttggtggcaacgggaattccgagtgccacggttgcatatcagggtatcgattaccagattggccaggctaacaatgccttgatctatccgggagtcgggtttggtgcattggccgttaacgcacggattatcaatgatgagatgctggctgctgccgcgcatgcacttggcggcctggttgacgtcaaggctcctggggcaccggttctgccgccggtcagccaattaactgctttttccaagcaagtcgcgatcgccgtggcccagtcagcgattgatcaaggcttggcccagactgatctcagtgcagaacaggccgttgcggcaatgcactggcagccagagtatcagccgtttgatcagctgctggcaaactaccgcaaataaaaattgacttagagtaaaaaacagcgtcagattcgtgctttgtaagccgaatttgacgctgttgccgtttatatgaatgattttagtagacggccccttcataaaagttgaacgaaggctgattaaaattaaagctggccagttcactcatcttgatggcgttgtccgcaaagccccatgacatcaggttgatcggcttgccccattcttcatctggaattaccagcagcacgtacttgccatgcgctttagcccaggcaatctcagttcccatgccgacgtcttcttcatctggaatgtagacggccagtgtaacgtcggtcgtggtaacgcccaggcagtcgcccttaaaggtagccgtggcccattccttgtcatgcaggtattctgggtgctcatcgacgcgaatgttcttgtactgatgctgcagaggaacatagctgttttcaacgtcaatggttggattctgcttgattgccgtcatggctgcttgataggcttggttttgcttatcagtaaaccagccggcgcaaaaataaatggttttgctagtcatcttaaaatctccccttgcttaaaattacagtaactaaggcagggtattaattataacattagccaaattaaaaagtaatagtcgtagatttttaataatttaggagtcatcaacatggccgattttaatgtagcaactaaaccattcccgaaacctaaacagcaatcaggccagctcacgcatgagtttgcagagctgatcaacgtcttgcttttgcgtggcccaactggtggcaaatcgaataatcgtatgcgtttcatcgtatttttcccaaaagctgaacgcaacctgctgttcaagacgagccagctgctgattttcaataataaagaaagtctgattggttggtgatgatccatagagctggtagtcgttttgcttgagacaatcgcgaatttgatcggcatataagatcgcgggccgagcaatgtcgatgtagcggtcatccttaaaaagctcatcaaactgaatgcccaaaagacggcccttggctaagagcgcgccatgctgtttgatcatcgtaaacagatgcagcaatagttgagggtctggaataacgacggcttcaccgatcaaggcgccgcatttggttccgccaatgtaaaacgcatcgcataacgttgccagatctgccatggtaacgtcatttaccgtgcaggccagcgcatatgataagcgcgcaccgtcaacgtaaagtttcatatcatattgttgacagacgtcgtgaatggcttgtaattccgatttggtatacagcgttccaaattcagtcggctgtgacagataaaccattcctggcataaccatgtgatcgtgattggcatcggctgcgtaatcaccagccagttcggcaatctgagcagcagtaatctttccttcatgcccaggcagcgttaaaaccttgtgaccgcctgcttcaatcgcaccggcttcatgaacgctgatatggccagtatctgcggctgctactccctgataggactgcagcagcgcatcaatcatcacggcattggcctgcgtgccgccaaccaaaaactcgacctcagcattgggagcgtggcaggcttggcgaatcttatccttagctgccagtgagatctcatcaaaaccatagcctggcagcttttgccaattggtatctgccagccgcttcaaaatgctgggatgagcgccttccaaatagtcagaagcaaaagaaagtcgatcgttcatataattacctcgcaatcaatgtcaataaaaagcgtttgattaatgccaatcatacgctaaagaagtgctggtgacaattatgggcaaagattgtagaatctgattagttggctgaacttgatccggcctagtcagcagttgaatgatttgttaaaataaaaaaagattattaaagataaattaaaaccgccatttccaaactgggatggcggttttaaatggaggaatggaaaatgccgggattgggaaccatcgtgaacgtaattgcaatcgctgctggaataatcggctgtctggctggtgaaagaatcgcgcctcgttttcaagacaccctaatgaaagcaaccgcaattgccgttttgtttttaggactgggcggaaccatggcgcagatgctcacgtttaagcatggcagcttttcaacgcatggtaccatgatgctgattggcagcctcgcgattggcggactaatcggcgagtggctgcggattgaggatcgctttgctgattttggcgaatggctcaagaaaaagaccggcaatgcgaatgatcaagaatttatcgaagcatttgtaaccgcgtcgctgaccgtttgcattggggcaatggcaatcgttggctcaattgaggatgggatcttgggcgaccactcaattctgtttgccaaggcgatccttgattttgtaatcgtcttggtaatggcggcttcaatgggacgcggctgcggattcgcggcagtgccagtcgggattctgcagggaacggtgactctgttcagcgagctgcttaagccactgatgacaacggctgtgatgaacaacatctcctatatcggttccgtattgatcttttgcgttggcatcaatcttttatggggcaataagattcgcgtggccaatctcttgccggcactgctgattggcgcggtctgggtagtcttttaatcggtcaaatgacggtgggcttacgcgtgcttaggcatcccgtcggtaattttgatctgatcgagcagctgacgcagggctggattatgattatcgctgcggtagacgaggttgaaggtaaagcgctggtcagaggcatctttgatcggccaatagcggatgtggcggctggtcttatcataagccttgatcagctcgcaggggtaaaatgccagtgccttgcccagactgaccagcatctgcatgtgttcaaacgaaaagacgcgctcgacgtttaaagcctgaccatttaatcccagactctcgagaaaggcccgcttgagataggatgattcttcattgctgtaatagatgatcgggtagcgtcgcagctgttcaatggaaacggcatctttaatcggtagtctttcgctggcgccaatcaccatctgatccgtgtgcagcaacgcggtttttaggcccatcttggaaaattcctggtcaaagccgtaatgatccatcactacagcgcaatccaagtcattcatcaagacatcggtaatgacgtgttcagggccggcttcggcaataaaaacgtcaatgttggcatccaattcaaagatcaagtcgcgcagcagcaaagtgtcaaaaggcgagaagtaaccaatcgtcaaacgatgccgcgatcgttcgtcaaaatgctgaacagcctggttggtatcgttgatcattcttaagataacctgacagcgctccttaaaaaaaacgccagccgttgtcagagtaacttgattcttgccacgcgtaaacaatttgacgttgagttcatcttctaaacgcttcatctgtctcgaaacggcccgttgtgaaacgtaatgtgcctgcgcgactttttgaaagctgcccaactcactgacttccataaagattctcaactgatcgagattcaagtttttccctcctgcctgccgaatgaaatagttcgggtgttggcatattttagcactacttaggctacaagttcaatgttaaacttatattgttaaaacattaacaataagtgcaaaacatggctagcactaataggcattgcttaaacggcgaaaacgaggctaagtttttttcaacacagccgaacatgttagtatggccataatagtattttatctaatttatggtcgcttatcttagcacatatactgttgtctggatgcaaaagcagttagtcatattaaagaagcatgtgagcatggtaaagataaggagaatcgattatgaaaatgaaagctgccgttgttcgtcaagctacggatccatacaaatttgaagaaatcgaacttgctgagccaaagaatgacgaggtcttggtacgcatcactgccagtggtctgtgccacactgatgaatttggtcgcacgcttggcatgtcgccaatcgttttgggacatgaaggggccggcatcattgaaaaactaggtgaaaacgtcaaagacttcgaggttggcgaccatgtagccttttcatatgccttttgtggtcattgcaagagctgcgttcaaggtcgtccacaatactgcgaaaagtttaacgacatcaattttggcggcgtgggtgctgatggtcagagcaagttgtcgcaaaacggtcagccggtagcaatgttttttggccaatcatcatttgctcaatatgctacgatcagcgaaaaaagcatcgtaaaaatcgatgaagacgttgatctggccatgattgcaccatttggctgtggcgttcagactggtgccggggccgtctggtgaagttgagaactttgactttggcaaggacgtcttgatggcatatcggactgtaattggctgttgtgaaggcgactccaatccaaagatcttcattccacggctggttcaactctataaagaaggtcggttcccaatcgacaagatcattacctagtatccgtttgaacagttggaacaggctcgagaagactccaacgccggtaaggttatcaaagccgtcgtaacgatggagtaggcatttagccatttaaatcctcataaaataaaaaaaacagcattgtaagcatttacaatgctgtttttaaattgtttttcagcttttaaccgcgccattgaccaaaaaactgatatccagcggaacgacacggttggtcagctcgccgatggacaaaaagtcaacgccgcagccgcgataggaggcaaccgtagtcagatcaataccgccggatgcctcggtaagaatttcgtcaggcaccaattcttgccattttttgatcgtagctgggacctggttgtcaaacatgatcacgtcggcatgatgagcaatcgcggtccgcagctgactctccgtttcgacctcaacttcaacgcgggtcattggtcctacgctttgcttggccagatcgattgccttgccaacgctgcccgccaatgccaggtgattgtcttttaacataatcccgtgcgtcagtcccatacggtgattaaacccgccaccagcacgtacggccgctttttcaaacattcttagcccaggcattgttttgcgtgtatccacgatcttgatggttggatcggccagcagctggacggcttgagcagttttagtagcaatcccgctcatgtgctgcagcagattcaaaatgacgcgctcaccgctcagtaaaacggctgctgatcctttgacatgtgccagcctggtccttttggcgactttttcaccatcactgaccaacagctcaacttcggcaccgcctaaaaggtcatagacggcattgataacctgcaaaccgcagacagtaccatcagccttggcaataaacgttccttcaatgacgtgatcaggcaggggagcaagactggcatccccaaattccagatcttcttttaaaaaggcagtcagtttttgttttagaagaaaatcattcagcatgagcgccctcattctttcctggctccggcaatgccaagacagccaccgaaccaataatcaacgaaatcatgaaaatcaagaaaatcatattgatgctgacgtgttggtcaatccaaaccccaaccaacagcggtccaaccacggcaccaattcggcccattccttgcgccatcccggtcatcgtcccgcgaacatcagtctcatacagggttggcgtcaaagcgataatggcaccataagctcccaagttgaagaacgataagatgcagccggcaagaaccgtcagtgcactgctggaaacattgccgaacatgattgctcccagcgctgttcccaacatgtagatggcaaaaacatacttaatcttgattttgccggcaagccaagccgccagatagtatccaggcaactgggccaccacgatgatcgtcgtgtagccgaaactttcgatgacgctgttgccccgtgccagcataatgcttggcagccacataaacatcccgtagtagctaaacattaccatcagccaagcaatccatagcagaacggtcttgccatgaaacgacttttttaaggcttggcccaaagcaacatgctgcgtttggacgtgactgatttcttgaatgttgcggcgcatcatgatggcaaaaaagccagtcagtgcagtaaccagtaacagaccccgccagccaatcgtagtgctgagcaaaaacgacagaaatgaggcaatcagccagccaatcgcccagaaactatcggctaaaatcagcatttgcgaacgctgactgccttggtacaaatcggcaatataagtagcggctaccggcagttcgccaccaagccccatgccgacaaaaaagcgaattactaaaaagctcttaaaaccaaccgcggccgccaagataacgttacccaatgaaaacatcagcagggtaataatcagcgtgtttttacggccaatccggtcagccaggtgtccaaaataaaagccgccgcagatcatcccaatcgtgctgactgaactgatcaaaccggtttgcgaattggccagcccccaagctttgcgaacaatcggcatgataaatgacagcagtcccacgtccagcgcgtcaaacatccaagccgttgcaataattaaaaacgtagcgaatgcagactttttaatgttaactccttgatccatttttcttctcccttaaccagttttaaaaaagtattaattacttttattgtgctcaagtgtagtcctttgttcgataaatgcaagccttatttagcaattcactaaaccagttaacgattatgcaaccgttaccgatcccgatccgatcacgttttgtaaaagtaaaatctacctaaaataatttaggactagatattttcgaaaccgcttatccaggggatgcaaattagcttgattgcaaattgactacaaaatcagcatcccaaaaataaacagcgaccacttaatctcgtcaaacgattaaaaggcggcaggatttatgaaaatgagccttcgactgacttttaaggtggcagcctgttttgacctgccaaatgatttttgatacgctgtttttacgtttaagatttaaaagttaaagttaaggagaagtcgatgccaaacaataatttaaaaatggatcttccgcgctgttcatgggttaacctgcaaaacccgctctacgtgaaatatcatgactgtgagtggggcaaaccggttcatgatgatcaccggctgtttgaaatgctgcttcttgaatcgtttcaagctggcttgtcatgggaaacggtcttaaacaaacgggctgctttcaaacaagcatttgcggaatttgctgttgacagggtcgctaactttaatgatgaggactgtcaacggctattgcaaaatccggggatcatccgtcatcgtttaaaaattcgtgcggtggtcagcaacgcccaggtctttatggctatccagggggaatggggcactttttcaaattatctgtggcattggacgcaagagaaaacggttcgccaaatcggtcaaaccagctcacagctgtctgatgatattgccaaagatctaaaaaagcgcgggatgaagtttgtgggcacgactacgatttatgcctatctgcaggcagtcggcgtagtcaacggacatgagcgttcctgctggctggggaagtcgctgtaagcatgatcaaactggctttgacagcataaatttacatctactatgatagtcggtgttttttgatggcgtttacaataatggcgggcagtttatttgcatccctacctcagcgtgctattctgaaggtaaaagaactgcaatgaggtgatcttaatgacggactatcaagaaaaactgaacgaagcccgggccaacaatcgcaatctgtttggtgcattgggcgagaccggtaaaggcttcaatattatgcatgatgctgccgttaaagatggtgcgctggatttgaagactaaggagctcgaagcgattgcaattgcgattgccatgcgctgtgagggatgtatcgtccaacatgccaaagcgtgcctgaaagctggcgttaccagagatgaattggttgaaacgattggcgttgccctgatgatgggtggcggcccagcaacggtttatggtggcaaggcactggactgctatgatcagtttgtccaggcctcaaagtaagctctcggcaagaacgataaaatgcaaagcctaagcaataattggataaataaaaatggcgcggagcaatccgggccattttttatttcgtattatctgaaggcaggatttagatctaaagtcgaagcctgtttgaagtttggctttactttatatgacagaaatcagctcaatcaagttttccgtatgcttcgtcatcaactggttccagccattcattagatgtttccgtacctggaatctcaaatgccagatgactgaaccagctgttttgcttaacgccgtgccagtgcttgacgttggctggaatctcaatgacatcgccaggcttcagactttgagccggcttgcctgcttcttgataccagccttcgccatcaacgcagatcaacacctgaccaccgccactggctgcacggtgaacatgccagttgttgcggcagcctggttcgaaggtaacgttgaagattgccaaaggatcgtctggttttgacaagacattaagatacgactggccgataaagtattgagcgtaggcgtcattaggctgaccaatcccaaacatcccgccgtgagcactggcagcatcctttaagtcctcggcatagacgtctttagcctggttgaaagcggcccaggcatttggccagccagcatagaaagccaggtgagtcagcagttcggccatttcttgtttggtgacgccatttttacgagccgtggccagatgataatgcagcgaattgtcagtaatacctttgccaatcagtgcgctgatcgtggcaatactgcgcagctttagcgacagtttgtcttcacgtgaccagacctcaccaaagagcacatcatcgtttaaatgagcaaattctggggcaaactcgcccagtgtatcgtgtcccgcagtttgtttcattagattttacctccataaaccgggaaaaagccatctttcccataatctttgatgtgttccagatgcttcatcgtttccagatcatcagccgcaataacaaagtcgacatcagcattctgcttcatatggtcggggttggccgtcttaggcagcggtagaagaccaagctgcagatcatagcggatgcacagctgagctactgaaacgccatatttgtcagccagctcatttaagatcggattggctaaaacggcgccatgcgcaactggtgagtaggcctcaaccaaaatatcgttctgctgacaaaagtcgatcagttcaaatggcgtgttcgtgacgtgggccagaacctgattgacggctgggcgaaccgttgcgtgatccagaatgttctgcagatcgtgctggttgaagttggaaacgccaatcgcacgcagcttgccggcatggtaggcatcctctaatgcctggtaaacggccaggttgccggcttcatgacggtcggtggattgattgacttctttccaaggctgcggactgtgaataatcatcaggtcaatgtaatccagtcccagtttctgtagcgactcattgattgcctgagcagctgattcgtagtctttgagctcggcggccagcttggtggttacaaagatctcatcgcgggccttgccagattgctgaatgccgcgtccaacgcctttttcgttttcgtaggcttcagcagtgtcaatatgacgatagcccagctgcagagccgtagtcactgctttttcagccgcatcgtcatctaaaagccaggtgcctaaagcaagtttggggatcttgacgccattgtttagctggtagtcttcattaagaatcgtcatttaagatcactccttggtgtttttgattgatagttcattcctggaatctggtccaggggtaaattagagatgctgtcgggatgatagacggctttttcggtaccggccttgattgcttcttggtagtaccagtctttatagtcgagttccttgagatagaagttgagccgctcaatctgatcaaggacgtgctgacgctgctctttaataatggcatagcgttgttccagcgttgcatcgccttccgcgcacagatcaacgtattttttgatctggcgaatcggcattccggtaccctttaggcagtttagaatacgcagccaggggaaatcggtatcctcgaaaacacggatgccattgacgcgcttaacgttgggcagcaagccttccttatcatagtaacgaagcgtggaaggggtaacacccatcacctgagcaacctgagagatggtgtatgacatttctcatcctcctttcatttcatcagctgatgcctttatgctaaaccttaaagttaactttaagtcaatggttaaatgagatttttaacgactttttttaaataaaacagccccggccggaaattaccaggctgagactgttcaattgatgtttgcgttgattgcaggctgtgaaaagtcagatcgatccgagaagcattgcagctattcggcgataacttggccagtaatgcataaaacgtcagccagaatcatcgtaactaaaattgctggcaaacttaagtgaatcaaaggaaccaaataagtcgtgaaattataaagcactaaaaataaaaacattagaaggttgcagacactgaaatgcttgagccagttatgccgcttaaccagttgtttcagttctttcaaatcaatcactccccaatcaataaattctcagctggacgtctttgggcagattattgtagagccaggtcgcgtcttttttggaaacttgaatcgtatcgtcaacatgattacccagcttgggttccgcctcaatgtcggcattctggccaacgcttaaccaattgatggacttaatgtctttgccatcagtattgtaatgaaagatcgatggacctctaaaatcgccaaccaaaagctgatgttgtccggcagcaaggttgactctggcgttgagaatatagacaacctttttactgtttaaaatgtagatcttgttttgtccaggaaaggcagccatagtaagatgccgaccgctaagtttgggataggcgcctttttccgaggattggtcaatttgaagggtccgtaatcgattggtatggacgcgccagctggcataactggttttcagttcagtaggcggttgattaaagatcccacctagattaacgaagactagttcaatcaaaacaatgctgatgcagagttttagcatctgcttgatttcacgattcatttttaaaatactcctctcaattccccaaaataaccgcaaatattatttaaccagcagctattggatagtttaaattcccaaatcatccaatgtatttattccatataagctttatagaatctttaatatatgccatattagtcagattgtttgtgatgtcaacttaacctcaataattctaatttaaatcgtatattcttcatttaatcttaattataaaaattataaaaaaagatgctggccaatatggtcgcatcctgtatttttaatatcgttcgtttttaagttaaatatgattggcagcattttaaattctgccggcgtttcggtgccgcaaggattaggcttgcgggatgactgaatcgttgatgttgctgtgacgatacccatagccgaagtagagtaccatgccgattgcaaaccagatgccggccccgatccaggtttcttttgacagaaatgacatcataaacaggcaggcaaacccggacagcaatggcagaaccggatacaaaggaaccttgaagccgccttcgttaagaatgtcatcacgcttgcgcaatgggatgatcccaaacgaaaccatcgtaaaggccagcagcgtaccgatgttaaccaggttggtaagactgtctaaggatacgaaaccacccataatggcaattacaatggcaacggcccataaagcaacttttggcgtgtgcgactttttgtccagctggtgcagcgaggttggcaaaaggccgtcacgactaagcgagtagatcagccgagatgaggcgtagattgcggtaaacatgcaagtagccataccaatcagcgccccgatcgaaagcagggaggccagccagccttggtggacggactgcagagcaaacgcaactgggttggcaacgtctaaatgcttgtagttgaccataccagtcaaaaccagcgatacccccatgtacagtaccgtggcgatcagtagcgtaccaatgattccaatcggcatgttcttttggggatgcttgacttcagccgcggaactcgagatacagtcaaaacctaagaaggcaaagaaaacggtcgttgcgcccttaaacgcaccgtgcgccccatatggcaagaacggatggtagttggcctttttgacaaagaagatgccaatcacaataaacgcaacgatgattaaaagtttaaccgcaatggcgatgttgttgacgcgaaccgattcatgcatcccgtatgaaagcagccaagtgatcaaaattacgcttagaatcgccgtcaggttaatataggtgccgccagcgggattaaacggaccagacagcgccttgggaatgttgacgccgcagctggccagcagcgagttgaagtaggcagcccagccagtcgagacacaggcaacggccaacaggtattccaaaaccagtgcccagcccatgatccagccgatgaactcgccatagatgatgttgccgtatgaataggcactgccggctaccggaatggctgatgagaactcggcataacacatcccagccaagccacatactaccgcggcggccaaaaaggaaaacgtcacgcctggaccggcatcattggccgcgaccgtccccggcaggataaagatcccactgccgatgacagcgccgatccccattgccattaaatctccggcattcatggtcttgggcatttggccgtcagtcttcatgtagctggctagactttctttacgaaacagatccatattatcaacccccagatctgacaagtgataaaaaccgatcactatttaatttattttcaaattcattaataatcttgctaccaatactagtgctctcaaaattaaaaatcaattagaaaatattcaaaaaatctaatgccaataattaaataaaatgaacttggcatcgtttgcagctaaatattttaaagaaataggaaattaagcttagggatgctgaatcaagcataggtaaaaattcacgtgattttgtggcttgaaagattagttgttgaaaaccaggtattaaggataaaattaaaatgaattattttggttaaatgaggtaatgaaacatgacaaccgtcttactggttgaagatgaacccggtttggccgattcattaaaaaccgaattggaattctccgaaatgcaggtaattttagccagcgatggcaaacaagcgctggattgttttgctcagtatcaaacgcagatcgacctgattattttggactggatgctgcctaaaatcgatggcttttcagtactgcgtcgtattcgccgcgaaagccaggtaccgatcatcatgccgacggcgcggtcttacattggcgataaggtagcggggctgactggcggggccgacgactatattaccaagccatttgaaatcgaagaactgctggcacgaattgaggttgccttaagacacggccagtccgccaagccaagcgcgaccagctcgacctatcagattggcgacctgatgattgatgacgatacaaagcgggtgcagcgaggaacgcgcctattgtcattgacgccgcgtgagtacgcactgctgctggcattggccaagaaccgcgatcaggcctgttcaagagatgatttgctgaatcaggtctggggcgttgactttatcggccagcctaatatcgtcgacgtctacattcgtcaactgcggcataagattgatggcaatcccaaactgcctcggctcattcataccattcgcggaacgggctatatgctttcggccagtctggatgcaggatagggggctgaaggatgaaaaagattccgaccagtgccgatattttgcagcgtgccgtctggaaattgatcgtttttattacgctgggttttgaaatcgtaatcatcggcgcgagcggtcatcagctttacgagcgcgtggtgatcaacagtcagcgaattgccagaaaactggtcaagaccgagattgattccgagtttgactggcagcattggcgaatgaacagcaatctggataccgaaaacgtctatttcttagaggttgacaatcttcgtcatgccaagccgcagcgtttttataccgagaatgccaaacagctggcaaacaagccgccgtggcatctttttaaatcattttggtacagtgagcggtttgggattttataccggaccgttacgaccaaaaatggcattcgctatgttttatggcaccgcatgtacgagcagaccacgattcttatccgcatcatctgggtaacactggctgcgatgatcctaatcatggcgttgagtccgctgtacgtcaagcgcttggcaaaacgactgacgcatcccttgaccgagcttacgcaaggcgttcaggccgccagcgagcgtggggatgacgatggctggcagctggcggttcccgagcagccggctgaaatcgtgagcttgacacaaaacttcaaccagctgcttaaaaagctttataatcatcaagccgagcagcagctgtttattatgaatgcagcacatgaactaagaacgccaatcgcggccattcgcagccacgtgcagctgttagagcggcatggtcaagatcaccccgagatcatccccaaatcgattcgctatattgacagtgaatcgcgtcagatgcaggatttggtaaattcgttgttgaaactgacccgagcggacgtttctaatctgacgctgtcaaaaatcagcatcagccagaccgttgccgaattggttgaacagatgcagcctaaaatcgcacagccgctaaaatcgcggatagagccagactgctgggcaattgccaatcaggatgccgtcacccagattatccataatctgattgccaatgccgctaaatactcgccagccgaccagccaattcaggttacggttgagcagcagtcaaaccaaatcatctgtcgcatcattgatgaaggccccgggattttgcctcaggacctgccgcatgtttttgagcgattctatcgcagtgccgaggtgcgcagccagattcccggaactggtttggggttggcaattgcagctcagctttcgcaattgattcaaggaaaactcacggtacacaatcatcagccccatggcgccgtctttgagctgcggcttttgcagacgctaaaaaaagcttcagcagactagacgttaagcgactgtaaaaaacgcgcagtacatcaaaaaaattaaacttagatcagcctaatggatcgccagcttcggggacatacccagctgcgatcttttttattagacgcaattctgaagattcttcagaaaagcctcattttaaccctgtatcaagcccagccagcttctcgtatgataataaaaaaacgagaggaagttgatctaatgcttagtcttgatcacttaagtcagattattacgcagctgttggctaataacggctggatggtatatggtggtctgtttttaattatcttagcggaaactggtttggtggtgacgccatttctgcccggcgattcgctgctgtttttatacggatcgatcgctgcgatgagctcgcatccattaaacatctggtacctgctgatcctggtcttaattgctgcaatcttgggcgatacgattaatttctcaattgggacgcgatttggcgaatatttaacgcggcggcatccaggacttatcaagccgaaacatcgtgaaaaaactgaggagttctttgcccggcatggcaacctggcaatcttttggggacggttcatcccaattattcggacgattattccgtttacggcggggatggggtcaatgccataccgtatgttcatcttttataacgtgctgggcggacttgcctggacgacgattgctcttggcgcgggctggtttttcggcggcctggccattgtcagaagccactttgatctgattatcgtggcgattatctcgatttcgctattgccgattgtctttacgctcatcaaggatcgacgggaggcagctaacaatgattaaaaagcagaatatgggttgggcttggctcagtctagcactgtttggctttctgggcatctgtattaagctgccggccgcgtggatcagctggtttgatgctacgggcgcaaacctgatgccaagcgtaacctgggccaatactatgatctttgaaaccattgcgaatcttggcagcccggcagtcagcctgttggtagcggtcctggttgctgccttgacctggcggaagtttagaacgcaggccattttgtttggcctggctcaatttggcggcgccggtctgctgttgggctttaaaatgctttttcaacgagctcggccaacgcaaccgctgctgccggaacatggcttcagttttcccagtggtcatgtttttatggcagtaatcgcggttttgatcatctggcgttggagcgactgctatgttaaagacgcagaacaaaagctgaccatccggctgctgggcatcatctggattggcctggtggcggcatcgcgagtctatctgcgtgcgcactatccaagcgacatcttgggcagtctgctgctggctggattttggtggccaacgggacactttttgatcaataagtgggcattaaaacgacaaaaagaggcgaatgaagcatgaccaaactaatgattatcgtgccggcctataatgagcaggaggtattgaaaagcagtattgaacgattatggcagattgaaagtgagcttaagcaatctcagcagataacgatggattcgggtattctgatcgttgatgatggctccgttgatcagacgtggccaattattgagcagctgcaccaaaaacaacctgcgatcagcggtttgcgtttttcgcgcaactttggtcatcaggcagcgctcttggcgggactcacgacggcggtctgggatgcggacgttatgattacgattgatgctgatctgcaggatgatccagaaaaaattccggcaatgatcgagcagtatcaagctggctgtgagatcgtctatggcgttcgcagcgaccggcagacggattcatggtttaagcgcaataccgcggcgcttttttatagcctgatgcataaaatggaggtcattatgattcctgacagtgctgattttagacttttgagcaatcgagccgtgcatgccttgctgaagtactcggaacgcggtttgttcttgcgtggcttggtaccgcagctgggttttcaaacgggccgcgtggaatatcgacgaacgccgcggctggctggaaaaaccaagtattcgcttaaaaagatggtcggcctggcacttaacgggatcacgtccttaaccagcattccgctgcggctgattttttggctgggaatgctggcctgcatgctggcaatcggaatggggatctttacgctgaccgtgcatctgctgggcaagacgatgcgggggtggtcttcgttgatgctgtcactgtggtttatcggcggcgttcagctgatgagcattggcgtaattggcgagtatctgagcaaggtgctggttgaagtcaagcaccgaccacgctttatcgttgatcagcatttaaaatagagtaggaggggtaaaaatgcgcgtttggcagcgaatcttatgcctggcgctgatgattggcatggcagcctgtgtcttaatgccgcgtccgaccaactggcaataccagatcttactagtggcagccgttttggtactattggggattctggtccaaccggctgcgcgtttagaaagactttcggcacgccgttttaagatcttgcttggccttttggggagtgctttgatcttgacccagctgctgattttaatttttttgcccgtgacggtttatcacgatccgtttcgggtgctggcgcaggctgctcaaatggctggcggcaactatgactggaacatcacctacttttggcgctattcgcaaaacgtaccaatcgcctggctgctgtcacgctggctgatgattaccaactggctgggtctttcagtgaactggggcgtcaatcttttagagctgatactgcttgacggctttatttatttaacgcttttgacggcttggcaattgacgcaccgaaaaaaagtcgtgctgggtctggcagctttcttgatgctgaccccgtttgcctacacgtattatctgcaagtcttctatactgatctgccaaatatgttgattttactgattatttttcggcagctgatcttttggtcaaatttcagtcatcggcaaaaatggatccgtggtctgctgctgagtggactgactggattggggatgctgatcaaagccaatctgatcgtactggtgccagcaattttgctgacggtgctgctcatgcggccaaagcgctctttgaaactggccctgggcgcgattatcctgggcgttgccttaagcgtacctgctcatgctgggattgaccgggccgcgcattttcagcaaaacgatgcttataaattcccaacgattgcctgggtaacgatggggatgaatgaacggacgcagggaacctacagctcagctgacgttatccgcaatatcaagcaaaaagatcttgcagcgcggcaaaaagtcgatcaaaaagtgctgaaaaaacgccttgccgacatgggggcagctggtatcgccagacaggtcatcattaaagatggcatcttgctggatgtcagtcagatgacggaatggtataatggcggcttcaaaaatgctcctgcctggtatctaagatttgccgatcattggcatgagctggcggtattgatgatgagctcggcagcaatctgtctatatctgctgaccattatgcgcttatggaaatggcggccccagcagcatgatgatcggcagaccgtcttaatgcttttggtaatgacggcactggggtatcttggctttcatgccttgctttgggaagctgagccgcgttatggacaggcgattttaccgctgctgtttatgattctgatgctgaccaagccggcttcggttcccgtagtgcagttgaaatggctaaaactaccgcggccagctgcatcggtgattgtcttgttcggggtgttgttattggtatggaatcaaggcctgcctggcagcaataccagtatcgtagctgcccagcgctcacagctttccacacagtatcacgcgcgcccaacgtttttggcaccacgtcagaccgtttcgcagcagatcagactcctagcagccggcagccggatctctgttcaaacctatgccaatactgatctcaatgtcgagctgcagaatctgcagaccaggcagaaatggcaattaacgcgtcatggcgattcgcaacatctgtgccaagacttaggtgccggcacttatcaagttacggttaccaatccaaccccgaaaccgcagccaattgcaatcttaaaaacgaatcgctatcaaatggcagaccggccgctgatttttaatggtcatgcacaaagagatgcttctttgatttatctggtcagcaatcaatgcgactagctgtcttaaagactggctttgaccgctgatagttaaagttaatatagatccactatggttatggaccttctattcttgaggaaactcatctataggaggttttttgaatggccaaaagtcagtcccatgccaaagcaaacaaaaagcccacagtacgataccgtgagctaataaaaagagcgcccctatgataaggagcgcccagccggcttgttggctaaaaagcaccaactgcacgcggcctaatcatcatcttagttatattatctgacatcccattaaaaaactttgatgtaacacggatttgagacgtcgcgcatataactagtcttcaaacgattggatgcagaccaattgatcgtttgagatgtgctcattcaatgcgttggccagatcactagagattaccccagcggcagcctgttgctgaacatagctgtgctcatcttgaaacgccttaatggctaatgtccgcaaaacgttgatgtccatttcgccccgggaatggaaacgatccaaagtctgctgccgattcagatacatgcggcgaaccatcgcgacttcatggacgttgtcgggcgtctgcacctcgtcgagaaactcgttgacatcggtcatggtcatgttaaagattgactccagccgatcaaagtactgctgacgaacggccttggatttgtcctgtatggttttatcgtcatggattttctggagttgtgcaaacgtctggggatgatgcttatgcagcttatgactcaaacgtttccacttaaaccggtaatgccagattcttaaaaaggcaaacaggccatgctgactgtgcattaaggcatcgcggccaatcatgcggttatagacctgctcttctttggcagtgacgacgccattttcgcgcagctcagccaaggtctgcatttcaacgccgcgcgcctgactggcaagtcgatcatagacgttgcgattgatcttaaaggtcagcgtcatctgactgctcagctggtcaatcaaaagcgcctgttcttttttgttttctggcgattggctcagttcatcgattgcatattgcacggtatgaatcagctgatcttgaaactcatcgttggtatagttcttagtcttggttggcagcagacgcggaaaggccaatgtgccgaccgtcagactgatcaaaatgacgatggcggccaaaagaatcagctgattgcgggttgccagctgcgcgctttcggttagtacggggatggaaaaggccattgccagcgtaatcgtaccatgaattccgcctaaagcaagcagcagaccgtcacgtttcggattcgtggaatgcatgtcgactaatttgaaacgtgcccatagatagcgaatcaagctcattgccaggtaaagacccagtgctaagagcgccagtttcaagatcgtggcggtcaaagtctggctgacgacttctggcagcataacccccagcagtacgaacacaaaaccgtttaacagactggcaatgatattccaaagcgtcgtcgtagcgttctgtacgcgcgaagaagtgagccgcagctggtcgtacaagatactgtgcacgattccggctgccacgactgccagaattcccgaaagatgcatttcctcagccagccagtagacggcaaatggagtcataacgttgattggaataacgatggagccgatatcgacatgggttcgcatcagcgtcgttcgcagcgcgatcagcatccagcccattagcgagccaaaaataatcccgccaaagaacacgtataaaaaggttaagacgccgtggcccagcgaaaattccccagaagtcaaggtcccggtagccagactgaacaagaccagtccggaagcatcgttgaacagcgattcgtattccagcgtctcattaacgtttttcggcatctcaacattggtcgtcaaagacttaaccgcgacggcatccgtaggcgtaatgatagccgccagcatgaaggccagcgcataggtgaaatgctgcggcaaagccaggttgaggccgctgccaaccagaattacggtgacaacggccaggccgactgccattgacaggatctgccgaatattttgcgaaagctggcgaaaagacacgttttggccatcgttaaacattaatggcgcgataatcagcagcatgaaaatctcaggctctaaaacgatggcatgcgtatcaattggcaagatgctcagcatgatgccggctaggatctgataaatcgccaatggcaaaaccggccagagcagatgaatgatgttggccgccacaacggttatcaatagcaggccaacaatgtagacagtggtcataaggttcctcccaatattaatttatttaattataactgattagaccagactgcggataccgacacgcactttattatcccgataatttattgacgatattatatcttatgtaaaatcatgtggcagaaccagactgaattaaatgatttggcttcttttacggcaacccgacttaaccagcctgcacctaaaatcaccatcatgtcttatagtgaagttctcattaagtcataaaaaaagagcgcccttatataaggagcgcccagccggcttgccggattgacggtccagcttgcacaacgatatattcctaattacgatggaattgtaacatacttttgtgctgtgttacattattttcgcacaactaaagcgagattgacaccctcgactagtgcgggaaggaggctccttccaatgtctcactggtatatattcctaactatcgtgccaagcaagcacgttaaacaactaatcaagcagctgtttaggtaatggctgccagcactcatcggtttggatactgatcgggcgcttttttattgaaaacagccagcttactaagcattgatgaccgtaatcaaagattgattaaattattttgaagcccatttgactttgagcatgttataatactttaagttttataagactatgattgaaattaagtaaagaaaggatctacgtgacacttaccggagcagattggcagcttttagaatcaatcatcgttgtcttgccgaaaaagaaactcaaaaaagtgtgtaagcataccgatgcaaccaagaaagccattaagcaggtacgcaaaggccagtcttttgtaagagaatgggacccaaaagtggcatcgcagactttgcagtatttagaaaagcacgtttataaaaaggacctggctaaaatgaatcagcaccggttgatctgcaactatcacgtgatgatcaacgacttgaatcgggcaatctttgatgaaaactatcgtgggcagtatccgccactgacccgtgaatcgcgcattcagatcgagcgcaatcctttagtccagccaggggaaggctatcgcaacattattgattattatctggatgatgggctgatgggagcacccagatatgccaagctgcatgaaaccacgatcggcgaggtcctggatgaaatggcaattatgggtcagtatagcatttaagaaaacattcaatcaaaaccaaagcgtctggcagcccgccagacgcttttttgatttagctttcaaacagatacggctgatcaaaacgcaccattaaatctggcagtcgctgtttcaattgttgctgcgtggtcagatcatagaaataactggtctgggtttgaatgtctaccatctctagataatgggtataaacgtcatggtcagctaattgatcgagtacgacttgttttaaaagctcgtttccctgcttgatagcgttctgatcttcaataggggatgtctgccaaagattgagcgaggcattgataaaacgcgaagtcggcgttctttttaagggcgggggagttttggagccgcgaatcgccatgattatttcggtatcgctggcgtcttgatcgattcctagatagtcagtcagtttttgacgctgttttggatagcagggactgttggttaagacacccagctggatgggctgaatcgttaaatgatattgcgtgggttcaatcagataggtaccagtggcatcgcttaaaagccaatgaaatggatggacgatgtcatgatcgtgccagattacgccaattagtgctaccgagtccaattctgcagcgatttcggcaactgatgcgtgcgtgcccagcagccagccgatcaagtcctgtggcgacagattcagatgatggctttggggatggtcataataaacctgcgggccgggaaaatatagctcagccgcccataagcccgccgaattcaagccatcgccaatcagatagtggtgattgattttgcgcatcccgcctaagattgcgtagtcgttggcaaatgagtcgcattccggcagactccgccattgataatcgattggcagatatcccagctgccatggcgtggagcgggttggaaagtccatcgtgcgcccgacaaagcgatgccgctgtctggttgtaaaactgattgccgtacacatgctatcaacgcctttttcttaaacttcacggcaattctagcattaattgcttggcatcactagtaagcggactgacaatcgttaaatttattgaaaacgcttagttaattggttccttaccaggcaagatgatttaaaaacagattgctattttgtataatcaagttagagatagtagtcatccgttcaatgacacctaattaccacctaattacataatatatttaaaggaggaaaaatcatgacgactcacaaattgatgcggctcgctgtagcggttttattggctgtcacggtatcaggcggcacacttgccacaacatctgaattgtcgccaacggtccaagcagctgctcagaccattaagctgaacgaaaaacaagctgtggctaaattcaagcaaaaatataccaaggccaagatcagcgaaatcagtctggaaaaacatctgaatcgctaccaatacgagatttccggctttgattcgcaaaaagaatattcagctaagattgatgcacaaaccggcaaactgtcagcagctaaatctgaaaaacttgatgctgacgaccatgagacggcaatcaaacttaatcaggtcatcagtcgtcaaaaagccaatcagttagccgaaaaagctgctaaatccggtcaaggccgcgaatggacgctggaaaccgatgatggtcaaaccatctggcaagttgatgtggttgatggtcaccaaaaaactgaagttaaaatcaatgcaatcaatcaaaaggtgatcagtgtcgaaaccgatgattagctaaaaatgctcgtcaagctgcttaaaacttggcgggcattttaatattaaaactaagcagagttgttttcccttatttttgaaagtagcattaaaattttagttttaatgcgtttgtattttaaaaccgttttggatgcctatattttatctatatctaacatgatctatttagctaaggagtttgccatgattaaaattactgccgttgatccccaagacctgccagccctcctgcgcatcgaacgacttggctttaacgaggccgaagctgggactgctgctcagtatcaggcgcggatcaatcagcttgccgatacgtttctggcagcacgcgacgccgatcagctcgttggctttatcgtcggtccagtcgttgatgcgcgttttaaatatattgaagactggatgtatgaagctaacgtgcaaaatcgcgctcaacctggcggcaaccagatgattcaaacgattgccgttgatcctgattatcgtggccaagggattggctccagtctgctgcaggctatagaaaaacaggcaattcaaaaccagcggcatcacatcgcgctgacctgtttactggatcgcgtgccattttatgagaaaaacggctatgttaatcaaggcatcgcggcgtcagcgcatgccggcgaagtctggtacaacatgaccaagcttttgcccagccaaccgcagccccttggttagcatttcagcgatttcaatctttaactgcggcttgtcactggacaaaatgaatcttagaataaaagcagtcaattcgtttttgaggagtgatcttaatgattaaagacggctttatcccttttggcccttaccgaacttattatcggatcgttggcaagcccagcgataaggcacctttactgctgttacatggcgggccgggatcaacacacaactactttgaggctttggatgagctggcggagcgtgatcagcggcaattgatcatgtacgaccagattggttgcggcctttcctcaatgcccgatcatccccgagtctatcaggctgcgacctggctgcgggaactaaagaatctgcgggaacggctgcatctgaatcagatccacctgttgggccagtcttggggcgggatgctggcaatcatgtatctttgtgatgaaatgccggctggaattaagagcctgattctttcaagcaccctttctgatgcccaattatgggggcaagaacagcaccgtttgatcagctttatgagtaaggaagatcaggaagtcattgctcaagctgaagcagccaatgatttcactggtgatgcctatcagcgggtcaatacccgatttatggaactgcatgcggcggcagcgcctggtgagaatgcccctgaatatctatggcgcgagaaaaacgttggcgaactggcctatcaaacggcctggggacccaatgagtttacgccgaccggtaatctcaaagactatgactatactaataagctgcgcaatctatacgtgccaaccttaattaccagtggcaccaacgacctttgcacgcccctggttgccaagacgatggctgacgccctgcccaattcgcaatggcatctgtttaacggcacgcggcatatgtcgtttgtcgaaaagcctttggaatatcaagcagtactgcaggattggctggatcagcacgattagaccagctcaagcagtcagactgtcgcatgatggtacgcttcaaagatgacaaagatgacaaagctccctgctctggcaaatggccccagcagagagctttttatttatcagtggctgtcgtttctatattgggaaagccagagcctttacaacatgatctgcaaggcttttggtctaaaaaattaatgacgagcatcgcatggtatacgcggtaactgaaacggctattcaaattatccaactaaagtatcattatcataagtaatcagaaaggctccagcgtgtttgctgaggcctttttaagataatagatcaattaatggtgtgattacgttcatccatgcataaagtcgcagtagtagtcacaatgcatggtttgcggaacctgatcccatttaactggatagccggcaccatgcgcgcagaaaaccgaatccggcgtattagccagatcggcagtcggcagatagtccgcctgctgaatgatctcgtcagcattatgacatggtcgatagccagccggcaggcactccaactgtccctggccatgcgtatagccgcgcagcaccgtggcatagtcgctcatttgggcaactggcgccagaccggtcagcaaaacgctgtcagttgtctgatcaccaagcgggtcaacctcgccatgcatccgctgcagatcgttaagcgcgcgaccaacctgagcacttggaactattaggcggaaacgataccacggctctaaaagctgacattgctgccgagcttttaaagtcatcagtccctgccgcagcgcgcgactggcagcttgacggaagtccccgccctcagtatgtttaacgtgcgcgcggccgccaaccagcgttactttgacatcagtcagcggggcgccaatcaaaacgcctttgggactggcctgctccagactggtaataatctgatgctgccagtttttattcagcacgtcgacactgcattggctggcatagcgcatccccgctccccgcttggccggttccagcaagagatgggcttcggcatagtgccgcaatggctcaaagtggccgacgccttcgattggcgcggtgatggtctcgcgatacaaaatgccgcccttgatgaagtcgacgtctatatcaaatcgttctaaaagcagctgctgcataatctcgagctgtacggtccccatgatctggacgcgaatctcctgcagctgctcattccagaccacgtgcagcagtggatcttcgtcagccagcgtctgcatggcctttaagcattggtgaacgtcattttctttcgggtctaccgcatagctcaacacaggctgcataagcgtctgcgtatcgtctttaagctttcccagcccttgccccggataggttgtcgttggtccggcaatggcacaggtagcgcccgatgcaacctgattgacaatggtaaacttactgccattgtatacccgcagctgattggccttttgatccggtaaaatggcggtctttgctttgagactgccacccagcacccgcacccaggttaagcgctcgccccgttcatcatgtgagatcttaaacacacgggccgcaaaatcgctgggaaattcacgaggttgcgtccactgggcaagtgaaaccagcaaggcatcgatcccctgcagctttaatgctgagccaaaacagcagggaaaaagctgccgctgcttaatcatctgccgaatccgctcatctgaaagccgaccttgatccaggtattctaacagtgcatcgtcatcttgcatggccagttcttcatggtcaaatgatttaagctcgccattaaagttcgtcaacgcaaaacagcctggtgacagctcattctgcagctgactgagaattttcgtaccatcagccgtatcagcatccattttattgataaagataaaagtcgggacgcggttttcagccagcagctgccaaagtgttctggtatagcctttaatggcatcggttgccgaaatcaccaaaactgcatagtccaaaacacgcagcgcctgttcagtctgcgcagcaaaatcaacgtggccaggggtatccagcagcgtgatggacaggtcgtcatactcaagcttggcctggtgggaaaaaatcgtaatgccacgctttttttcaagctgctcagaatccaggaaagcatccccattgtcaacacgtcccagacggcgaatgattcccgtctgataaagcagggcctcagacagcgttgttttaccggcatcaacatgcgcgatcatgccaatcgtaatctgtttgctcaattcaattctcctttatggcagtgagttgccagctgccagatagatatcgtaccattcctggttggtcaaggttatctcgctgccttgagcactatcgataatatgctgcggattcatcgtccccaaaagcacttgcatttttgcgggatgtttgagaatccaagcaaccgcgatcgcatttttagaaacatgatacttatcggcaagctgctttaacaccacgtttaattcatggaactcctcattgtcgataaaggttcccgcaaacgtaccatattgaaacggcgaccaggtttgaatcgtcatttgcttgcgccgcgcgtattccaacagtcccccatcatgattgagcgaggcttgatcagtcatattggtatgcaggccaaaatcaatcatccccgtgtgcatgatcgaaaactgcagctggtcaaccaacagccgctgtgagcaggcatgttgcagcaattcaatctgttgcgggttgaagttggaaacgccaaagtgccttactttgccggctttttgcagctcatcaaaagccgcggctacttcttcaggttccatcaatggatcaggccgatgaatcaagaacgagtccagatagtcaatgcccatccgctctaagatgccatctacggcagtcagcagatgctttttagaagagtcatagcgcgtaatgcggcccgtttcatcagcaaacagcccagccttggattgaatgtagaaatcatctcgtcgcagcccactttgcttgagtgcctgaccaaaatgaatctcggatgagccgcgaccaagtttgggatcacggccatagatgtcagcggaatcgataaagttgatgccagcttcatgagcggcctgaagcgtcttaacggcatcagcaacgggcagtgtccccatccgcatgatccctaaggcaacgtttgagacttcccaatttgttgcgccaattttaatcgtctgcataatttaacgccttctttattgttattgttgatatgatcagtataaaccaaaacaaaaaaatctcctaaaactcatgccggttctaggagaatgcggttaatgcgactgatttggcagattataggtaaagccctcgccttccacgctggcaatgtcaaacgtagtaataaaggcatgcggatcgatatcattaatcaggcgttttaaggtgacgacttcttcagaggctactacgcaatagagggcttggcctggctgatgagaataggcaccttcgcttttcagcagcgtgacgccccgttccagctgccacatgatctgattgctgatttcctcggtttgcgtcgagatgatgataaagccttgtgcaggataggaaccagcctgcgtaaaattgaccaccttggaaaagacataggatgctaacagcgtgtacatcattttacggatatcaatataggaaagcgatgccgttaaaacgatcgcgtcacagattaaaagcgaacgccccatgggaacgccgcgatgcctttcaaacatccgtgcgacgacatctgacccacccgtcgtaccatcaaaacggtagacgattcctgagccaaagccgccgatcagaccagctaagaccccagaaataaacaggtcatgctgaatatccagggtgaatgggacgcgctgccaaatccagatccatactgatagccaaatggtgccatagacggtatagatcaaagcgcgtcgtcccaacagccgatagccgatgacgatcagtggaatattgatgcaaaaagttgaaatggaaggatcaacatgaaatagatgatagatgatcaaagagatcccggtaaccccgccttccgctaatcgattggcaatattgattttaacgaatcctagtgcataaatgccgcagccgatcgtgatcatcaacagatccagcagccttactttgttggtcgatgcctgcttgagcattgcatcacccgcctttcttaagtcatgttcgatcaattcagcttcccatgccaggcagctgactaaataactaaattctagatgcaaaccggttgtttagtcaaatcacgccgtttaacgatataatagaagttaattaaattgggaggcagtgggatgcagaaaaaaaggtggagcctgttattaggaatcatacttggaatgatgatgctgacgattccagcacgtgcggctacgaattcagcaacgtttatctttcatgatcgaatcggcagtcagcgtgacgagacgccattagttacagccgcgcaaaaagacggcgtgaagctaggcgttttgcatgcccaggtcagtgctcaaggaaaggtcaggctaagcggacaattgacaaaagaaacggcgcccgtaatcgaagtcgagtttgccaagcatgaaggcagctattctaaaactgcgcaatggtcatatcaagttatcaaacaagcacgggctaaatggcattttaagaccatgaacctggtgggaattggtactggtaatatgggtctgctgaactgtctgacgagatatgccgatgctggtcagctgccaagccttgccaaacaggttgccattgctggtccatttaatggcacgcatattcagccaaacgctgattcaaagctgatgaaaaacggccgcccctatcatatgaacatgctttatcatgagctgcttggcttaaaaaagacctaccccaagtcaagcgccgtcttaaacatttacggcaatcgagctaatcattcggatggaatagttgctaatagctcatcacgtgcgctgaaatatttggtaacgccgcgagccaagagttatcaagaacaggaagtcaagggtacgcgtgcaggtcatgatcagctgacacgcagcccgcaagtacagactgccgtaattaagtttttatggaaatagagtcaaataccatcgactaatgtcacgggatttccagcagaaataattgaagcgctgaatcacttgtcttaaggatgattcagcgctttttttgatgatcacggccgcgcttgatcaatagcccgtgtgaattctaaaacggtaccggatcgatgctttgtaacttttggcgattgcttgaactgcattttttgcataataatccagcttgagaagtttttagctgccattaaccccaaatgaccgcctgtttcactatcatgacgctattgttgtgactgtttgggcgatgagattactgattcgccagctgataatgtctgaaaatacttgtcgagatagactttgtggctgaccgtcataatcaggttacgcagcatgcgtttttgctcggtatcgtcatgccccactacggccagttcgttttgcaggccaaatacatatctcaaaacgttttccagttcttcgcaaaaatagtcataagcagtttgcgtgttatagctttgtcgctgaatccgaattgccagttttagattatccagctgcaggacgtttttagccacggcaataaacatcagctcggccagctgctctgtttgataaagcttcttttgcggccgcgagatcaaaccatgcttgacatagttgctgatcatggagctggtcagcttaacgtcgcctaatggactgaggcactgattcagataattggttgtctgttccagataaaggccaacgttaggcaactcttgatagcgcggcagtttaaaatcaatcaggtcttgggccattctttcttctctcttagtcatcatggtttcctttcacaaatcaattaaaaatattatagctcaggcttgataattaaactaatagtatcttatattctctttgcggtttttaaaaaacttgacgttggaaattggatcaactaaacttcaagtaaagagttttcaaaaaaccgctaatgtaatcgaggtaactattaatgaaaaagatcgtagttgattccggcgccaacctgctggaaaaatccatcaaaaacgttgaatgcgttaatgttccgctcaccctgacaattgaagatcaagtctggtctgacgatgaagccctcaacctgcccgctttcacagccgccctgcagcagacgagccaaccagctgcctcttcatgtcctaatctggcccagtggctggccgcttatggggatgctgatgaaatctacgtcctgacgattactggcaaaatgtcgggcagctataataccgctcagcaagccgcggcaatttatcttgaatcgcatcccgctgctaagattcaggtctttgactcgctttcggctggaccggcaatgcatttaatggctgaaaaactggctgagctgatcaatagcggcctgtcgtttgaccgggtcgtgatggctttaaatgaattcatgtcgcaagttgagctgatttttgcactaggctcactggacaatctggcggcaaacggtcggatcagtcccgtattggctaaagtggcacacttgatgaacctgcgcgtgatcggcacggcggatcaaggcagctttaagatgttgaccaaggcacgcggtccgaagaaatgctgccaagccatgatcagccagatggaacaaaaaggctatcaaggcggcgcggtcagaatcgatcacgtgcagaatcgagcagctgccgaacagtttcaacagctgctgttggctgagtatcctcatgccaacgtagtaattggtgaatgccgcggactatgcagtttttatgctgagcagggcggtctgatgattggctttgtcaagggcaatgagcagcaatagtcatcctttttaactgctaaaatctgtatcctgctatcagcaaaaggtattttacttaatatctaaaaaacgctatgctaaaagaaattcaaattgggggacttgaaaatgcacggatttcttttgaaaaagtggcggtggctgctgacgattttggtattggcagtaattggcggtggactttgctggtggtagcgagcccaggcagctcagcaattcgttcaatcaaagacgccgaccttcttttttcatggctatggcagcagccgccatgctgaagaacacatggctaacgcggccaagcgagctggagcgaccaatacgattatctgggcaaatgtcgaccgtactggcaaggttaccttctatggtcagatcaaggccaacgccattaatccaatcattgaggtcaactatgaaaacccgcgggaaatcaactatcatactgatggacagtgggctttcaacgttttgagcgcggctaagcaaaagtgggatttcaaaaagatgaatctggttggtcactcaatgggcaatatggacattatgtattgccttttggatcatcccaacagccaacagctgccgaaattgcaaaaacaagttgacattgccggacatttcaatggcttgaatggcgagaaccaggcatcatcaaagctggccgcggatggcaagccggccgtaaccaatcgtttctatcgtgagctgaccaagctgcgaacgacctatccaaccggcgtcaagatcttaaatatctatggtaatctgcaggatggctctaattctgatggcacggttcctaacaactcatccaaatcgctgcgctatctggtgtcgccagttgccaaatcgtatactgagcatgaaattaaaggtgcacgggctcagcacagtaaattacacagcaactcacaggttgattccctactgatcaactttttgtggaaaaaataatacagctcaaaacagtgtcagcttgttttcaagacggcactgtttttaattggtctagtttagtttaaaacgatgaatctgattataaatccaacgaatgattaaaataaagataaaaaaggcccgttttttcttttttaagcaactaaaatcgatcaaaacttgtgattattcgtttgtccccaaaattggtttacatgttgggcagctggtgataaagtcttaaaccataaagagaaagcaaattggtttttgaaaggtgtgttaataatgagaaaagaacacgattcacttggtattcaaagcgtcccacaaagcgcctgctatggcattcatactgtccgggctcgtggcaactttccagccgtcagcagcgtcaatgatcgggagctggtcaagaacttcctgcgcgttaagctggcctgtgcccgcgccaaccaaaaagcgagtcgttgggatgatgagcgtgttccattggcgattgtcaaagcctgccaggatctgttggcacactttgaggaatatgaagatgaatttgccatccctgcgatccaaggcggtgctggcacgagtaccaacatgaacgttaacgaagtcgttgccaaccgggcgattgagctgctgggtggccaaaaaggcgactatcagctggtcaaccccaacgatgacgtcaacaaatcacagtcaaccaatgatacctacccaaccgcgggccatctgaccatgattcagcttacggatcgtctgtcgctaacgctgaaaaaagtaattacaacgctcaagcagctggctgaaaaataccaaaccacgcttaaaatggggcgtactcaattagaagatgcgattccaaccacgtttggccgctcgtttcatgcttatgcctcgctgttggaacgcgacctcaaacgtctgaaagccgcccgtgatcagctgttgacggtacctttgggcggaacggcgattggcaccagcttgactgctacgcatgagtatctcaaaaacgtaatcgcggagctgcaaaatgccacgctgctgccggtaaaaggctgtgaagatctgattgacggcgtgcaaaacactgatgaatacgttcagctttcaggtgcctacaagtcattggccgttgatctttctaaaatgtgtaacgacctgcgcctgttgggatcaggtccgcaaaacggcttgggcgaactaaacctgccacagcgtcaagccggctcttcaattatgccggggaaggtcaacccggtcatccctgaattcgtaacccagactgcctaccaggtgatcggtcatgacgcaaccatcaccatggctgccgaagccggacaactggaactcaacgcttttgagccggtgatgttctttgatctgtttgacgatgcccgtctgttaaatggtgccttgcagacgcttaacgagaactgcttgatgggaattaccgtaaacgtggagcgctgtcggcagatggttgaatcttccgcggaagccgcgactgccctttccccgcttttaggctatgaaaccgtcagccatctggttaaaaaggccttaaaagaacagcggccgattcgtgaactggttggtgatcgtctaacaacggcagaattggatcaagccctggcgccgaccgcgttctttgttaaataacgttgcttaatgaaaaacaggctcagcagcaatgctgggcctgttttttgtcgatcatgataggttgaaaatcgactgaacctcgcgcagcacgccgtcatgatcgttatcataactggtgatgcggttggcaagctttaaaatatcgggactggcatttttcatggccacccccagaccggcttcctgcagcatttgccggtcatttgacgaatcgccaaaggctacgacactctttagctgattatgatcgtcattgataatcagctcttttagtccggctgctttgttgacgcccaaaggtaagacgtccatacagccaaagccgctataggttgcataaaccggatagcgctcaatcatttgttgggcaaaaccgcggatctggtctggcgtgacttgatgattgagccagattggattaacgttatagatcttatcgtcaacctgagtcagatcgtcaatgaaatcaatattgatcccaaacggccaggcttttaggtcagaaatcctggtgccccaggtatgactccaacccgtcagcaaaattacgtcaggcgtgaccggcaacgcgttgactgctttgatcagctcattgacttgtgacttagcgtgcgttctttcaaaaacgacctgccctttttggacgatcagcgcgccattgattgagataaacgtgtcaatcaatggacaaggcgcaaaacacttctttaaaaatcgatagctgtcaccactggccacgatccaagaaacgttttgctgctgcagctgacctaatgccgtattcaaagcagcggaatttagctggtgccgactgtcaagcatggtgccatcgacgtcggttgcgatatagcgatacatggcgatcctcccttcaatcgattgaggacgataatgatgattctgattaatagcaacgcttgcgcagacctaaaaagccaaagctcagcatccccatcagcatgcccagaatcgtcatgcccaagccattgcgattgccggtctgtggcaggagccgttcaaaaattgatggctcagcagtcgtaatggcgttggacgtgcttaagagctgactgtcgccgtgcttagcctgactgacctttgttggctcactggttgccttgaccgtaacgtctttaaggctgctctgcttgttcgatttgctgttggacgtcttggtgctggaagcggtgctttgcgaggatgacgcctgattagcatccttggcaacggcttcaatcgccatcagcagattggctttctctaaggcatcctgtgctttgttcaaggcatcgacagcatcgtttaattctttctctgcattgctcaggtttcctttttgcgtttcgacgtctttattggcattggctaaagccgtctgtgtttcattgaccttttgcagtgccgatggaatcagtccatagatatgtaagactccatagttgtccatcgcgacgccgacgtattcagtattggtactcagcagcattctggcatgactgttttgcgagtgagcatcgttaaacagcatatcccaaatcgagaccgtggcaacacgttttaaatcgcccatggtcttaacgattcgactgatgacattgggctgcttttcgttagcactcattagaccgatattttcccaatcagcctttacggaatcaattccctcatcgtattgataattaacggttttaaaaaccagctcgcgattatgatcacgggttacgttggtattccagttttggctattataggcataattaacgattgccaacgcctgggccaaggtcatgtcgttgtagatccaagccgtcagcccaaacttagcccgaatctgattgatcaaagcagccacataatcgctgatctcgctttgctgagcctgcgtcagcttagtaggatcaagcgtcatgctttcatcatccagtgtcggcacgacggttaaagcatccttgagactaggatccatttcgtatttctgtgttgcttgattgaaatgccagttttcggtaacgttgacttcaccaatctgattcttaacgttggctgacgcatcagatgatgaattgtcaaacatacttaaattggcatttttgatgtcaattgtactgccgtttaaagcggcggcctgttcagcactggatggcatttgtgattgagccaccgcactggcaatggcataattactctgtgcgacactggctgcactggccgcgctgctttgggccgctgtcgctgaatttactgctgccgaagctgaggccacggcggcagaagctgaatcgactttttgctgagcctgggaaacggcagcctgcgcgctggcaacggcacattgcgcatcggtagtcgaagttgcggcatttggattagtcgttgtaatttgtgcagtggaatttttgacggtatcggcatgagcttcctgccagccaccgccaaaaaacgctgcaccggcaatgactcctgccgttaagaccgattgttttaaatgttgattcttcatcttagattactcccttatcaaacaagttggtggtcaaaccaatctcaatatttactttaccgatttccacattttatgtcaaaccatgctcaaaacttagcaagaatctttctggcaaatctgatactatataatagtagaaacaaatagaaaagaggaaacacatggaagccgataagtatttgaaactgatcgatgaggaactgtcgcggctcccagattatgttaatgaatatcgccttggaaccaatcatgccattacgacgacctatcagtatctgactgagattcgtcggtttatggattggctgcgcaccagcggcctggttgatgccaagtcaaaccgagaaattccgacttcagttttggaacacttgcgtcgcaatgacatcatgctttatatcgatcatctgcgccatactaccaatgctcagggacgcgtcaattcaccgacctcaatcaatcgttcaatcaatgccctgcgcagtttgttcaagtttttgacgatcactgctgacaacaacgatggcgaaccctattttgagcgcaacgtcatgctcaaaatcaattcgttaaatgataccaagaccttgaactatcgcgcccatgctttggccgcgcatatgtatcgcggtcagatgaagtttgattttattgattttattgaaaaccgttatccaaaagtatgcgacaagcgctcattgcccgcgtaccggcgtaataaggaacgcgacatcgcgattgttgccttgatcttggggactggaatccgagtttctgagaccgccaacgtcaacgttaatgatatcaactggcagcagcagatgttggacgttacccgtaaaggtggccaaaaagacagcgtgccgattgctccgtgggcagtcaaatacgtacaggactatcgcgatctacgagttcagcgctacggggctactaaaaaggaccaggccttctttttgacgatctatcaaggaaaaacgcgacggatcactgccaatgccattgaacgaatggttaaaaagtattcgacggcatttggccatcccttgaccccgcacaagctgcgtcacactttggcctcggagctgtatgacgtaaccaaggatcaggttttggtctctcagcaattgggacaaaaaggcacttcggctactgatctctacacgcacgttgatcaaaaagagcaaaaggcagcattaagagaaatcagcgagcaggcaaaccaagcgccgcaaaatgaataatcaagcttctgtctggcgatggctagacagaagttttttattagcgttgattttacataatattcaaaacgtaatatttaatcgagatgccgataactatcattcagccggttctccatttaagctatcaatttggcatattggccgacccagattaaatcgtcctttctcctggcaacattgtctctgactttatgatccctgccaataataagctaggtcagaatgcctaaaacgactgttaaaattcttggcaaattcccattttcaaaatcgccgctcagccgcatctaaacgaccaactacccacgcagattaatttcagtgcgtctgagagctaaattttaaaattccccggttttatgctgatttctagtactaaagcgttaattgtaagacacttttgataaaagaatcttacactaaactgccataaatgccgttaaatcaaggtttttaatcagtagaaaaacacgtaagactgttatatgattattttgaaaaatcggcttgttgatttttagctgttaatcaggcggatttaagagcagacagccggtcaactcagtataattaacgtctacgatattatgtaaataaatatcggcttttaattttcatggctttcttgtatcattaaaaccattaatcaaacaaggatgtgagattttgaagaatatcgtgattattgcaactggtggtacgattgccggcagtggcgaaactggtcggactactgaatatcgggcaggaacggtagcagtagctgatatcttaaagagcgtgccccaactaggaaaattggccaatattgaaatgatttctttaatgagcgttgattccaatgaaatggacgagcagaaatggttgcagctgcgcgaggttatcaatcagcaggccgctcgtgatgatgtggatggcatcgtggtcacgcatggtaccgatacgattgaagaaaccgcctattttctaaacttgacgggcaatactgccaagccagtcgttttgacgggagcaatgcggccggcaactgctaccagtgctgatggtcccttcaacatctaccaagccgttgcgctggcagcagatgatcagacctatgactgcggcgtggtctgcctgttttccagtacgatctactcggcgcgcgatattgccaagatcaacaactataaaatcgatgccttcagcagtctgaacgatcatgccgcactgggatacatgcgtgacgccgaggtctttattaccagtcggccggtatcaaaacacacgattcactccaagttttcgcagcttgaatattcagcattgcctaaggttggtgtggcagtctattatgctggggccccggctgaggttttagaacgactgggacaagactgtgatggattggtagtaattggaaccgggagcggcaactattctcaagcctggcgccagaaactggacgcgttggctgaacagggcgtggttatcgtacgcagctcacgggtatcaaattcaatcgtttttgacgaaccgatttttgacccgcacgatcacttcattggggtcaataccctcacctcttataaagccagaattctgctgatgctttgtctgacccagactaacgacattgctgagattcgccagaacttttttaaatactgatctgctaaaaagcgacccctatctacatttaggagtcgctttttattttgacggtttatatattatgttaaattatcgctaaccaataaatcagcactgctttcttaacggcgcttctcatctttgaggctgcgcagatgcgtcgcgtcttgcccaacctccagacagcccagataagtgccatcttcacgacgaacggcaatgtattccaggtggataaaacgcttaccatgcagactaaaccaaaactcttcgcgatcactagttccctcatgaaaactggtaagaattttcttaaccttaggctgggccttgggaggatggcagttgtagacggatcgtccaatcacgctcttggtccgcggaaagatgcgatcaggaatatctgaataccagcggacctgatcagccgcgtcgacaaaggtcagatcaactggaagcagtttaaagatcgcgatcaattcttctggactcagctgaccggttgccagatcaattctggcttgtggatcaactggcaagttagctgctggttcttgatgatttggctgagtgatttggttaacctgcgcgtcagtggtggccagttgtttggcgatttcattaaactgctggcccagtgtggagttggtgggcttgtttgctgcatcagcgagctcctgttcggtaggctgccaattgattggcggtgagatcagcgtatagccgatcgaatcctcatctgctcgtatgcgggcccagtcagcaggcgtggcaacttcagcaagcattggcagcatgatgtcttcttctttaacgatcattgccaagacttcctgagcggctttttctacggctgcctcaatgatgtatttgtcgggcaacggctgctgatcgaccagctgacaggcttttttgatatagccgcgaatgtcgtcgtcaacgccccacatgaccttgggcggtgccgtaataccatatttatccattagtggaaacaaggtattttcttttctggcataatgccgatcgatggtcagcagatcttttagggcctgctgcattcgcttgagatattcgttctcaccgccatcttgctgccactttttaagacaggacagcagttcatcattgattaaagagtcaatgatcttgttttccagtttcagtgtgtagacgggatgtccaggagtatcaaaagcagcggttggcttgcccggcacgatggcatccttaaacagtgctacatgcacgttgcataatttttgaatttcacgtgggtccagaccattggcaatcagctctctttcggctgccgtaatctcaactacgtcaacgttggcaaattcttgatcaaataactgcttggcctgatcaaaattgccaccattgcttaaaaaagtcagaatcttgaccagctgctgctgacgctgatggagattatgcggttcagtcatggttaatcacctcatacccatgtcgtttaaaagtgtcgattacaaggtgcttatcaatattcatcgccagacagccccgattgatattgacgaaacggccaaccgtgtcaagcatcccaggaatcttgatcttatcaaagccggctccgaccatgatagcgataaaatcgggatcctgttgggccagatcgtgtactggctaaagtcaacggttttgatggtcatgcaggctacctccaattcctaactgacgacgtgctttgggcgacattctggcaatactccagactggataccagaccagctggacgcgggcatcacgaataccaggcacgttttgagcggttttttcgatgtcattttgcaaaaagctgcttagcggacagccgggcgtcgttaaactcatcttaatgcaacaacagctctgctcatcgacttcaacttcatatatcagacctagatcaacaatgctgacgttaagctcagggtcgattacagcagtaagtgcgtcccatacttgttgttcaactggggtcatctcatccctcctaatccatttctctgcgccctattttagcatgatcatctggtttccttgttaatttttttgttgctcaaaatcggcattgatcgaacgctcgccgaaaatcagcttattttttggctattctcgcctgttcgacgccccctagtatcagtcttatttaaaactaaaaagctggttggaagatcaagtgatttggcactatatcctgtcaagtatacaaggtaaatagataaaatttgattatacggcttgattgctgtaaagctcaaacagttttcaaatttcagctgggtcgtcattgccaaatagcccagggtccagttgtgttcctgctctaacttaagaatcgtttcaagcagttccgactgtttgtcttgatagcgactggcctttcctttgagccatttattatggcgttatctatcccctcgtttcttctttttaaggcctaagccgctcagcattcctgccaaccctagcagcaattacggcttggtttggtgagtatcccgcgcgatctggaacctgaaccgcttgccaagcagcctgtgaccattgcccgtaaactttggtgccaattgccttatctacctggactggccgactgattgtaactgactgcgcaacggtcttaacggtgccaatcgtattaattaaaatgtttgacttgattaaaattgttctaattcaattttcttcgttgattattatataaaatgtttacaaaaagataccagtagctataaatactcaacatctatatataagaaacataaaagtcagctgccattagtggcggctgacttttatttatgatgttattttttaatcaaatgatactcaaccagatattcatgagcaacttgactggcttttcgatgctgaaccgttacttgatagttcatctcctgcatgtctttttcagtaatcttaccagccagcttgttcagacttttaacaacctggggatgctttttggcaaacgaggccttcatcaatggtgctccttggtaaggcgggaagaaatgctgatcatctttaagtaccttgagatgatactggcgcacttgcggatccgttgtatagccatcgaccagattaacgcggccagcagcaattgcctgatagcgcagcgcgggttccatcgtctttacctgattgaagcttaagccgtatgctgatttgaggcccagatagccgtctttttgattggcaaagtccggatcaaagccggccgtgatctgatcattgattttagccagatcgctgagcttggtaagctgatgttccttggcaaaatcagcagtgacggccaggtcgtagccattttgatacttcatcggcttcagatacgtcagatcatactcctgcttcaacagacgccgcgcccgctggtaggtcttaaccggatcatgcggcgtcgatcgttggtcatgaaccagcgactgtaaaacggttccggtaaactcaggatagatatcgatctgatcgttgcgcagcgcacggaataaaaagctggtcccgccaaagttagcctttaattcgaccttggcatgcggatcatcgtttacaatcaaatctttgtacatgtggattaaaatatcaggttcgcttcctagcttaccggcaatcacgattggctccgatttactttgaaagctgctccagcctcgccagccaccaaatccgaccagagcaagcgtggcgacgacgattccctgtttcaaatgtttcttagaagcaccgacatattttagcagtgccgacatcaaaagcgccaacaatgctgacagtcccgccccaatgatcagataggcgttgttgttttgattgatccccagcataatgtaggttcccagcccaccggcaccaatcaaagcagcaagagtagccgttccgataatcatgaccaacgagatgcgaattccagataagatcacgggcagcgccatgggcaattccagccgcgtcagctttttccagcgcgaaaggccaaatgccgtcgcggcttcttcaagattcgggtcaacgctgcgcagtccagaataggtattttgatagatcggcatgatgccgtaaacgaccaaggcaatcaaagctggaacgctgccgatcccaaccagcggaatcagcagtcccagtagcgccagactggggattgtctgcatcacgccggccagctgcaagacaatctcgccggcatgtcgactgtttttcagcgacactgccaatggaatcgcgatcaatatggcaatcaccagcgcccaaaacgatagcgacagatgctcccacagtgcttgttcaatctggcttttttgagccacgatcgtattaagcaattcagtcatgttaccgatcctctctttgtcctaaataatgcagcagatcagttgtctgaatttgaaaatcctgcccctgatattgaaaatgaagccagccagccgaatcaggcgtgagacttgccagttctgctaccgtagcaacggcgacagattgatcagtggctgacgttttttgcactagttttgatgataaaagcgcggtcattgttcccaatcttggtcgcgccgttgcaaaaaagtcagcgacaaactgattggccggctgttctaaaatctcatttggcgatccaatctgctgcagctgaccattattgatcacggcaatccgatcgcccagccgcagtgcctcttgcatgtcatgagttacaaaaacaaccgttgtccttgactggcgatgcagatttaacaacagatcctgctgttgagcacgcaaaaccggatccagcgcgctgaatgattcatccatcaagatcagctgcggttgagtagccattgaacgagcaatcgccacgcgctgctgctgaccacccgaaagctcatcgggatgccgatcgataaaatcgctggcggacagaccaacctgatcaagcagctctattgcacgcttgcgccgatcgtttttattgacgccctgctgctcaagctgaatggcaatgttttcgccaaccgttaaattagggaacagactgctgctctgcaatacgtatcccatatgtagccgcagctcgcgcaagtcatagtctttgacgcacttttcattcaaatagacgttgccggcagttggcgccgtcagccggttgatcattctaagcagcgtggtcttgccgctgccgctaggaccaactaagacgaacagctcaccatcgttgatcgttaagttaatgtttttcaagataacattttggccgtattgcatgccgatcgcttcgtatttaatcaatctaatcaccgtattctctgtttgctgtaaccattaaagtttctttttgcattctaagccaatccgctctaaaatatacatttttacctacgatttaaaaaatttcagcctttagtaggtaaagccaggtcgactgaatatacatttacctactttcggccctaaagtagcgaatcgtaggtaaacttaaggtctctgtaagctaaaacctgattttcttcacaaagtcaggcccgaaatcgtgaagtattgtactcataatcatgctggcgacagtgccgttttcaatgttagacgaaacaccgtcacgcttgaaatcaaaacagcgccgaatcgaacttgattccgcgctgtttttactattcggctggtagcttttggtacgcaacccgcttgattacttcagcctgctccggatacttagccaacagctgatcccgggtaaacagttcaaagtcatgatagtcaaagccgggcgccacggcacagctgaccagtccaaacgatgaagcatccaaaacctccgagccaaaaatcgttcccgctggcacccggaactgcagctgttcgtcccgtttaatatcacggcctaaatgtacggcctcataggtgccatccggataaaagcagtggacgacaattgatgagccatcatggaaataccatagttcatcatgaagcagccggtgcagatgcgatggcgagcctccatccaggataaagtagatcgaagtgtactcataacggctggccagggatgtagcgtcataacgcgtcttggcactatgataaacttgacgataccacccgccttctggatgtggcgttaggttgagcttttcaatatattcgtctttagtcggcatggcatagacctcacttttttcctttcattgtagcaaagttcggccatttgcgcgggctgatcgtcaaaaattatcctgcttattttactggggccttaaaaagatcattcagtgcctcagacatggttggatgcgtaaagatcatgtcgcgcagcgtttcgtatggcagatccgccttcatcgctagcgcaatcagattgatcgtttcatgggcctcagcagcataaagcgtcgcgcccagaatccgatgcgtgtcgcgctcaacaattgccttgtagattcctcgctggtcctctaacacgcgcgccttagggatggccttgaccggcagtttgaagaccagatagtccttaccggcagcctgggcctggcgctcattgattccgacgtttgccagcggcggtgtcaaaaacgatgcggtcggcaccacattgcgatcagcagttgtccgcttgccttgaccaaacagctggtctttaacgatccggaagtcgtcaagcgagatgtaggtaaacattggcccaccattgacgtcacctaaagcccagacgttggggaccgtggttcgcagatattgatcaacttgaatggcatcgcgcttggtcaaggcaatgtcggtattttctagtcccagtccatcgatgttgggacgtcgcccagcagctaccagcacggcatcaaactcggtctgccgtttttgaccagcttgttgataggttaataagacctgctgcccgttatctgtcgcgctggttaactcagcattcagctcaatcttgatgccgagattggcaaggtcgttcgttacctctgccgcgacatctgcatcttcccggcccaagagctgagcatgatgatcaagaatggttacctcgctgccatatgaattaaacatttcggcaaattccagaccgatatagccaccgccaataattgccaagcgtgccggctttttggcaagttccatggcttctttggaactgacgatgcgctcgctgggagtcagccccggaacttttggccagaccggcgtggcaccagtattgataaagacgcgctcggcagcaacttgtcgcgtagtaccatcagccatggcgacttttagctcatggttaccgacaaaactggcctggccattccataccgttgccaacggctcatccgcaaccatgtgatagtttttgttccgcagctgcttggtcatcgttcctcgtttggcaaccgcgtcagcaaactcaagatgacgctggccattgataatcatatttttagacggcaagcagccaacgttgatgcaggtcccaccatacatctgattcgagcgctcaatcagcagcacttcttcatcatgctgtgccaaaaacttagccagtgtcttacccgccttaccaaagccaattaccacgtttttaaatttttccattgccaatcatcctttcgccaattcaaaataattaatgtttcacttactataaataagtggcttttaaaaagcaaccaatctgctcaaaaatagccaataaaaaatgattccaggccagactcttataaaagagcggctcagcaccatttcagaacaccaattaattaagattaagctgctttaaccaggcatccatctgggcgtcactgtttaaaaccgcgcctggcagaacctgaacgtcagcgttgttttccttgacggttcgttccagatagctttgggcgcgttcaaaaccagaactgccggaagttgcaaatccagccagctgcttgccattgagcggcagacgatcaatcaggtcggcaatcaagcggggtggaattccccaccagattggaaaaccgatcagtaccgtatcatagtcattgatagcgggcagatcgtctttaattgcaacccggctggcacgctgatgctgttcaatggacgtgcgtgagttaggatcatgccagtccagatcagcggctgaataaggcttttcagcttggatcgcaaacagatccgcgcccagctttgatgcgattttctctgcgcgctgcttggtcgtattggtagccgaaaagtaaaatacgatacttttgctcaaaatagtcagcccctttcatcttacttacttttagtataatgctaaggactgcgaagttaaaatatttattagcatgcaatctctgcatcagatcaattgctgaaaagttatcctgttattttacaattattcaagctgtttgattttatgccgactttcaataatcatccagagtaccaagccgatagtaattacaataattaccaggccggtcgtcatcgtcataagctgggtataacttttatcatgactataagcggcaagcatcagcgtctgcagattatacagtgagatcagcgcggtaaccataaccacgtttttatcggtctttaagagaatcgtggcacggcggggcttggcaaacccacgaagcacgttgcctaagttgataaatgtatatagagccacgaccagcagcacgttttgtgaaaaatgcgtcgttgagctttcttgatgtaggatcagaatcgtcatgccgcttagaatcggcgtaaataaaagcagcagtcagccaagcttagacgagtaagcggtgaactgttgccgctggttcgaatgactcaagatcaaacgaatcaaaaacaaaagcagataataaaatacctgggtaagaaaccaggccgaatgatacaaaacaccaatcaaaaacgtataaagacaatataaagttgccacaatcaggccaaaataattgctggcatgatttttaattttttaagcaaatggagtgcggactggtttgcttagttctatctgaatataaagcgattgcttgtgcaaagacatatttattcaacaaatctcaatcagtagtttccaataaatacccaatttgacaatttaattttttaatccataatgtgatttaattcactattaagacatatttaagatttagttcaaaatcaattcaaatattctcgctatactttagtcatagtcgaaacagcaatgacaaggaggatcatcatgaaattcagcccgtcattgatcatcgctattacggtatttgcgctcagtattttggcagtcggccgcatcttagttggcttgatcgtatcaaatctgcatcagatcaacagcattgatcggcagcagcttagcaaaaagccagctgaccaccgtttctctgtgataattcccgcgtttaacgaagaaaagtttattcggcggggcattgaatcagtcttaaggcagacttatcctaattttgaggtcatcgcggttgatgatggctccagtgataaaacagggatgattttggatcaattagccagacaacatcctaagctgcgtgtcatccatcaacataatcaaggcaagtcggttgcaatcaatcatgccttaaaagaatttgcaaccggtgatctgattatggtgcttgatgccgactcttatttgacaccaaccgcactgacaaacatggcccggcgttttgatgatcctagattattgggagccagtgcgaacgttcgcattacgcgtccccataatctattggaatacgtccaaaaagtcgaatacctgcttggttaccggctaaaaggatctgaggaggttttgagtatatcattggcggtattggctccacttttcgcaagtcagcgatgctggaagtcggtggctatgacactgattcgatcactgaagacatcgactttacgatgaagatgatcgaccatttcggcaacagcaatcgtcaattcggctatgcggatgacgttatcgcctatacgccgccggtcagccgtttttctcagctgctcaaacagcgctatctgtggaaacaaggtcgttttaaggctttgttcaagcatcgccgcgttattttcaatcgtgatgccaagtacactttctcactcgctttttggaaattgccaaaagttttctttgaagaatttttaatgctgattgacccactgctgctgctttggattatcggcattattcatcactttgccgatttttcaacgatctttgcgatttttggcctctactatctctttgcgatggcaacgtttataccagaagagcttaaattctgggaacgaatccgactgatgatggtcgcgccgctagcctacctgattctatacgtgatcaatatcgttgactggatctcactgatgcgctgcttattcaacatgaagcgaattgccaacaatgaagataaaacggctaaatggcagcacgttgatcgttaaaaacgactgacaagccaataaaagcctcaagttctgaatttaatcagcacttgaggcttttttcacgtttaatttttttgatgacgctgcactgccttgacgatttcaacaatcaaaaccatcaaaaggccagccgctattacgatgccccattgagcaagatccaattccgtagtatgaaaaattggatttaaagttggaatgaagatcgtaccggctaaaagcagtgttgagcttaggattgcccagttaaagtagcgattcctaaattctcctgtcttaaagatcgttccctgtaacgacttgcagttgcaggcatgcagcagctgaatcaggcctagggtaatgtaggccatggtcaatgcatcagcatgaatcaacgcggatccttgatgaactgggtagagaatacccaaagcgtaaacgcccagcgtcaagagtccttccaaaatgccttggtagatgatgttgaaaccaacgccatgggccaaaaagctgccttgattgccccgtggccgatgtttcataacgtcaccttcagctggctcaactcccagtgcaatcgccggaaaagtgtcagtaaccaggttgatccacaaaatctggaccggtgccaaaattgaccagttcatcatcgtcatgatcaaaagcgtcaagacttcgccaagattggcggaaagcagatactggatggctttttgaatattggcaaagactttacgcccttccttgaccgcagcaatgatcgtagcaaaattgtcatcagctaatacaacatcagccgcgtttttagaaacctctgtcccagtaattcccatgccgacaccgatatcggctgtcttcagagctggggcgtcatttacgccatcaccagtcatggcaacgactttatcatgtgcctgccaagccttgacgatccggactttatgttcaggggcaacccgcgcgtaaaccgagtattgggcaacttgatccttcagctcctggtcactaagttcattcagctcttgaccggtaatcgcgccagtttcatcaccaggctcaatgattcccaaacgttcagcgattgcccgcgccgttgtcttatgatcaccggtaatcatcaatggccgaataccagcttccttagcctcttgaattgcggccttgacttcaggacgcggcggatcgatcatccccgacagcccaataaagatcagtgactgctcaaccaacgctgggtcagtactttgacattctttttcagttaatggccggtatgcataaccaagtacccgtaatgcctgtttagctaaatgatggttggttttaagaatctgctcacgatccgcggccgtcatctcacgtacctgctcaccatcaagaatgcgatcggcacgcgttagcagttcatcaaccgcgccttttaggtaaagagttggctgtttatcattaacggctactgacattaatttacgttcagaatcgaacggccatgaattaaggcgtggatagcgctgtctaaactcatcgatatcaagccctttatcaatataaaattgccacagcgccgtttcagtcggatcgcccaataattctttttgactgcctcgctcagcatcattagccaggatcattaccttggtcaatggtgagtcggcatcaatcttaaaatcaggtgcagctgtaacttgaccattcagcatcagctgttcgatcgtcatctgatttttagttagcgttcccgttttatcagacgcaatgatttcagtggctcccagcgtttcaacagcctgcagcttacgaatcagcgcgtgccgtttagccatggcttgggttcctaaagccagcgtaatcgtaacaattgctggcagcccttccggaattgcggcaaccgccagtgagatggcagtcagcagcatatccagtggtgtttcgcgcttggtcagcatccccaacgcgaaaataatgacggcaattgccaacaccagaacactgagaatcttactgagatgggtaatgttacgctgcagtggcgtgacggtcggttcggcgctgttcagcatctgggcaatcttgccaacctcggtatccttaccagtagcaactacgactgcctcggccgtccccgccgtcatactggtattcataaagcccatattatgctgatcgcctaaggcagccgattcagcatcaattaccgcttcatccttagttacagcaacagattcgccagttagtgctgcttcttcgactttaacgttttgcgtctttaagaaacgaacgtcagctgggataatgtccccggcttccaaaagaattacgtcgccaatgaccagttccttgctggaaagctgggcaatttggccatctcgtctgacccgcgtggttggcgtgctcattttttgcagcgcatcaatagcattctcagccttagtttcttgaaagaccccaaatgcagcatttaagaccacgactaacaaaataataatggtatccgaaagttcaccagcaaaagccgctacaattgccgctacaattaaaatcaaaatcatcaggtctttaaactgagcgatgattctttgcaaaagcgtaactttcttcccttgcggcagttcattaggaccatttttctgcagccgctccatggcctcagttgtcagtagcccttgtggcgttgcgtgaagtcgttctaaaacctgcaaggtggtttgacgataaaattggtctttcatggacgttaaacccctctctgtatttgatacttcttttttacaacaactattacaacacaagcataacatttactagactaatatggtaggggttacattggcagctttagtgaaaaaagcatagcgaaatattccaaaaatctcacagccggttgtcaaaaaagaagcaccctattaaaatttaaaaaaaacgaaaatgaggcttttccattgactaaacctaaaatcgcgtttatctgtacgcataacgcttgccgcagtcagattgccgaggcgctaggcaaaaaacttgccggggatgtttttgaaagctattcggcggggaccgcaatcaaaaatcagattaatcctgatgccactcgcctgctgaaaaaaatctatggcatcgatatggaagcagcaggacaatctaacaagacgcttgacgcactgccagccgttgacggtgtcgttaccatgggctgcggcgtgaaatgtccctatctaccggctaaatggcgggttgattgggagctaaacgatccaactggccaagccgatgatgagtttattaaagttatcaagcagattgaaaaaaatattttggcgctcaagaatcagctcaagcaatcaccgcgttaattttttccgctaaacaaatcatttaatcgtcccatccaggcatttatttatgcttagatgggacctttttgactgctgcccagcatttttactgattcaaaatcaacagtcgcaagcgctgccattaacaacttttagctggtcagcgacacataacgcttaattatcagcgttattgatttaagaccattaacttatgccgtttaatgcgttaagctttgtccaatcttaaaaatcattttgaaagcgaggttttttacatgcaagcaacgattcaaacaacggtgaaacgaagcgaacgcaaaattgccagcaacattttaaagggttctttgggcaacatgattgaatggtttgactggtatgtctatgcctcgtttgccatttatttctcgggggcctttttcccagctcataatcaaacagctgaacttttagcaactgctggtgtttttgcaattggctttttcatgcggcccctgggatcattcgtcatgggacgctttgcagatcgaaaaggtcgccgcgccgcattgacgctttcggtttcaatcatggcaaccggttcattggttattgcgttggtcccaacctatgcgcaaatcggtatctggtcaccgatcatcttgattgcaactcgattggtacaaggtctttcattaggtggtgagtatggaacctcggcaacctacatgtcagaaatggcatccccaaatcggcgcggtttttactcatccttccaatatgtcacgctgattggcggtcaattaagtgcactgctcgtacagattattctgcaggccatctataccagccaacaactgtatgcctttggctggcggattccgtttgccattggcgcggctggtgcgatggtggtattatggctgcggctttcaatggaagaatctgatcagtttaagtccagtaatcgcaacaatcgccaagctggaaccttgcgtcttttagcccattatccaaaacaggtactgacggttgtcgggatgacgcttggcggtacgatcagcttctatacctacactacgtatctgcagcagttcatgatcaacacgaccggtctttctaaaaaaacggcagccatgatcaactttgtggcgttgctggtgatggttgcgttgcagccgctatttggtcacctgtcggatcgaatcggccgtaagccactgctgattttctttgggattggcggtacgctgtgcacggttccactattcacgctgatggccagcgcatcaactgctttggaagcactactgttaatgattgtaggcattgttatcgtttctggctacacttcaatcaatgccatcgtcaaggctgagcttttcccatctgaaattcgggcattgggcgtagggatgccctatggactaaccgttgccttgtttggcggtaccgtaaactacattgctttatggctgcgttcgattcacctcgaatctgccttcttctggtatgtatccggtgcagtatttatttcgctgctggtctatgcgttcgtacttaagccaggatccttgattgatgaggaaatgactgaatccacgactactgactaaacgcttgcttttgataagcataggtaagcaagcggtcatcccaagactaagattgccaagtttctggctgaccataattaaaagagatcaacgaagtaattgatctctttttttattttgcccagttcagctattctttttccggtttaaacgacagcttgatcttgccatcaagagtattgctaagcttttgcagatcaaccaggctgacagtttgcgccttagcttcctccaatgcattaagctcagctaacggaacgccagccgcatgactaagggtttctcgtgtccagcctttatcttggcgcagtttgatgatgcgataggccagtttggcagccggatctaatttaacggcttcttccagtggattttggtgcgcggcagcataaatcaggttcgtcatcttcttttttgtcagaccgcccttgacatgacgggcaaagaaatcaaggttgtcttgaccgatcttctcacctaggtcattggttaatttatgcattgcctgataagaatcataagaattgtctttcagctcttcaaaacgggcttccagtcgtttacggatgtcttttttcttcatgtccattttcctctctgaattaattaagctataggatatcactttatcaatcctttgtaagcggtttatccgaattgttttttaaaatcccatgcctgctgacatgagattccttaaccactgagggctagcttgcccctgccaaacaattgcgcttggcaatcgcggaggtgaggaatcgaacctcacagcttggagcattgcaaataacagcgtttagaccggcactccgcaaatttgtaaatttttgaatcattcgttgtcgcatgtatgcttggcgaaatccacaaattcacaaaatcttcaaaattcatcttaacgcatcatcctaattttgtcaaacagatgttcgtaaaattaaaaattccccacttcattttggaagcagagaattggtcttgccgatacgatttgacaaaggctccaaagtttaactcgctgataccggcagattcaaaaagctgataatctcttcagcaatggcagcaggactcaagccatccgttttaatggtcagatcggcacaggcattgtagttgacctgacgctgggcctgcatgtcggcaatgcccttttcgtccagcgactgtgccagcggccgaccactgtcaccgccaattcgccgcagcgtttcagtcgcgctggccttcaaaagtaccaccggcgtcggcgtgtctttaagcatggccaggttgtcagggcgcatcggcgttccaccaccggttgccaaaattccctggtcagatttcagaatatcggctaaggtatcatgttccagctgacggaagtatggctcgccgttttgggcaaagatgtccgcgatcggcatgcccgcgcgccgaacgatttcaacgtccaaatcagtaactggtgtgttcagcatctcacccaacagccgactcacggtagttttgccgcttcccataaatcctatcaaaatcagttccattttgcttcctcctaatgatcgagtttttctcggtcagccttggcttttgaaaatacggcaaaaagcttttcttgatcatctgcggcgattgcctgccgtagtgactgcagctcgtttagatattcgtcaagctgttgaacgatcagctcacggttgttgtgcatgatcgcgctccacatggtcggatctgacttggcaattctggtcgttgacttaaagccccccgccgccagcttcaaaagctcgcgatgatccttaaaagtagccgccgattgagtcatcagagcagtcgcaatcacgtggggaacatgactgagctgcgcgacgatcttatcgtgctgacgagcatgaattaagtaccaattgacgttcagaccgcttaaaagatctttaagtttgctaactccctttgagccgctggttggaatcaaaaagtagtaggcatctttgaaaagatcaactcgaccagcttgaatgcctgattcatgtgaaccggccattggatgcccaccgataaagatatcgccgcgctcaatcagcggctgagcagcatcaataatcgtctgcttggtactgccaacatcggtaataatcatccctggctttagttctaaccgtgccagatcatgcaggtcttttacgattgccgatacgggcccggcaaggatgataaaatcagcctgatcagcttggtatagattggtccccgcgtcatcaatcagcccctgttcaatggcaaaatccagcgtggcagttgaaatatcgctgcccacaatgcgatattggggatgctgttgccgaatcgcgcgaatcagcgtactgccaatcagccccaatcctttgacaaacaccgtcgtcatgccaggtcgcctcccaacagccgttctagatcctggaagaatccagggtaagaaacgctgactgcatcagcattagcgagctgcagcggtcgatccgctttaagagccgcgatcgcatccatcataccgatgcggtgatcaccatagctgtccagctgatcattattgattgcccactgacttcttcccttgatgatcatgccatccgtcagttcttcgacttcaacgcctagtttgcgcagttcggcgactacggtttgaattcgatccgtttcttttacccgcagctcttctgctccccgaatcgagctggttccatccgcgcaagccgccagcagcgccactaacggtaactcgtcaatcacggccggaatgtcttcggcttcgatctgaatcggtttgagctgactggtcgcaatcgtaatattgcccaacggctcgccatcggttggcagtgcttcaatctgcagatccgcgcccattttctgcaatacagtgatgataccggttcgcgtgggattaaggttgacgcgttccagtctgattctagagttcgcaacgattgctcctgccgtcaagaaaaaggctgccgatgagatgtcccctggtacttcaactgtttgtcccgtcaattccggttttggcacgacatgaatcgttttttgatccgtggcggtttcgatattggccccaaactgattcagcatgatctcagtgtgatttctggttggcagcttctcgatgatggttgatggcgtatcagcctgcagtgcagcaaagatcagcgcgcttttgacctgggcgctggctacctgcatttgataatgagtgccatgcagcttttgtccgtggattgttgccggcagcgtcccattatcggtcagatcgattcgcgcccctaaatgactcagaggttcactgacccgtttcatcggacgcttctgcaacgaggcgtccccaaagagtcgcgtctcaaagtcacggcccgccaagatccccatcagcaatcgggtagtcgtccccgagttgcccatatcaagtggttgagcaggttctttaagcgcgtcgattccgttgccgtagataatgacagtttcgccatcccgctcacttttgacccccatggcattaaaagccgccaaagttgacagacagtcgtcaccagccaaaaaatgatggattaccgttttgccctgactgattgaaccaagcatgaccgcccgatgtgagatgcttttatcgccaggaaccgtcaatgatccgtgcagtccatggggtgccgtgactagttttttcatgacgtttcctccttagtattcgcgcatttcctgacgccaggctgcgacttcttcttgcaggcgttccagactagcagattcaaacgtatccgtaattgccttggccagttcgatggcaacgacattttcaaccaccaaagatgccggcacgatcgcggtcgtatcagagcgctcgacattggccttaaccggttcatggctggtgacgtcaacggtctgcagcggcttgtataaggtcggaattggtttcattgccgcgttgatgataattggcatcccattagtcatcccgccttcaaaaccaccaagatgattgctcaggcgtgagtagccggtttcttgatcccagctgatctcatccattacttgactgcccagccgcaccgcgttttcaaatccatcaccgattgagactcccttcatggcattgacgcccattacggctgcggccagtttgccatctaatttggtatcccagctgacatgactccccagaccagctggcacgttttcggcaacaacacggatcactccgcccagcgtatcgccattgcgcttggtttgatcaatcaattgatgaattgcctcaactttggtgttgtcaatgattcttaaatcattttgggcaatcagcatttcaattgccttgacgttatcaggttggttgccgcgcgcatcaataaagcccacctgctgtacgtaaccaacgatcgaaatatccaatgcggccagcaactgctcacagatattgccgactgcaaccctcatggccgtctcgcgtgctgatgatcgctccaaaacgttacgcagatcacgatgtctgtacttcattccgccaaccagatcagcatgtccagggcgcggatggttaaccttgcgcacggtattttctggtgtggctggcgatgtcggattcataatttctgaccaatgcgcatgatcacgatttttgactgtcaatgcgattggcgagcccagcgttacgccatgacggacgccaccgacgatctcaaccgtgtcatgttcgattttttggcggttgccgcgtccataccctccttggcgagcggccagcgcttggttgatctgatcgacatccaagtgcaggccagcagggattccctctaagatccccgtcagctgtggtccatgcgattcaccggcagtcaagtagttcataaatgttcctcttttctaattttcctgttccgtagttaagcagttaaagactattgttaaacattattccagcttttttgcctcatccataatcgtttggaaaatggcttgtattgctggctgcagcgcttcattatcgacttttgcttttagtcggttcaaaaccgcttgctctcgtgctgcgtctttgattggcagatgggcggtttgtttgactcgccctacttctctgacaacgtcgaatcgctgcacgatcaattgcagcagctgttcatcgatatgattgatctgtgtgcgcagatcgtttaattctggattttccattggttaccctttcttttcagcagccatcacaattgcagcgactaaaatcccaattccagccattaccagatcaccagccataactgcggccatactgatgtcggaaagcatcccggtaatgattggtaccgtaaacgaagcaatgctgccgaagaagtagaagacgccagtaatcatgccgcggtgcgttgggtaaagcttcatgaagatcgtcaggccggtctgcatgattccgctggccgcgctgaaaccgaatgcgaacgaggcaacctgcatcaaaagcagctgtccactttgcatgatcaccaacaggtctgctaaggcaattgcgtttacgatcagcagcaggcgcgattccttaacgttgcgtcccaataaggcaaacagtaccaaaactccagtgattgagccgatactgtaaagcgaaagcaagaaatgggccgcgccatctgacatgtgcatcgtctgctgagcaaacatcgtgatccattgcgtaaaccagatcatcagagccattgaagagtagccgtagacaaccagcgcgccagtcatgacttttttggcaactcctttgatctcggattcccgctcattaacggcactgccatcagcttgattggcaactgggaacttaagcggcagaatcagacagaagttaattaccagcaaaatgaccattgccatgaagctccagccaaaccacattccctggccagccaggatcgtaaccagaattggcaagatgaactcaccaacggaaacgaaggccttgatcagaatcgtgtaggctccattaccgccattcatctctacaaaagtcgtgtaggtaccggcatcaagcgatgaattggcgaccccagctaggatggcaaagaagtaggcaatccagatgtttttcgccattggcatgccaagcgcaaataccgcgtagcagaacatcccaaactcaacaaaaaacttgcggctgatcttatccgataaaaagccggtaatcaagtatgagatcaaacgaccaatcccgatccccgaaattacgaaggaaacgattttgatgggctgattccaagccgtgcccagactgttcatattctgcgccaaaataatcatgcccatcccatgtaccaagtagttgaggtacaggctgacggaaagacgtcttttagcagttgtatcgatctgattttttgcaatctccataaataatcccccttagtcaggtactaaaaaaagtcagccagttttgagacgtctgcctcatcaatccagctgaccttctgcacaatactttttatgaagggatgtacttaaggttggttatttaaagaagaagtaagcttcgtctttgctggatttagagttgcccggcaaagacgcgccaaaatgcgactctgctcaagcgctgaacgtctcgcgttcgcacctgagcagcacgaacgctatccgaaagcataataagcaaagccgaaataaaacgctggtcgattttggcattgaagtttcataattacttcccctttcaataatttgttgttaacattaaaacactctaattttatctcgtcaacctctaatcataaaaaagattgattattttttatcccttggtattttagtcttttttaacaaataaatagtgattgattctcatttttaactaatcaattacctgaacaccttccgtatcaggttcaatttccaataatggatcattaaggccggcctgtaaaagcagctgcttaaaccgcggaatcccctgtttatcgataatcgtcataacggtcggacccgcgccgctcagataggtagccagcgcaccggcttcatggccgatttcgcgaatcttggccagttccggtaccagtttggcgcgcggctgttcgtgaaactcgtcagcctccatcaattcaccaaccagatcatagcgattggcaaacagtccggccaccaagacgttggcaatcgcgctgccatgcgttgcctgttttaatgtcaggctggctggcagggctgctctggcatcggcagtctttagattatatgacggcacataggcagccagcgcgtaaggaagcaatggcgctttaatggcgtcaaaatgaccattgacattggtaccaatcaccaatcctcccaaaattgccggcgcgacgttatcgggatggccctcaatctcacaggcaattgctactttttcatcgttgctcatttgcagctgaccaagcgtattggctaattcaattccggctacgatagcactggaactgctgcccagaccatgagctaccggaatggccgactgcatttttaaatgatgcggcggcaggtcggctttgatttttaatgccgtatcaatgatcatattggactggtcatgcggcagatcgtcaaagtcgtgatcgataacccattcatcactgggttcaagtacgtccagcgtaaggtaaagcgaaacagccatcccaattgaatcaaatcccggtcccagattggcactggaagctggtaccttgatctgcataatcattccccctagttttccaaaaccttgtaagccgcattaagcttaatcgaatcagcctgctgcaattgttttttgagctccgccaattgactttgtgacagctcgtgcgtgattacggctacatgagcaatgccttcatccttaattggtgcctgcacgatctgactgaagctggctttaatgtcagccatgattcgggtaaatttaagcatctgcccagaaacgtccggcatcgtcaatgaaagatagtaagggtagcgcacgttgtcaggatcggccggtacatactcattttgataagtattgaacgcatggccgctggtacccatgatcagattcttgacttctgaagtaatatcactcaagacactgttggcagttggcaaaccaccggcacctggcccataaaacagcgtatccccaacagccttgccagtaaccatcacggcattgaactcattgttgatcgttgccaatggatgatcttctggcaccagggttggcgctacatcaacaaacacaccgccattgatgaccttggctgagccgaccagcttgataacatagcctagtgactcggcttggctgacgtcatacgcattcagagtatcaattccttctgttttgaaatcatcaatcttaagctgtgttccaaaggcaaaatagctcaggataatcattttataagccgcgtccttacccgtcacgtcgttggttggatcagcctcggcaaaacccagctcctgtgccttcttcagtgcttcttcataagtccagtgcttttgattcatctgagtcagaatatagttggtcgtaccattaacgattcctttgacctcaagaatattatcagccgcaaaactattgacgatcgtacgcagaattgggatcccgcccgccacgctggcttcatacatcagatcacagtgattttcataagccagcgctgccagttccggaccatacgatgcaatcaagtctttgttggcagttaccacgtttttatgtgctcttaacagctgttcgatatactctttggcgggatgaattcccccaatcagctcaacgacgatctgaatttcttcatcattaagcacttcttcaaatttagtcgtcagtttggtaaccgtggctgcgttttggtgcttttctggatgacgaaccacgaccgtcttgactgacagttcccgaccaataatattgcgaatcttattctcattgttttcaatcatttctaaaacgccagagccgacggtacccagccccagcattcccagtttgacagtttccatagcgctgctccattctcggtagtttttaattagattttcatatttatgattgtaacatggactatccataggctacaatatttaaaagaattctaccaaaccactactgtattaagaatggaggatcacaatgaactatcgcagtacgcgtggcaatgttaaagatgcattaaaatctagtgacgccgttgttcaaggactggctccggatggcggattgtacgttccggttgactttcccaaaccagcgtacgatctggaaaagttgatccagctgccctatcagaaactggcgcagacgattctgcaatggttttttaatgactatcctgcagaacagctggctgatggcacaaccaaggcctatgccgaccaatgggatgacgattcaatcgcaccattgagtagacaaaaagccggttttaactatctggagctatatcatggcccgaccctggctttcaaggatattgccctgcaaatgctgccgcagttaatgaccaaagcaatcaagctcaatggtgttgatcgcgacatcgtaattctgaccgctacttctggcgacaccggcacggcttctatgcgcggtttttccaatgttgatggcacgcaggtaatcgtcttttatccagatggcggcgtcagtccagttcagctaaagcagatgctggggcagccggggcaaaaccttaccgctgtggctgttaagggtaattttgacgatgcccagactcaagtcaagcagatctttaacgaccaggcctttaaccagcgcttgatcaacaatggctaccagttctcctctgccaactcaatgaacatcggccggctgattccacaggttgtctactatttcgccgcttatggtcagctggtggaacaaggccagatcaaacttggcgatgcaatcaacttcaccgtgccaactgggaactttggcgacattctggccggctggtacgccaagaaagtggggctgccaatcaaaaagctgatctgtgcctcaaatgaaaacaacgtcttgactgatttcttcactactggcagatatgatcgtcggcgcgcctttcatctaacctccgcgcccgccatggatatcctggtttccagcaacttagaacggcttttgtttgatgtttatgatgaggatgctaccagcgttaaggaattaatggaacggctacaaaatgatggctggtaccagattactgctgccgccaaagccaagctggattccgaatttgcggctggttacgctacgcagagccaggtcgcgggtgagattaaatatgtctatgaaaccagcggctatttgattgatccgcataccgccgtgggatcatttgtcgctcgtcaatatcaaaagaacagtgatgatcagacgccaatggttatcgtttcaacagccagcccgtataaattcccagaaaccgtctatcatgctttgaccggacaggatactcaacagcaaggcctgccatccatcaaacagctgcatgatctggtcggtggcgaattaacggccggggtcaaggaactgtttgatcatcagccgcgcaaagaatccgtaattgcaccagatgatatggaaaacttgattgcccaagtcttaaaattgaaataaacgtttgccctaattggagttgtcttcaattggggctttttattgctgctgtaatctatataccatcgtcttcagaaaaagacatcataagtaggtaaagttatataaaccgaaatatacacttacccttatttacctactcttagctaaaaagccgtgccaagtaggtaatttatctcccgaatgccgttcaagaatcgctttgcttcacaaggttatcattcaccacgtttctaatcagcggcaacatcgctaaactttagtcggcgatgtgaaccttgattaattgatggctgcagcccttttgacagggtgcggcaataattaattgacaaagaaagggcattggattattttactgaatttttttgagttattagttaaggtaaatttatactgttgtgtgagaagctaatgccttgtaatagtcaaccaccatcggctaaagtcgatggcttgtgggcaaacacctctgtattgagtatccgaaccacaatttgcatagatacggacgatttactcaaacagccgcagttgcttgagcagtgatcatctaattaccaatgccttttacattcccaggttgccataggaatgagcctagctttttgactgggctttttgttgtttctggagtcctttttcaagaatattcagtgctgcattgtaatcacggatatgatgaacatggcactgtggacatatccattcacgatctgccagtgtcagcttttcggtcccgttacttcccattacaaaaccgcagtcatgacaggtttgggtcgtgtttttagggctgaccgtgataaattgacggtcataaaggtcggctttgtatgacaacatacccaagaaagaccgccagccaacatcactgatgctcattgccagggcatgattttttagcagattcttactcctcaattcttcggctacaacgagatcttggttcttgatcagtgctgtagacgtgcgttggagaaaatcacggcgtcggtcaaatacccgtgcatggatcttagcaactaacaagcgctgcttctggtagtttttgctttctcgcaaagaacgctgctcttttttagcccggcgctggcggcgtgaaagagtacgctgtgctttagctaattttcccttgattgttcgatagtagcgtgggttagcgatggttcgaccgtcactggcagtcagaaagttttctgtgtttaggtcaatgccaatttgccgattagtgcggctaagcttaggaacaaacggtgtatcggaacctaattgcagcgacaaaaagaatcgatcggcagcatctttggaaatggttaccgtaccaatgcgtgtttcgccttgacgatccaatagtcgctgctgagcgcctttgatccgcaaacgtcctagtttaggcaccacaatatgtttgcggtcttcaaagcagacggtaccgttgtctagccgggccgtcttttgctttggatattgacagttggtctggtatcgccaggcatagcttttacgatgaaattttggcacaccggcttcatgaaccttgcgaaaagcgttccaagccttgtgatagttttgaattgcattagccttagcaagactgtcaatacgcttatcttctaaaaactggaaatgatttgacatctgcttagcgttttgacgaagctttagctgttggatccgatcttgaaccgtatcaattgacagtttgattcggtttaattgccagagttctttaccgatcgcaaccatctcattatagacgaaacgactggcatcgctgttaaccttgattatttgtttctggtaatcactcggatagatgcgaatcttcaatccataatgatattctaactgggccattgacttcattttttcacctcctttaattggattatatcatcagctaatgactataacgattgcggtgttcttaatgactaaagaaaagattcaagacgcagtttatactcgtcgatatatctataattttcattatcacttaatctgggtaaccaagtatcgtcaccagactttttcaactaagaaactggtagacgaaatgaaagacatattgcgaatggttgcaaaagataacgaaattgtaatcgaaaagatggaagtaatgccagattatgttcatgtactgatcagttttccacctagcaaggcgccaaccagcgctatcaaagcactaaaggggcgtagtgcattcatcttttccagaaattcgacaatcacaatattggggtggtcatttatggtctcccagctactatatgagtacgcttggcaatatgagtaaagatgtagtggaaaactatatcaacaatcaaaaatacaatgcactccaaaagaaaaagcgtccaaatggacgttgagtgagcctatccatcccatgactaaagtcacgggattttcggctaggcataattaaaagcgtcaccaagcctgcctgcttagtgacgcttaacttattgattgattttatttttccgacttggccagcttggcaattgcctggacggtctgccgatctttagccgtgccgtaaaactcagcttctcgtctggcattgagctgcttgaccagttctctgatctcatggttttgagccagcttgcgcgttggcagcggaataaacgcattggcggcaataatggccatcactaccccaatgatccgcgcgccgtaaaacgaaacgttcaaaaacagaatcgttaccgcggccacggcgaacagtaccgtgttgaagtacagcggccagtgcggattgtgccgctgcttttggcccagattaaaatgcaggtcatatttttcacaggccagcttggcataggaattcagtttattccaataaaaagccaaaccaaccagcgcgagcatccctaacagattcagcagatttgcgccaactacaccacgaatcccccaaaagatcagaccagttgctaaagttgcggcatacccagccatgaaaggatgtcggacagaaaatttttgcattttagtgcctcccagcttttagttaactttattataaagccctttcaagatttgagcaagcgtttgcacaaaaacgacatcatttttgccctgcttaaattaatttaattgcactgcttgacaaattaacgatctgtttctaaaatgagtttatatttaaataatgaaaagttaatgagaatagtagccgttttttctaatcttagcgagcgtggtctggtgcaagcacgcattggcagacgcggcgaaatgaactcattgtcaaatggaacgggtgcaagctacgtccccggctgattaccgttatcaatcatggaggtcattgttatgcaatggcaaaccaaggtggtacagcgaacacaaacgcccttgagcagccggctcaggggcgcttttttaatgaaaggatgaaagaatatgcgaatcaacgcggaagatgaactcagctatctacagaacgtttttgataaattaggctttcgaaaagaggatggtgccttaattgctgatacgctggttgatgctgacctgcgtggaatctcctcccacgggatccaaagactatactggtatcgcagcatgatcaacgacggcatcatcgtacctcaaaatcatgccaaggttttaaaagagttgcctggcgccgttttagtcgatgccaaccaaaacatggggcatctggcagccagcctggcaatggataaagtaattgaaaaggctaagcagattggcgtcggcatcggggtcgttcgcaactccaaccacttcggcattgccggctactacgttcgcaaagcactggctgcggggctagctgggattgccctgaccaacacgcggccgctggtagtcccaaccaatgccactgaagcatttttgggatcgaatgcctttgcgtttggcttcccggcctcaccgcatcccttcatttttgacggggctacttccgtggttgctggcggcaagattcagctggcggacaaaaaaggcattgagctgcccggtgactgggtcgttgacaagaatcgtcaagtcgtcaaggatcctaaagaagcagagagcatcctggcaaccgcggcctttgaagaagaacaaaaaggcggcggcctcttgacgctgggcggcactgaggtcaactccaactacaagggtatgggcaactcgattgtcgttgagattctgaccggtattctggcacaaggatccatttcagccgacaccaacacaggcaagcacgactttagccagtttgtctttgcgtttgatccagccttctttggtgacgttgaaacgcttaaagccaacgcaaccagcatgcttgaccgaattcgtcatcttaaccatgttcccggcaagacaatctgggtccctggtgatcgtgaatacaagaactatgccaataatcaaaaacaaggcgttgacattgatgccaagacgattgaacaaatgcaggaaattgctgctgacttacagattgagatgcccgctgaagtttaggataaaaaacaaagccgccacggaatttaccgtgacggcttttatgatgccctcaaatcgttatgaccagcggcaataaaatcagctgtagccattaaaatcttttatcataaccaagctggcttagtttttgcatgattgcctgcgctacaaccattcccccaaccgtgttcaagtgcagatgatcgccaaaatcataaatttctttaagaccgccgtcgttgccaagcagccacggatcaagatcaacgacccactcaaaccgccgcagttcctggttgatcaaaagccgccgctgctgagcatcaagcaatacgttttcctgttgtggagccacatgcggtgaaaatggcggaatcgttgtcagaatcaatggacaccgccgatcatccaagatttgctttagttgactgaccccggctagatattgccccggtgttaccagttcatgagccgactgaccgtcaatcagcggcaaaaccagatcattgctgccaatcaaggcaataattggatgctggtgcggatcggttgactgagcggctcttttgatcagcgactgaccaaaagtctgatacagtggaccatcttgcggggcatcatgaagcagccgatttccggagatgcccgtattgactactacagcctgccccaaaagcttccttatcagtcctgtctcaatcattcccgtttctgccagggaatcaccggtcagctcaatgatgggtgtttttttatccgtccaaacctctaaacggctgatgcaaaaccagcctttacgtgccagccagttatgcggcaaatgcggtgcggcgttcttagtcccggccatgatcgcgttataaaacgtttcatcatagacacagctgaaatcggcatatgtctgtttttgcgacgcccgtatcctaaaataaagcggctggccggcaacgacttcaaacggcagcgcgtccgtatgcactgccccgttgccgacaatggcaatctgcttttgcttgccgcgagtaattgattttgcatcgctcatcttttcatcatggctgacggtaagctcatcaaaaagcagcgtcgcgtcattaaaccggttctgcaggatcaatcgcagaccgctgccgtcgacttgaggcgtaatcttgatcagtaaagtgagttccttcatcttaaagggcagcgcgctgaaatcatgagtcaagcggctgctggcgatctgccatcccatgtagacaccttctttctaaatcttaattccataaaaaaggccgacgctgtaatacgccggtcttttacctgctgaccaatgactgcctttcaccgctttaaggcattcaaaacagtcgctgggtgctggaaattttaatgctgcttggtcagcagattgataactgcctcgggatcaatcccaacaaagtagcgtttcagatcaagcttggccagtgcctgctgcatggcatcctgatcataaggctgcccgatcaaggcgttttggacatcagctacgtcaccggtgccaaagaaatcgccatagatcttcaagtcattgatgcaaccatcttcaaccaggaaacgggcatcaatggttccgccatcgaaatgctgccgtttttttactgagaactttggtgacttgccatatacccagtcccaattatcgtaatagcgtttttccaattcagaaatcgctgcttcatcttcaggcgtcagctgatattcaaactgcttggcctcttcgatcgaatcgacgtgccagatgtgtttgatcaattcatctctaaactgctgcgtcgtcagattctgaaattctggcttaaggtatggcttaacgttggtaacgcgcgcccgtaccgatttgatgccttttgactcgattttgtctttcgggacgtgcaatgcagaagcaaccgcgctggtatcaacgtcatacatcagcgtcccgtgtgaaaaggtccgcccgttgcgcgtgtacatggcattgccagaaaacttcttgccatcaattacaatgtcgttgcgtccagtggtttcagccccggttgcgcccatgtcatgcagtgcatcaacgattggcttaaccaggttcttaaagtcgccgaatcgaatcccatcggcaggaacgacaaagctaaagcacatgttgcccagatcttgatacatcgcaccgccacccgacagacgccgcgtaatcgtaatgtcatgttcacgacagtactcggcgttgatttcttccatcgtgttttgattgcgtcccacgataatgcaaggcttttcgatataaaacagcataaatggcagcttcatcttgtcgctgttcatcagatactgctcagttgccagattgcgacggatatcctcactaggcattgctaaatattgcattcgacaccactgttcccttcatccaatttaaatattggttggcattccaaggccgacatcagcagcatccatcaatgtctctgaaagagttgggtgcggatgaatcgtcaatgcaatgtcatcaatctcatttcctgattcgattgccaaagtcagctcactgatcagatcagaagcatccggccccacgatctgagcaccgaccatgacatgcgtgtccttcataaataccagccgaacaaagccttccgttgccttcatggatacggcccgaccattagccatgaatggaaacttggcagtcttgacgtccaatcccttttcttttgcctcagattcagtcagacccgtcgtggcaatctcattgtcaagatagcagaccgctggcattgcgtggtagtcgacggttgttggcttgccagagattgcttcggcagcaaccttgccttcatagctggccttatgtgccaaagctgctccagcaacgatatcgccaattgcgaagatattcttgacgctggtccgaccctgggcatctacttcaattaagccgcgtttgtcaagcttgataccggcttgttcaaggcccatgtctttagtgttgggacgccgaccaaccgaaacaactacataatcggcatctacagtgtgttcttggtcaccaacggcataggtaaccttgacgccatctgcggtttgttcagcctgcttggccatcgcattggtaattacgtcaattcccttggccttaaagtctttgagtgcaaccttgaccaagtctggctcatagttgcccagaattgacttggtaccttccagaatcgtaacgtgggcaccaaagttggcataagcattggccagttcgctgccaatgtagccgccgccaatgatgaccaattcttttggtacttcttttaatgccaatgcacccgttgaatccagaacgcggccttcaaacttaaagccaggaatctcaattggatgactgcccattgccagaatcaagtgcttgaacgtataggtttgaccatgctgaccgctgataacgcgcaggctgtggtcgtttttgagataagccgttccgttgattacatcaatcttgtgttccttgaacaagaagccaaccccattggtcatacgcttaacgacgctgttcttaaatgcctgaaccttttcaaaatcgagcttggcatcagcaacctcaatgccttgatcggctgaatttttggcagtttggtagttatgactaacctgaatcaaggcttttgatgggatacagccgacatttaagcagaccccgccaagataggtactttcaacaacggcaaccttttgtcccatttcagcagcgtgaacggcagcaacataaccgccagggcccgcaccaacaacaatggtatccaaatcaattgcaaaatcaccaacaaccatgtctgatcacccttccatcaataacagttctggatcactcaataattccttgagccggttcattgcccgttgtgccgtaccaccatcaattactcggtgatcgcaggccagcgacagcttcaagaccttggcaaccttgatttcgtgatcaacaacgactggttcttcaacaatgcgtcccatacccaggatggctacttccggccagttgatgattggcgtaaagaagccgccgccaattgagccgatattggtgatcgacatgccagtgtggctcatgtcatcgccagaaagcttgccttccttagccttttcggtattggcgctgatttgacgcgcaatgtcaaacagactcatagaatcagcatgcttaacgtttggtacgaacaaaccgcgatccgtgtccgtagcaataccaacgttgatgtagtcacggtagacgatcttttggtcagccatgtccaccatcgagttaaagattgggtattccttcatgattacggccagcgccttggtcaggtaggccataaacgtcaggtgaacgccatgctctttagccagttccttgtacttcttgcggtgatcccaaagcttgtcaaccaccacgtcatcaaagacatgaatcattggaatctgctgtacggaacggatcattgccttagctgtcgccttgcgaactggcgtcatcttttcatcgtgcagtggccattcagcggaaccctttggcagtgcaggctgttcaatggcaaccgcatctgccgtttgaggagcttccggttcagcagcagctggggcagccttggcaccgccagccaagaagacgtcaacgtcagtctttagaatctggccatgacgaccggttccggcaatctgagccaggtcagcacctttttcacgtgcatagcggcgtacggctggcattgccagaactggcagagagtggtcagcagcactaggagcagccgctggagcaggagcggctgacgctgatgctggggcagctgaagcagtgcttggtgctggtgcggcacttggctccggagcagcactggcatcactttccgcttcggcactggcatcaacattaccttgaccatcagcaacctcaaattcgatcagcacctggccaaccgtaacatcgtcgcccttttcaaaattgatcttggttaccttgccatcgactggtgatggaatttcagaggttgacttgtcgttttcgatttcaaccatatcggcatctttttgaatggtgtcgccaaccttaacgtgccattcgccaatcgtaccttctgccatcccttcaccaagttctggcattttgaattcatatttgctcattgatcttccacctcgcgattaaaagttgacggtttccttgaccttgtcaacgatatcttgcttgttaggcagccatacttcttccgcatcactgaatggatatggcgtgtctggagcagctacccgcgcaattggtgcatccaggtacaaaatgcccttttcaccgatcagcgaggccaactgaccaccaacgccggcttgcttttgagcttcttgaaccaatacgacgcggcccgtcttcttaacggattccagaatcgtgtcttcatcaagcggtgccagcgtgcgcaggtcaacgacttcagcattgatgccttccttggccagttcatcggcagctgccagactttcctgaaccatgtagccgtacgtgatgatggatacgtcagtgccttcgcgcttgacggctgccttgtccaatggaatggtgtaggcttcatcaggcacttcttctttgatcgaacggtaaagcttcatgtgttcacagaagaagaccggatcatcagagcggattgccgagatcaaaagtcccttggcgtcataaggaccgcttggcgcaaccacgcgcagcccaggaacctgagtcagcaggccttcaaagctgtctgagtgcagttctggcgtgtgcaccccaccaccaaatggagcccgcaccgtgattgggaacttgcgcgtgccacccatccggaaacggtagcgcgccatctgaccagccagctcatcaaaggcttcgtagataaagcccataaactgcagttctggtacgggacggaagccttccagcgccatcccgttggccagcccgataatgccagattcagccagcggcgtgtcgaatacgcgatcattgccatatttttcctgcaggccatcagttgcccggaagacaccaccgtttttaccaacgtcttcaccaaagatcattaccttgtcgtcatgagcaagctcttcatccatggcagccgtgattgccttgatcattgtcatcttagccatgattacttagcctcctttgcttggtaagcatccagctttttttgaattgctggcggcgtaaccacatactcgttttgcatcagttcggtaacggtctgcgttggctgtgattcaacttcctgcattgcgtcatcgacttccttgttggctgcttcaacgcaggccttttcctggtcttcatcccaaaggcccttgctctctaagaacttgcgcatccgaatcagtggatccttcttcagccagatatcttcttcatcttcggaacggtagcggcgtggcacgtcaccagctgtcgtgtgcggtccataacggtagcacagcgtttcgatcagtacgggaccattgccggccgtgatccagtcacgagcctgcttggcaacgctgtagacagccaaggcatccatcccatcaacctgcagtccaggaattccgctggcaacagctttttgagccaaggttggcgctgccgtctgagcctttcttggaaccgagattgcgtacaggttgttttgtacaaagaacagggccggtgctttaaaggcactggcaaagttgaccccttcataaaagtcaccctgtgaggtaccaccatcaccagtgtaggtataggcaacgttcttggcacccttcttcttcaggccaagtgccacgccagccgtctgggcatattgggcaccgatgatgatctgaggcggaacggcatttaattcttcagggtatttgttgccgttaacatgacccttgctccataagaatcccttccacattggcagaccgtgcttaaccagctgtggcacgtcacggtagccgccgagcagaaagtcatccttgctcattgcgaagttggagcccatttgactggcttcctcaccggcagtcggggcaaagaatcccaaccggccttgccgacaaagcttcatggtacggtcacccagtacccgtgaccaaaccatctgcttaaacagttcaatcaactcttcatcactcaggtcaggcatcaaatcggggttgacgactttgccatcttcgtccagaacttgaagcggcttgatttcggggttatgtttcagctcctcaaaatctaactttttcatctagaacaacctcctttaacaaataatgaaacgcttacacttatagttttataacatttttttgcaaaatcaagtcttttttcaaaaaaaaaaagaaaacattttcgatttaagaaaacgttttctctgtctagattgtgattttttgcgcattaatgagccagtgagacagccatcttgttcaaaccagtttcacgcatgccgcgatcaactgcttcacgcaaaacagccgcagaatgagccattgccttttgttcgcgctcatcaagctgaacgtcgatcacctgttcaaccccatgcgcgttgatgacagccggcgtccccagatacagatccttaacgccatattcgccgttaacataggcaccaattggcaaaacagcattctcgttgtgcagaatggccttggtaatccgcatcaaggccgtggcaacgccatagtaggttgcgcctttccggttgataatttcgtaggctttgtgacgagtttcatcttcaatctgcttgagacgttcttctgaaacgccctcttctttagcaatctgcaacaggttcttgccgccaattgctgctgatgagtaggccgcaaactcagaatcgccatgttcgcccaagacgttagccgatacatcggcagggctgacgttgagctccttggccaaagccacgcgcagccgagccgtgtccagcagcgtgccggagctgattacgcgactggttgggaacccagagattttttggacggcataggtcaaaatgtcgactgggttggcagcaactaagaagatgccgttaaagccggacttaaccacgttttgcgtgacatcggccatgatcttaaggttcttgttgatcaattgcagccgggtttcgccaggcttttgggcagccccagcacagattacgactagatcagcatcgcggcagaccgagtagtcggctgactcaacttttttaggcgaggtaaagaccgtggcatcctccaagtccagtgtgtcgccttcgcctttgctcttggtgtggttgataatcgcaaattcttcagccaatccctgctgaaccatggcaaatgcataggcagaaccaaccgcgccgtcaccaatcagcacgactttttgttgtcgataagacatattatgatacccctttgttaattatttcatgaacaggttgacatagagaggaaccagaatgtccattgccaacgaaacgataactacggcaaccgaagccatggccccttcaatcgaacctaattgcagcgccttggcagtaccaaccgcgtgaccggcagagccaagtgccaaaccattgccgacccgagaaagcttgtttaagcggaagactttgatcaggaagttaaccagagcataaataataacggcgtttaagatgcaggccatggccgtaatggctgggtcaccgccaacccccttggcaattggcatggcaacggcagtcgttgcggcttgtggtagcatggcagccgtggaaacccgtgacaggccaaacagcttggaaaccatttgaatcccaaacaaggagataaagccgccgacaaacagcgtcaaaacaatatcaagccagtacttcttgaaaatatcattccgacgatacagcggaatggcaaaagcggccgtagcagggtttaagaaccagaagatgatgttcccacctggcaggtagtacttagtgtagacggcagccgtcgtagagccgatacccttagcccagattgccaaaaccgcaatcccgaagaccatcccaaccagaagcggcgtgaacaagaagaaaccatgactgatcttaaacagccacatccccaataagtaaccgacaagtgagataaaaataccagtatatggcagcattagtgattgagtaaacattgcttaaatcctcccttttctcatgcagtgattagttagccaggtgatgcgaaccattttgtgctgaaacggcatctgattttttggccaggcgttggtgcatcttaacaaagaagttaccaacgtaggcaatcactaccagcatgatgatcgtggagatgatgataacgcagatatcctgcagaccttcacgcttcatcagtcccagactgccacaaagctgaacgccagatggtacgaacagaaaggcaatcaaactgatcatgaagtcgccaaacttttcaacctgctccagcttaacaatgtgcgttgccagcaaaatgtagagcagcatcataccaaccaatggcgttggtactacgaagctggctgggaataaatctgaaatcagctgtgagacaaacaaaattgcgccaaaaatacccatttgaattaaaattggtgccgcctttttttcttctttagccggcgtttgcttttccttcttatccatgttgcttttccttccctcaaatcaatccaaatatcataaaaaataattgcagttaatcttatttaagatggccatctttgatatcgattacacaatgtattgtagttaactttggtgattttgtgttaattttcacattgattaacagaatttgacgctgaaatgcctttatcgaccattgaaatgccccgaggattcttttttgacaaaataaaaagcactgaatgcattatcttgacattcaatgcttgtgcaaatattagacaattcaagttactgcagtccgattgccttcttggttttagccgcatatgacctgctgactgggattttgctgccatcttttaacgttagctcgtaggtatgattaaaactgggctgcatttcatcaatctcgtccagattaacgataaatccccgatgaatccgcaaaaaatgctttggattcaagagctgcgcaataccggttagcgtctgccgactgatcaagagcttatcgtttctgagatgcagatgcgtgtagccgccctgggtctcaatatacatcacatcacgtttttgaatcaccatggtcttgtcatcaatcgtaatcgacagccgtggattctgccaggcagtctgttctgcaacgtcttccagctgttccttattgcccaaaagcttagcgactctggcaacggcttcgttgattcgatccgggtcaaacggctttaagacataatcaacggccgcttcattaaaagcctcgatcgcgtaattgtcataagcggttgcgaagacgattgccggtggctgtggctgttttttccaacgtctggccagtgccatgccgttgccatcatctaatttgatgtccaaaaagaccagatcgggatgcgcggcattgactttttgatcagccgtcatcaccccatctgcttcatcaatctgattaatcagcgcgttttcgtttaataaataatgcagttcatttctggccagtggttcatcatcgacaatcagtactttcattatatggatgctccttccaaatttggatcctgcctggtttgtgcataaggtatcaaaagcgagattgaagtcccggtcttgccggttacgatctgcatcctagcactatcgccatacagacctttcaaacgagcattcagattctgcatggctgtaccgcttccatgctcagaagcgattttttccttgcccagtttgccgataactgcctgatcgattccctcaccattatccgcaacccgtatttccagatacttgcccgatttggtaatccagatattgatgatgttgccggtcttgcgattaccaaatgcatgatggatcgcattctccaccaacacttgaatggcaaaaggcggaaccagcacctgatcatcaacgctgctgtagaattcaacgtcatacttgtcgggaaagcgcgtctgttccaggttcaaataggccttaacatgcgcttcctcttgtttaagcggaatcttggattgattggcacccagcagattcgatcggaaaaacgtactgagctcacgcagcaggaaccgtgctttctcactgtcaaaacgtgaaattgcaataatcgtattgattgaattaaagaagaagtgggggctgatctgggcctgcagcgatttaagctccgcgtctctaagcagccctgcctgtcgttccttttcacccagcacgatctgtgtagccagaatctcgccgagtccctcgccggtttgaatctcaacgggggtcagctgccagttttccttaaaataaagtgttaaaacacccagcacgcggttacccagcgtcaagggaatcgccatcccggcctgcagtggacaatgatcgccatgacagccaatctgcgcggcattataggccagctgtgtctgccacttttgcagtgcccgcttggcaaactgcggcacatcggcttttggcatgtcatgataatgatgatcgctgccagttccggcaaaggccagtgttttttcattgttgccaatgccaaccgcgtcaaagtcagtatactccaaaatcagatcagtaacctgacgagccgattccgactgcaagccatggcgaaatgccggcagcgtcttgaccgccagcttcattactgaacgggtctgaacggcgcgggtgtcgacttcctgacgaaaatacaaagacagaatcatcaagaaaaaagccgtcccaatcgagctgatcacaaccattggcagtgcgataaagtgtaccagtttcagatgtgtcggactaaacaagccgacaaagatcatctgaatcgactccatcattaagctgatcaaaaagccttgccatggcggcatcacgacaaagtgacgccgatttttatgatacagcattccagacaaaatcccaatcaaagtcgagctgacaatgtaaaaccaggcatccgtggcccagctttcctgcatcatccgatgagttccggcaaccagacccgtcagtccgccaacaccaggtccgccaacgattccggctaccgttacggccagaatacgggcgttggccactgaatagccattatgaacatgccataaaatggtttcccgcataatatgattgtcaggatcaatctcaatccccaataaattagaaacgattgcaaacgccgaaaagatcaatgctagtttaaacagattagccggagttgactccaaaagcagccgccgaaatggccgaatattgaccagaataaaagccagcagaataatcaatccaactcgttctataatcagaaaagccagttctcccataaattcactccttcatcttgctcatccagtaacttaatataccacaatctcttaaaagtttagtgatatatttaacaagattttgattttaagctgccttaaatcttgccgcgatcatttgaaatataatattaaaaagaggctgggaaaaaagtctcaaaactaaagaatcgctaggaaccacgttgctgaaaacgttgatttctagcgatttttaatattactattctctaaaattcatctgaaaatatagttttttcccagcctcttagcggctacttggtaatgtcagcgccaaagtacttttgagaaagcttttggagcgtgccatccttttgcagttcctgcagtgcctggttgtattgcttttgcagcgccgatgagtttttgttaaacattgccgcaaccttgaccggcttggcttcgctggaaacgtcaatcatcttgagtcccttggtgctgtgctttttagcataaacgtaccaagcctcgcgactattgatcatcccttcaacccggccttgcttgatcatgtccagtccgctggcaaagtcgctgtcgtcaaccgtaatcccgccatactttttaaccagcgtggcattgttggttcccacgccagcggcaaacttgtggcctttgatggacttaagcgtcttaagcgagctgttttctttaacgatcatgacaaagtgcgatgaaatgtagggatcagagaagaggtacttcttttggcgttcaggcgtctgcgcaatgttgttcatgaccacgtcaaacttcttagcgcctaatccggcaatcaaagagtcccacttggttggcacgaacttggcctttaagcccatcttttttgcaacggccttgcccagttcaacttcaaagccctgtagcttgccgtctttacgatatgagaacggcgcataggtaccttccagaccgatcgtcagcgtatcaggcgtcttcagctcggacttgaccgagtcggcatggctgatcgtcgtgccgatcgtggttcccaatgccagtgcagctgtcattaaggcaatcttcttaaaaatcttcatgttgttttccccttatctttttcttttaggcttccagttcttccattgtcatggccgcaataaaatggcgaatccgctcatcaggattatccggcgcaaaaaaagctgtcggatcgccatcatatttgatcgtgccatcctcgacaaaaacgatcctgtcggcaacacgtctggcaaagaccatattgtgggttacgatgatcaacgattggttttcctgagccagcttaagcagcacgcgcaagacctctaattccagttccgggtcaagtgctgaagtcggctcatccaataaaacgtattccggcttcatggccagcgcgcgggcaattgccactcgctgcgcctgcccgccagaaagctgcgcaggataggaaccggcaaaatcgcacaggccgaccttgctcaagatttccagcgcttcttgattggcagcctctttagacttcttgagcactcggatgggaccttccgtaacgttttgcagaaccgtcagatgcggaaacaggttgtagtcttgaaaaaccatacccgttttctgccgcaacagcagtttctgcttgcggctgacgctctttgcaaagttcagatgcagcttatcaaaatcataggtgccgcgatcaggctgctccaacagattcagcgagcgcaggatcgtagacttgcccgatccagaagggccgaccaaaaccgttgtctgccccgctggaaactccaggctgacatcttttaaaacgtgcttttcgccaaaccatttgttaatcttagcgagtttcattaaaacctcctattgaacaggcgcggtcttggccagagatttttccatccaggcctgcagacgcgataaaacggtcgtaaacagggcatagatcaaagctacgataatgtacatcaaaagcggctcgtagttttcagctgtgatctgctgtgccactgaaaacatttcagcaatcgtaattgaagctgccagcgaggtatccttgaccagactgataaatgagttggccaatggcggcagcgcgactcgcaatgcctggggcaaaatgatgcgccaaagcacctgcagtctggtcataccaattgcttcggccgcctcccactggcctttgggaacggaagcaatcgccgcccgaatcgtttctgaggcataggcaccagtattgagcgagaaggtaatcaccccagcggtaaacggcttgagctgcacgccgtcaggaaagactcctggtataaccaaatgaggcaggccgaaaaagacgatgaacagctggaccaataatggcgttgaacgaaacagccagacataaaagaccgcgattccctttaagatcttaaacacgccattttgtctggacaaacgaatcagcgccaccaaaagcgcgatcagcaatccccagaaaaaagataccagggctaatggaatcgtgtatttaaaaccggccgccagcagttccggcaacgagctttgaatcgtatgccacatcttatccctcctaagttaaatgtttcaaatgatttttaaatgcaataaaaaaggcgcagtcgggattgaccaggctgcgcttgatgctgatccggccgttttcagccaaccagctgagcaacggtaataagcggacagcctaagcgcggtccgctgcaacatgaatggttggttaatgaattgaagtttgccattgctgatttctcctttgaaaaagttagtaactgtatgataacttacaaaaaataagctgtcaacaaaaaattcctaaagctcatctaaaactttaggaatcaatgttttattaccaggcaaaactagtcagacatgtcgcaaagctgaagaagattccagggaagttggcccaaaaaaccggccagtcccgatcttctttaaagtaagcatagatgctccacagcgtacagttgataccggcgacaaatggctgtaccggtgagccatactgaccgtgcagattattaatgatctgagcaatataggaaatgtacatgagaattgcgattacgctggcaaagcgccccagccagctgatgaatttttcgctggtgatggaatgtgctgaatgtgaatgtggattagtcatgaataagttccttctttccgatcgatatcggcttaaatcagtcaacatctggcaaaatttcaaactcaatcgtaaacgtttacaacttgttaacgatttcatcttaacaccattgagcttaatgtcaaccggttgtcagaaacctgcgtccagaccaatttattgacaaacatttagcttcacgactgactgaatgcttcatcagtttgcaccgcttacattttttcaaaaaataaaactgggaccggctttagccaatcccagctccattaataatcaatcaaagctatgcagtgcttccataatcagctcaataaaccgctgccgattgattcccagcatgacctcggtgttctgtggcttgccggtcagctcatagtagtcgcagaccgtttcgccacgcgttagctcaccagtcgtttcaacatcgacgttcattttttcggtttggaacatctctggttcaatcagccaggcaatcgtgcaaggatcgtgcagcggtgctccttgaaagccccactttggattttcatgataacgctcaaaaaagctcagtagaccataaaatgcctggccaactgaatttttaatctgccgcagcgcctcaatttccggtttcaaaatctgcgcctggtgcgtaacgtttaatggtgccatcaccaatggaatcccgaaattcatgacgatcttagccgcctcgggatcaacgaagatgttgaattccacgctgggctgccagttgccaagtcccatggccccacccatgtagacgatctgatcaatttttgccttggccagttcagggtagacccgcaaaaacagcgccgcgttggtcattggtccagtaactaccagtgttaccggcgttgcgctctctttaagcgttttggcaatcagctcgatcgcggtcagctcaaccggctgaaaatccggttccggcagtggataaccgtccagaccgctttcgccatgcacctccccggctgtttctaatggcttgaccaaaggcgttcggttcccgccagcaactggaatatcctctctgcccaacagcttaagcatccgcatggcgttgttgagtgtcttgtctggtgtttgattgccagctgaagtcgtaacggccagcagctctattttaggcgaggccaccgccagcgtcattgccaaagcatcgtcatgaccaggatcacaatcgaggataatttttttcgtcataaattttcctgcctttccattcaataaaacgttttcatttgtaaaactagtataacattttacctagtgacttcaaatccccacatttaatttttaaaatttgctttgaaaagcgcagaacccttgatctatcaagggtttttcgtaattcagattcccatcaaaatataataattttttcgtagtaaaaggcttgctttttaaatctattcagctaaaatactatctcgtgagtaatcgaaaaaagcatcttcgctttaataaattttaggaggcatgaaacgtgactttgcgcagctttttcaaatatcaccacaatcaaaaaatgatcgaacttctggcagttgaactgtcggaagtaatcgagcggcggcatttggattccgtacaaagcgcgatcgtctacgttcaggatcatgctttcttccctaacgatcgcgactaccaaatcaagctgcatattgacgactgcatggcaatggacatcctgccgctggttgaaaaagaaatgaccacggtttgccaaagtctggccaaggcgcgctgatcaaaaacccgttcctaagcaaaatgcttggcaacgggttttatttgttgatattcatcggcaatcgtttttccatccgatttagaccattattcgccaaaaactgctattataaaaataagatcatctatcggaggcagatcatgacggaaaactatattcgcgactacatgcgcctggcctatcaagaagccgtcaacgtgcagcggctgttcgttgatgccatgaagtcaaccggcgtcaaagaacggctatgggctcatctggatgcttttcaacgcaacgtcaatacgatgaatgaatttatgtaccataccagtgaggttgaaaatgccgcacaatatgtcaaatttttggagcaagctaaagaatttcgtcaattagtcgatgaaaaattgaaaaaacatgcctataccagaaccgatcgtgatagtatttatgatgcggtgatggcgttagacagtgccatgccgctgatactttaaattcatgtctcaatcagcttaatcgccgttgttccccaaaagcagcggcggtttttttgtttggaaaaaaataaaaagccccgccattgacagcgagacctgcagtttagagagaacctgaatggattgtgagaccgctagaagctttctcaacatcaatcagtctaacggcgcattgtaaagattcattcgggttttgggtattgtttttgtaaagtttctaatttgcttttagacagatcattatcagctgagcgccgccctaacagcgtaaatcaaaaattgacttttaaggcgattttctttaagatttacgcaaacaacggctgcacttggccgctgatatttaattctaaccaccttaaccaagaaaagagtgagagagagaatgaaagttgccgtaccaagcatcatgtcgcaggctggcaaggattatctgaccagccgcggttttgaactgatcgagaccaaaagtcaaagcgccgctgccctgattaaggaagccgcagacgcagatggcattattttgatgacggaaccatttcccaacaccttagccgatcagctgccgaaattaaaagtcattgcccgccatggcgttggctatgacaatattgatcctgaattctgggctaaacgaggcgtttgggtaaccatcgccaaaaatgccaatgcctcaacggttgcggaatcgactctggcagccatgatggcaatctctaaaaatctggtccccaccactgagcacctgcgccagggtgactggggatggacatttaatcatcttggctttgatctggccggcaaaacgctgggaattgtcggctatggtcgcatcggccgcatgattgccaaaaaagccagtgcctttgacatgaagattattgcctacacgccatccaatcgttcagacggaaatgccgaaatggttgatcgcgacacggtctttaaggaggctgacattatttcgcttaacatgcgggtcacgccagaaactaccagaagcgttggccagcgcgagttcgacatgatgaaagattcggccgtcctgcttaactttggtcgagcggctctggttgatcaagcggcaatgcagacagcgcttaaaaccggttcgattgctgccgctgccgtcgatgtctttgatcaggaaccgctgcccaaagatgatccctggttcagcacgcccaatgtcttgctgacgccgcattgtgccggcaacaccaaggaatgtatggatcgaatggccgttgatgccgccagcgaggtcgttcgcgttttaaatggcgaaaaaccgctgtggaacgtcaatcagccagagcattgacttaaataattgacggtcaaaaattagcaagctgcttattatccataattaaaagaaacgcgctatcggctcaacagtccggcagcgcattttatttagtgcgattttttaaaccgagcagcgactggatcttcagcggcttgggcagcagcaacgtcggcggctttaaagtagacccgattggcattattgtacataacgtcagccaattcatcagcagtgaacagatcggtattctccagccaagtagccagttgatgataggtattaaacgttaccgaccatggtgagtcagtcacccagatcaaacgctgtgctccaacgatctgcttggccagcgcgaccgtttttgacagcgtgggtaaggaaagtcagctggcttttccccatcaatatcttggattgctgaaatgtccaaatagatatttttcagcggcgcaaactgccgtaaaacgttttccaagcgctccagatgatcagcgttaggaaatgacagatgacaaacgacaaaatccattttggggtagcgcttggccagattaacgatggcttcgggctgatagctggtctgagtatcgtcaccataatcaacggttacgacaaaacctggatagtcagccagataatgcataatctgcccaacccggacgtcactgtctaagcggaaaggcgtgtgaaaaccatgcaaaccgccgccttgactgatctcaaacttgatggcccgaaagcccagctcttcaacgtgtcgcttaacgattgccatcgctcgctcagcgaatggatccacggcaaacgcgccgataaagcgatccggatagcgtttgatgacttgataagtgtaatagttttgatagccgttcagtgtcccttgcagtaaaacggccttttcgatattttcggctgccatgataggaagatatttttccacacgaaaatcatcgtcgccccatcccgctggcagcaggtgaataatctctccgtcgtcccagatcgcatagccattgcccaatggactcaagcgcccttgtcctttagagccggccatcgcgcgaattaaatgaatgtgcccttcgatttttttcaagatcattccttctttctgattttaattgcacagcttgacaccgcttatcctaatcaataactttcaaccagcagaaggccctaaaaagcaccaccgcccgagccaccgccaaagccaccggaactgccggccgaaaagccacccgagccaccggttgctgaagatgagttaccagtatccaaggctttttcaaaagtgctttcaaacacgcccgtccaaggatcactggcaaaaatccatgggtacgtaattaaaagcgtatcattgagctctgcttcatcaaacgaaagccttaattcacgaataacttttttagccagcccaaacgccgtcgcatatggcagaatctgttcccataaaacaatatcgccaacttctttgagcttgaagtcgccaatatctttgagcatgagaataaagcagtccaaatcatatttcattttttgtccttttggcgtatatggcaggagctggcgatagtatataatcccccagccaaagccgcctgccaatatcagccccacgatcattttgaaaatccagccagcgacgataaaaatcatcccaaaaatcagcaaaagctcgccgatcagccaaaagatgccaatctgcttgaaccgatccgcgtcagcatcatagtagccgttttttctagcactttccagactggcttgcgaccattgatcaaaggctttcgcgatctttttagcgtgcttgcgctgcttgctccattttttcaactgttggatcgtaaagctttggccgtccccgcattcattaaacataatcttgagcagccgattttcggcaagcacggccggttttttgagggtaaaccgatagtcgtcgttttcagtcttgctgattgcaatcttatattcacctgccagctgcatcagatagccgctgagcacgcgcgcgtcaggccgttgatttttatcgatcacgtaggcctgttcaactggatagggcggaatctcaaaagaatgaaccagtggcggctgcttggatcgctggggatgttttttaatcaaccaccagccataagctaagatactgatgccgcatattgtactgtagccgatttggaaaagctgtcgccgtcttttttcctgggcgcgcttggcattagccgcttttgccagttgctgctcctgctttagcttagcagccaggacctttttggcaactcggttatcattttgcggtacgacggcattggcaaacagcaggtggctttcaacaaactgattggccggcacgcggtcgaccgtcatcttaacctgaccctgccgcttcttgactgacgttttgccgtttagcggaccgtgcgtaaaggctttaagcgagccaacgtttttagccggcagctgaatggtaattgaaacgtcatgcagcgcttcatcccagcccgtcccaatgatcttccaattcagctctgccgtatcctggtaactggtaatcatgccatgcagccggtagtgatagataaaggttgcttctgcatcgctgatttgatgatagaccttgagcttaagccagtctgcgctctgcgtggccttaacggtattattctgaccggattggctgagcgccaggttagtcagcttaccattctgctccacggctgccgagatctgatcagccttgccgatgccttgcaggtcttgattataataaacgccatgaaaatcaccgtcaaaatcataggtaatcttttgcgtcagatccgcgtcgccgttttttaacacgtcgacgttcacttggtaatgcttaatggtaaagtcgccatccgcatgacccacgactggcgccagcaagatcagcagcaaagtcaaaagacctagcagccaggtattctgctttttcatttgcctgccccccatctcttaatatttcctttaattttaccaaatccgcgctttttaaaatagcctactaagcgaaagccatcatcaacggtccccactatcgagcattagatagggataaatattttgatacaattccctataattatctatttattcagatttcttgaaaccgtttgcgaaaaacgcgctaaaataaaggcaaaatcagatgaaagcgatctttatcagtaaggaggctttgataatgagcaggcaagaaaatcatgctgacgccgcctccgatcaagtcgcggcgcaacaggctcggcaaaaacgcgttgattatgcagcaacgcattcgccagccgagcttttcaaacatttcaacaccagtcaacagggcctaaatgattcacaggtagcgcaaagccgcaagctgtttggagccaaccacgtgcagcagcagcgtcagccatcgattggcaagcgtctgatcagtgcttttgtcaatccattcacggcaattctattgattttggcaatcgtgtccacgtttaccgatatgatttttccttacttttccttatttggcagccggcccgaaaacttcacctgtgccacggtcgtcattatcgttacgatgatcatgctttctggcttgctgcgctttgttcaggaataccgcagcggcaacgcaacggccaagctgctggcattgatcaagacaacctgtaccgttacgcgcaatggtcaggaaaaagacattgatctcaatgacgtcgtggtcggcgatatcgttcatctttcagccggcaacatgattcctgccgatctgaggattctggaaaacaccgacttgttcgtcaatcgttccgagctgactggggaaagccgccccgttgaaaaaagcgctgctgatgagacgactaaagatcagattactgattacgaaaacatcgcgctgatgggcagcaacgtcatctcaggcagcgggctgggactggtcattgaagtcggctcagatacaatgtttggctcaatggcaggggccgtcgccaaagaaaaggtcactaccaactttaccaagggcgtcaattccgtcagctgggttttgatccgcttcatgatggtcatggtgccattggtattcttcatcaatggtctgactaagcacgactggctggaggctttcttgtttgggatctcaacggcggttggactgacgccagaaatgctgccgatgatcgttaccacttgtctggccaagggtgccatcgcgatgagccgcaaaaaaacgatcgtcaaaaatcttaattcaattcaagacttcggggccgctgatattctttgtactgataagactggcacgctgactcaggataagatcgtcttggactgttattggaatattgatggccaagccgatgatcgtgttttaaggcatgcctttttaaacagctattttcaaactggttataaaaacgtaatggataaggccatcattgccaaagccgaggacaccgaatcgcatcccgaactgcaagatctggaaaacgactacgttaagatcgacgaaattccatttgactttaagcggcggcgactcagcatcgtcgtcaaggatccaaacgacaagcggcagatggtaaccaagggcgcggttgaagaaatgcttagcgtctgcagctatgccgaaaccaaaaccggtattcagccgctcaatgacgccctgtaaaaacaagttaaggccacggttgatcgtttaaacgacaaaggctttcgggttctgattctggcacagaaaaccgatccggcgccaattgacgttttaagcgccaaagatgaaaaagacatggttttaatgggctacctggcgtttttggatccgccaaaagaatcaacgggtcgcgcgctaaaagccttattggagcatggcgtcaccaccaagattctgactggcgataacgataaggttacggccaccgtctgtcaggaagtcgggatgtcggtcgctcacctgcttttgggtgaagagatagtcaagatgtcagatcaagaactagccgcgcaagtcgagcaaacgcaggtctttgccaaactgactcccgatcagaaggctcgtatcgtcgctgccttgcgcgctaagggccataccgttgcctacatgggtgacggcattaatgacgcggaagccatgaaagcagccgatatcggcatctccgtcgataatgccgttgacgtggctaaagaatcggccgacattattctgctgcaaaaagacctgatgattctggaacgcggcatcgtggaagggcgcaagacgtatgccaacatgatcaagtacatcaagatgacggcttcttctaattttgggaacattttttccgttttgattgctgccgcgctgctgccatttttaccgatgaagagtattcatctgctgctgctcaatctgatctatgactgctgctgtaccgccattccttgggataacgtcgatgctgactatctcaagataccgcgcgaatgggacgcttcttcaattggcagctttatgatctggatgggaccgaccagctccgtctttgatttgacaacctacctgtttatgtattttatcttctgtccattattcgtttcccatggcattctttataccgatctgccagcgcatttctccggtgccgtattagcgaccatgcagcttaaatacgtcggcatgtttcaggcaggctggtttgtcgagtcaatgtggagtcagacgatggtaattcatatgatcagaactcctaagatcccctttattcaaagccgggcctcagctgaactgattctgctctcaacgattggcattgccctggcaaccttgattccgttcaccgcggttggccgggcaatcggctttgttgccttgcccggcagctacttctggtacttgattccctgtgtaatctgctacatgcttttagccaccagcatcaagaaagcctatattcgtcactttggcgagctgctttaaggaaggtgatcatcatgatgactttattaactgcttttcatccagctcatgctttttggatcgggctgctgagcgtcttggcaatcatcgcgttgatgaatctgatctgctggctgttgccgcctaaaaaacggccatccgagcatcccgcccaaagccaatccaaattaaaaccgaactaagtaaaaccgcactgactggttgagtcggtgcggttctttatttgactttcattcagcgagcggcttgcgcttttcgctgcctaattgcttcgttaatggcggccacgttcatctgctgtcttaggctgtgacgatcgattcggttatattcacagtagcgccgccagttttgccgtggcacgctccatgaccgccccgttttgggatcacgaattgagacgcgaattccgcaagccagacccaataccaataaaacggcagccagagcaaactgcatgaacagcgcaaacgccaaggccagcatccaaaagagaaactgaccaaccggaatcaagcgctcaaacggccgatcgtattccatcgtagcatcgctttgcagcggcagcttattcttattcatgatatccatcccctaagctttatttgtactttaattatagctcaagatcggatatttgtacggatgaatatactgaatatcgttttatttatctgtcaaccgtcgtcgtgatcagcattcagccaaggctaaaggcagccagctcttaaacgtctttttcggcaaccgcgtaccaattgccctccggatcggcaaaattaaacgtctgctggctgcctactaaaactatttcattaacggtcgcgcccatctgcagcagtctggcatgcgcggacgccagatcgtcaacataaaacatgattgaaggcgagttcagcgcaacttccggtgagtatttctgaataaaggcgcgactgtaaaactggagacaggcttctggaagaatcgggaccgtaatcatctttgaaccgtcaatcatcgtttcttcactgattcgtggcgtcccagctgcctgctcaaaaaaagcggctactttttcaacatcatcaacataaatcattaaattcattgactgtaacataaaaactccttatcaactattgtttggcttgccgtttcttgatctgcgccgcaactgcctctgctcggctctgctcacgccaccgtttccagtcaatgttattatagcgacagtattggtgccattttttgcgcgctacgacccatgactgaccggttttaggatcacggatgccgactttttgataaaacagcagaccgcccagcaacactgccagtgccagcccaaatcgatagaacaggcataagatcatcacgctgattaaaataataaactcaacgcccgaaaatgcccgtacgtagacatgatcgtactcactgggattttgatccagattctgcaatggttcagtttgcttttggtcaagaccgattggcaattcggttgtgcttttattaatggtttttcgcatgattttcccccaaaactttatctgcctaataaggatattatatcgcaattttttgacagcgcctacaggttcaatttgttgagctgctcatctgaaaaagatagaatttaaatatgcttaaataatccatatgatgaggtgaaaaaatggctgacatattaacgctgcatcaaatcagcttgaccatgcagggaaaaacgcttttaaaaaacatcaatctaagcgtacccaaaggatcatatatcacattagccgggccttctggagctggcaagagtacgattttaaaaatctgtgcgcgtcttttatcgcccagcagcggtgagcttttatatcaaggccaaaatgcctttcagatgccgccccaggaatatcgccgccacgtctcctattgttttcaacagcccgtcttgtttggcgaaacggtcagcgacaatcttgatttcccatttcagattcgcaatcaggctcctgatcgaaatcgacagcaggaacttttagatcaggtcaatctgcctaaggactacctgaccaaaagcatcgccagtctatccggcggggagagacagcgcgtggctttgatccgtaatctgatgtttaaaccagcgattctgctgctggatgaggtaacgaccggtctggacgcgcaaaacaagcagatcgtccatcagctgattgccaattatcggcaaaccggcactattttggccattacccatgatcctgatgaactggccaaggcagaaaagatcattaccgttaagggaggccaaatcaatgaatagcgtccacgtcaacaacatcagcctggtctatgccgccggactggtactgattgctctgtttatctcatatcgtcaaaagctgggactgaatcgcgacatgatcatcagcgtcgtccgggcaatcattcagctaacgattgtcggctatcttctcaaatacattttcgcgctcaataacgttctggttaccggggccatggtgctcatcatcatctttaacgcggctcataacgcggccggccgtggcagtggcattcccaagctgttttggccatcctttttggcaatcttgatcagtaccggcattacgatgggtggtttggtttggtctggagccatcaagttcatcccttcgcagatcgtgccgattgccggaatgattgcctccaattcaatggttgccattggtctttgctaccggcagatgaaaactaaatttcatgacatgcatcaagcggttgaggaacgacttgcccttggcgcgactgcctttcaagcttgcggcgacattgtgagggcctgcattaaaaccggcatgcagccaacgatcgactctgcaaaaacctatggcatcgtcagtctgccagggatgatgtcaggcttgatctttgccggtgtggatccggtatacgcgatcaaatatcagattatggtcgttttcatgctgctttcggctaccagtctgggatcggtatgctcatgctacatcgcctaccatcgcttcttctcagacgatctgcaattaattgatcgtttggcaaaggaaaatcaaaaatagccaaaaagccgtactaaattagaaatattattgagactaaggcttaaaaagagggcatcccgctgcttggcgaggtgccctcttttattgtcgcagtacttttatctgccaatcagctcatcatctgctgaagatacgctattggcagcagataattcaacgtgctggcaatgactgatttctaaattacagctattatacaaaagatcctgtatattaacatatgacaaaatcatcattacctacttttcacaaaaaagcgatgcatagtaggtaaaagtcagtgtatatcaagttagggatccccaacattacctactatttaacaaaaatcccgcaatagtaggtaattcacaaaatcggtctggcccaatcacccccaaaatatacatttttacctacgatttgaggaaaaaccatcaaaagtaggtaaagttaggctaaccaaaatattcattacctacttccggctcaaaatcagtctagggtaggtaatttccgcctccaaactgaccaagactcgctttgcttcacaattgacacacccgcatacccacggaggcgtaattgtctggtagcaagacacgctcgcatgcctgcgataggacgaaccaatcaattttgctgaaatagctgctttaaatgtcacagatcaagccattaacgccaatcaccagcattactaatcgcagttgccaacaaaactcccagttgataaatcaagtcgttttgctcggtaataattggcattctatcaatagcaactgctgatcgatctggataatgtttttagttaaggtaaattcatactactatattgaaatacagcgtcaccaaaatttaagcataaaaaaaactgagcagccgatgaatctcccaactcatcatatgctcagctgatatacagtcaaatggatctggcatgattgctgtttgattgaacatttaagccagattcagcaacgatttccagcttaatcgtactttacttccaatctatcataacgatttttcgctttgcctattcctggtctagacgtcatgctttggcggagtcgaccagctcggaataccgaaccagttgaacatcgtgtcgctcaatcatttcaattgcctggccactggttgccatttcgacatccagcgttcttgggtaaaccaaatgcgaatgctgcaggataaactgatccaaaaaaccagagtgcaaaatcagttcaggaatcacatgtggacgcttgtcagctgcagaaagtacgtgcgccagcgttgccactggatcataatccaaactgaaattttccataaatggcgtcagtttctggccttgaaactcaacctcatgctcaacgtcaaagctcaaatatggaatctgatgctcactggccacgtcacgcagcgcccgaataaaattaaggcttagtaccgtgtgacctgccagatagtccggctcgcgcttggtcatttccacgaagcattcgtattgcgcctcgacttctctgaccgcgtcttcgtaatcaacaatatcttttccctgttcaaaagcatcgtgatagacctgcgaacgcttaaagctcccatcttcctgcaccagactcgataccagttttggatcgctcaacggtttccccgcacagattacgacgtgaagcccaacatcagtgtctggttcgttttttaacagttcccaaccatgctcgctaaatggcaggttaaccatcagcgagacgttattaacaatgccacgatgcgttgcctcatagattccgtaattgacggcacatgagtatcccagatcgtcagcacgaacaattatctttttcattcaacgtctcctccgtcctttaaaccttttcaacctttctaaagggtaataatatcattattggattaccaaaaaaacaaaaatactccagcatttcagtttgctagagtatctttacgaaacgttttgtttatttattcaagaattgcctttaaggccagcgcaaagttgccaattgtcgctgagccattgttcttcgccaacggcatcgtgatgtagtcctttagatctccgacttcaacataattgtccaacagcttggcaaattcatcccgcacttttgccaaaaacggctcactgactacgccgccgccaaaaatgatcttccctggccgcatcattaaggtcgtgtcgagggcagcctgtgcaacataataggccataatatcccagacatgatcatcaagcggcacgtcttgacccttctttcccgtccgtgcctcaaaagtcggcccgctgaccagcccttccaggcagtcgccatgaaacggacagatgcctggaaagccaagatcatctggatgccgctttacgcgaatgtgtcctatttccggatgtcccagatcgccaagaaaatgaccatccacaaccgcgccgccaccaacaccggttccaatcgtaaagtagactaaagagcgcagccgctggttgaacagcgttgacaagacgtattcgccatatgccgacccgttaacgtcagtcgtccaggcaatcggtacgttaaaggcttttttcagcgtcccgacaaaatcagtatcggcccagcctggtttgggcgtgttggtaatgtagccgtactttggcgagttgcgccgaatctcgattgggccaaacgaagcaatcgaaatcgcctgcagatcgttaaattgcttaaagtagtcaatgcatttttgcaaggtttctgcgggtgtcgtcgttggaaacttggtactgtccatgatgcgatagtcttcgttccccactgcacatacaaactttgtcccaccggcctcaatgcttcctaacaacataaatgtcacctctgaatccttatttgagcatcattttaaaacgctttcatttctctacggctattatgttaacgcttactagcgtgactgtcaaccggttgtcagcgattgtttcatcaatcgacagcaaatatccgctcccgaatggcttttattcatgaaaacgtgtaacatgaagattaagtaattttacgaataatggaggaatgcctaatatggaagccaatcatcggcctaaattagaagacgtagctgccgcggccggcgtttccaagaccactgtctcgcgtgtcttgaaccatcgcggctacctaagcgaaaaaaccattgccaaggttcaaaaagcaatgcaggaacttgattatcgccccaacatcatcgctcggcagctgtataagcagcggacggatctggtcggcatgatctttcctaccgttgacaatccgtttttcagtcagctggaagccgagatggaacgtcagctttatcgcaatggttataaggttttgatcggcaacagtcaaaacgatcctgccaaagaagaaaactatctccagcagctgttgacgcaccaagtcgatggtttgatcgtcggaactcaaaatcgtggtctgatcggctatcagcatgccaatctgccagtcgtggccattgatcaggttgttggtaaaaatattccagtggtttcttcagacaactaccagggtggtctgctggcgacccagcgcttgttggatgacggttgtcgccacatcatccacaccaatggcccgcttggattagacacgccaacgcaaaaacggcgcgaggcctatgagcatctgatgaccaaaaacaatctgccagccattacctaccatctggactttaacatcagtaccattgataaagagcgggttttccggcgcatctttgaagaacaccccgaagtagacggtatttttgccgccaacgataccgatgccagcacgatcatcaatctggccagcgaatatggcaagcgaatcccggaagacctcaagattgtcggctatgatggaagcaacgtcacccgactgcttttgccgggactgaccacgattcagcagcccattgatgaaatggctgatctggcagtgcagctgctgcaggcacgcatcaacggccaaaacgttaaatccgtggttctgcccgtcaccatctggaatggcaagacggcttagttttttgatcataacggtagctgaccagcttctttaaaataaaatgagtaaataattaggcaaaactggttttttcgttataatatctccgaacatccatttatcgatatgggggaacctttatgagcaagttaagtcaaatcatcaccgaaaacgagctaagcagcctgttgacaaaaaactacatgggattagagctggaggagcaccgtttgctaaaggacggtcgcatcagccgctacccatacccagctgaatttttgtcacgccggcataatccgtatctaaaaaccgattttgccgacaacatgctggagatttccggcacgccaacgctggggaccaatgccaatctggccaatcttgaaatgctccagcagctggtaaccgatcatctgcaggctgatgagatcatctggccgctaagcatcgcacctgctttttcaaaagatgatttagactttgccggtttattcaacactcgcttttggatggctgaatatcacgactatctgcagcaaaaatacggcacggctcgagagatctttaccggcgtccatgtcaactacagcatcaatcaaacgttggtgcaatcgctgtgggaccacggctttaatgaagacttcgccacgctggccgactttaagaatgctttaaacttcaagctggcacaaagttttgtgttgtggcgctggctgtttacctacttttttggcgccagtccaattgccggcaatctgccaagcaatctaccgcgtgatctgcgttttccggttcgcagtcttcgcagcagctcatatggctatgccaaccaaaaaggcgaggagattacctatgactcatttgaagaacagcttgctcagctcaagcaacgaatcgatcagcatcagttcttctcgatgcatgaattttacggtcccgttcgcttaaaagggcgtggcgacagtctggccgacctgcagaacaacggtactgaacggctggaatttcgttcgttcgacctggatccgtttgcgccggcgcgggtcagcccagcggcattaaacttcttggaattattcttgatcaatgcgctgctgcggccgcttcctgaaaaactagcggaacagctaaaactggctgcccaacgcaatgagcagattgccctgcagcacccggctgaagtctttgcctgggtcaagccgcttgctgccctactgattaaacagctgcgcgctactgctgcccagctggacttgccggataaatatgccaagagcctggacctggctgaacagcgcttggaaaatcccaaattgacgctgagtggccaattgctcgatcacatcagtcctcaaggcgatcttttggaatttggtctcacaaccgctttggcagatcgcaagcgcattgctgaatacaccgagccattagcggcattgaaaggcaagtgctctgccagtctgcagtcgctcattcgccaagccgtggagctggggatcaaggtgcggcttgatcagcatcacttgcatctgcagcttaaagaacatgaggagatcttccccatccacgtaacgtttgactaccaaattggaccgcgcgagtatctgctctcgcttttccccgaagtcttagaaatcaataacgatgaatactaagtaaaaagactgaccagcattttgccgatcagtcttttttgaaatcgaattatctggctaggcagccttttgagtactccaacaagcagcaacgcgtcgggcggcttctttagttgaaagctcagccgcgtcaatcatgcgatcatgtccaaagttttgttccagcatcgcttcaaacgttttgtccgcgtttttttgatctttcaatacgacgacgaatgctcctgtttcctgcagcatcttcaggttttcgtagcgagtgagaacatgactgggtgcggttaaaacgacatttcgttccgccagcttggcaccgaaaacgtcatgttcgatttgacggaggttttcttcaccacggctcatcgtcagttcgtccatcgtctgcccacttagattgacgatttcctgattcagatccgtaacgggacgatgcagaaactcgctaatcagtcggctgacacctgcttggttatcttccatgaaatttacaacgactaaatccataatgaatgcctccattcctctaatatttttctaattgaattgccattatattaatttagtcgccttaaaatgtcaatcgtttaaaactaatatttgtaaaattaaacaaacaccaattattgcgcatcagccattgatcaatgattaacaaaattaagcaggctgctttaaccgtttcagactgttaattcgtaatatttttcagccgaccatctggacttgatttgctttgtttttttctttggcaaatcgtttatcaattcgacatacggcttcaccattaaagattattaagtaaaattctatttgcaaatgttttcatcacattttgtaattcgttttatttatttgatacaactcgtgatatgataatactagtcgttttataaataaattcaggagggaatcgttaaaatgaaagtgctaatgtatggtacgcacccatatgaaaagccctacgctgaaaaatgggcccaacagacgcaaaccgaactcaggatggttgatgagccgctcaatgacgaaacggttgagctggcaaaagactttgatgccatcacggttctgcagactgcttcaatgggcagtcccgcggtttacgaaaaactggccagctttggcatcaagcagatcagctgccgcatggtcggcgtcgacatggtggatttggatgccgccaaggccaaccatctgatcgttaccaatgtcgccagctattcgccacgtgcaattgccgagatgggagtcgcccaggccatgtacctgctgcgccgcattgggatttttgatgcccgcatgaatcaaaaccacgatttcagctggaatgaaacgctcatcagcaatgaaatctacaactgcacggttggcttgattggtgccggtcacatcggtacggctacggcacagatctacaaagccttaggggcccgcgtcctagtcaatgacatcgcctatgacccagctctggaaccatttgccgaatacgttgatcgagaaaccatcttcaaggaagccgacattatttccctgcatacaccgttgctgccaagcacgcgggggatgattggcgaaaaagaactaaagaagatgaaaaagactgcctatctgatcaatatggcgcgtggtgctttaatcgacacaacggctttgatcaaggccctaaaagatggtgagattgccggtgctggtctggatacgctggctgacgagacgactttctttggtcaaaccaacgtggccgaaaaagacgttcctgccgattacaaagagctggcagccatgccaaacgtagtcattactccccacgtcgctttctttactcagaccgcggcccgcaacatggtgcagattgcctccaatgatgccattacaattgccaatggcggtcgctcccgcaacgagattcgctactagaaggtcgttaatcgaaaacgctgcttggcagagacatctggcaggcggcgttttattattataattgaccataaatcgtcagacagctgagtaagaactagacagtgatttaatcattatgaaaacaaaaatgccagtgaccgttaagccactggcgttttttcgtacgcgatcttaaagattatgcgcagttttaatgaagaattaaaatctgataagatggactcttaatgcttacaggattgcagttctaagcgaatcttttccgttaagaatgctttgtttcttatcaacttttaatttacgattattataataatccctgttcaagataatgtcaaccttattttttaaatttgcgaatttattttcaaatttaaaatcagtcaaactattgcgttattttttaaatttttaaaaacatttgattttagaaagaatgatcagccttaattagctctaaatgttcggctttcaatttactactcggcgtcttgctaactgttcgttttatcaaaagcaacttttgccaactaggcttttgattaagaattgatgagttcaaccaaaaactgaccatactgactggtggaaagtgctgcagctgccggtactagatccgatgtggccttctgcatggcaatggcctgcgcgactgcttttctgatcatttcggctgctttcccccatcccagatactccatcatcattgcacctgataaaatcagcgacgttggattggcgcagttttttccggctagctgcggtgccgtaccatgtatggcttcaaaaattgcgcagccagtctggaagttaatgttgctgcccggtgcaattcccaagccgcccacttgcgctgctaatgcaaaggaatctccggattatcaggaacacctgcagctgtccttttttcatttcaatcaattcactcaaaacaatcactcctttttgctgatcagctattttgtcagaaccggtcgttaactatttcaattaaaatatattaagtttccattcaaacttaacgcaaaaaggcacgccgcttctttgagaaacatgcgtgcttaaggttaagagtatggtacgttttgtctaattctaggaactttcttgacttgcctcggaagcagcaaaacgagcagatttcaaattggtgccctgccaattgtaatccagttaaagagtcgccccgacccctcaagacgactcaaaataggcgaggaatcacacaaaacggatcttaattgacgcaatggatcaatctgaggtgtttttctgtttccatggttaagactaacgaatcattgtaaagaatttattgcagcgctgtttctctattgtaaatttttgaattaatcttacttaatttgactattcgctgattttaattcaactacatactacgccagcgccagcacgaatgctgacagcgtaatcaaggaaaatgccgtactccagaactgcgttgaggccagctctttttcgtgtacgttaaactgaattgccaaggtagatggcattgttgccgttggaatcgctaaggcaattactaccagacatcttaaaccgcaccgctttctataaattaatctgtaaaagcatttgcaaatttaaaaacgatctttccaataaaccaattccaagcccggcaactttttctgcggacagccgcaaacctgctgctgttcatatttttcaataaaaaaaccgcccataaagagacggttttcgtcaatcacatctagtcaaccgaactcaatgcatcaagcatatcaacgcttcggatcttgtggtgcatagccattgctactcccgccgtaatgaccgccggaatcagtgccgaaacgataaagttgatcagcgtcatcgttggatcaaacattgcgttggcaggcggtaagctcaagatgataaagcgatgcagaccaatcccaaccagatagcccagcaggatgccgatcacggacaaaatgatcgtttcgcgatagatgtagagcgtcacttcttgatcgtaaaagcctaaaaccttgattgtcgacaactcgcgcatccgttcctcaatattgatgttggacaggttgtagataaccacgagtgccaataaggctgctaaaccgatcaagataatcatgacgcggtttaaactgcccatgatgttgtcaatcgtccgctgattattgacgttttgattgatcccctttacggcgccggttgccatcagacgttgcgactcctgctgcagcttagcgccttttttaagcgtaatcaattgcgcattggtctgatatgactgatggaaaatcttttggtatgcctggggactcatcagtacatagtgaccgatatacatctccatgatgccagcaaccttcatcgtccgccattttccactcgcgtccttaagcttgattgagctgccctttttggcgttgagcaatcgtgccagcttttctgagattatcacgccatcttgcggcagcttaagcgtttttttagtctgccggttcttgaccgcgaaatactgcttaaagtttttttcattgtttggaacgattaaagagatcgactgcgtggcatcatcatcaccgaccttcttggtcagctgctcaaaatagataccggtatgtcccttcactgatttgccgttcagctcgtttttcagttgccgctgctgtttggcagagctgttcgaattttggacggcgatcagatcgtacttgatgatccgactgtattcaatgttgctgatgccgctgagcgaatcgcgaatgctaaagcccattaccaaaagtcccgtacaacccgccacgccaaagatcgtcatcaacgcccgactcttataccgaaagagattgcgcatcgttaccttatagttgaagctgagccggttccacagccaatgccaacgctccaataagatgcgtgatcctcccttaggcggcttaggcagcagcaatgcggccggcttggctttcaagtcacgaggcaatgcccacagcgcggcgcccgtcgtacagagaatggcaatcagccaggtcgtcaaaagcagcgcccatgagaagtggatctgaaagccgctgagcgtggagttggcagcataggccttaaaaatgatctttggcagtaccataaaaccaccccaagctcccagcgccaccccagctgaactggccaacagactaaacagcgcaaactttttggccacatcggcatttgaatatcctaaagccttgagcgtaccaatctggatccgttcttcttccacaaaacgcgtcatcgtcgtcaggctgaccagggccgcgattgcaaacaacagcaccggaaagacgtttgccaggatatcgactcgttcagcgttggaacggtaaatggcatagccaggattttccgttcgatcactcagcgtataggttggcgtgcccagctgcttgagcttagtctgctgttttttaagcgcagcagcctgctgaatgagaaccgcattgcctgcccctgcatttttctgctgaagcaaatcggcctgctgcgttgcctgcgtaagctgctgctgagctgccttcagctgacgttcaagtttttgctgcttggttttgccatgccgattcaaggctttcttcaattgctgctgctgtttttcaacataattggtatagcgcgcagagtaaggattcattttcgccgtctggttatacgtgatccgtgcgattgcataggcagtaccggtcttgaaggctgtttttttaacgacggccaccccgctcaattggccggtgcctaccgttgtctgaccaatgtcgctgcgatccagatactcgctggaacgtacgaagccgacgatcttaaactgacgatgcttcaatgagcccgcttgcttgagtgtgatccactggccaatatgatacttgcccttcagtaggtagctgacggcaatctcattatcatgccgcggtagatgtccactgaccgtctgccagcttgagacgccattggtttgtgaaaaaatccgcagtgcccgcttcgtctgatcaatcgtactgtcctgcagatagccaaaatcaacctgcttaacgctcttttgctgtcgaatgatctgacggtcgcggctgtccagaccatagttcgatgtaatcgtggtatcggccagatgatgctgggcaaaaaaggtgtttgccgtctgccgcatatccggtcccgtaatttttaagccaatcaaggcaaacgcgctgacggccattaagagaaagatcgcgataaaccggcctagcgagcgggaaatagcctgccaggcatctttccataaaattcgcttgctcaaagttctcacctaccattcaattgactgaatgtcagccggatgctgattgcgttcctgcttgaccagctgaccgtcgtgaatatgcagcacctgatcgccaatcggagccaaagccgcgttatgcgtaacgataatgaccgttgaaccatgctcgcgactcatatcctgcagaatctgcagcacctgcttacctgtttcataatccagcgcaccagtcggctcatcacacaaaagcagctgtgggttcttagcgacggcacgcgcaattgccactcgctgttgctcgccaccggaaagctgagcgggaaagttgttgatgcgattggccagccccacggcttttagcgcttcaacggcatccagcgcctggggaacgatttctgaagccaattcaacgttttctttaacagtcaggttgggaatcagattatagaactgaaagacaaatcccacgctcagccggcgataggtcgtcaactcacgacgatcatatttggcaatgtcgtggccagcaacgataacctcgccgcttgagttcgtatccatcccgcctaagatgttgagcaaagttgacttgcccgcgccagaagcgcccagaatgattaccagctcgcctttttcaattgaaaagctgatgtctttgttggcataaagcttttctgaccctgtttgataaatcttggtattattatgaacttcaatcagtgccatactgtcatcccccatcaaaaggcttttctttttattttaatggattgacagttaaatgttatcgctttcttttaaattaacgattaaaaaacggttgatcgctaatttgcggatcaaccgtttttactgactagattgaggaatgcatatcaacagtaaccggcagaatcgacgtatcactgaccgttgagtggctctcaatttgagacagcagtttttgcgccgccagattacccatcagctccatgtcctgccgcagcaaaaagataccgtcatcaccaacgtactgcgaccagctccagtcatcaaagctgatcaatcccagatcttttggaaacgttactttctcatgtttaaagatcttaagcagagtaaacagggtcgggcccattaacgagatcacgaccgtccgtccatcaagctgtcccattacgcgcgtcagttctcttgccagccagtcatcatcatgacctttgatttcaatattatgataagtcagccccgtttcactggccgccagctgaaagcccttgattcgaggatgctggccggaagcctcggcaaaccgcgagctgaccgtgatcacattggcatagccctttttgcccaactgccgtcccaaccggtagctggcatcaaggttggcgctggttaccttgcctactgtcagcggctgatcatcaacttcccggtcaaccaaaaccaatggaatctgattgcgcaagactgactgatactgggcaaagctgcgcgagtttggctggacgataatgccgtcaacgcgctgctgatacagatcgtctaaggcctttttctccatttcctgcgagttgttggtgttcatcaacaatacatcataacctgctggctgcaagatatcatagattcccttactgagcagtgatgagaaatggttggcaatatccccgaccagtacccccactaaatggctctgcgtctggcgcagtcgtctagccgaagcagccggcacgtaatgcagttgattgattgtggcgtcaattcgctctttggtctgcgcgctcattttttgataatggccgttgagatagcgcgagacggtcgttaccgaaacccccgccgctttggcaacgtcgctgattgttacatgctgtgacataatcctcttcctttagcctgtttgcttagtaagatttattttatcataacccggcactaattaaaaaagtgcggaaccacaactgggctcacgcacttttataggtattttaagagtgaatctttagctaagaaaatcagttaggcaatgatcaacgacaggacccagacgcttgccagaccagccagtgacaatactgaagtcagcgtcgaccaggaaagcagcgtttctttaagtgataggccgaagtattccttgatcatccagaaaccagcatcgttaacgtgatcgcagaataccgaaccggcaccaattgaaagcaccatcaaagcactcatcgttggcgacatgtgggcggccattggtgcaatcagaccagctgccgtcattgaagaaacagtcgaggaaccaagcgaaacccgcagcagagccgtaatcagccaagctgccagaattggtgaaatgctggtaccggcaaacagcgtggaaacgtatttggaaatgccgccttctaccagaacttccttaaaggcaccaccaccaccgataatcagcagcatcatggcaatctgcttaacagaagtcgtcattgacttggagatctcgctcatcttttcgctgcgggccagccccatcgtccagatcgcaaacagcaacgacagcagcatggccgcatctggagcaccaacgaattgaatgaattggttgactgggttggtcttagagagtacaaatgagcagatcgtagcaacggcaatcaagataaccggcatcatggccgtcaaaacggagatgccaaagccaggcgtttcttctagcttaaattccttgtattcgccaaggaccgagatatcaacgtctttgcggtaaacggaaggataaaccttgtgcaggaaatagttgaaaaccggaccggagataatgatcgttggaatcgcgacgatgatccccaaaagcagcacgtgacccaaagtagcaccaagaatgtcggtaatagccgttggtgccgggtgtggcggcaagaaggcgtggcagacgttcaaagtagctgccatcggtatccccaggtacatcagcggcatgtccagctctcgagcaatgatgaaaatgattggcaaaacgacaaccagaccaacttcaaagaacagtgccagaccaatgataaacgatgccagaattacggcaacctgaatccagcgccgaccaaacttattgatcaaagtcgtggcaatccggtagccaccaccagcatcagaaaccagttgacccagcatggacccaaatccgaaaataattgctaagtggcccagctgaccgccaatcccagtttcaatcgcggttggtatcttggcaaccggaatctgcagacaaagcgcaatgataaatgaagtaacgaccagtgaaacgaatgtgttgagcttcaacttaacgatcaagaagatcagaatcaaaacccctaataaaacaatgagcagtggcataatgtttccccctcaattttaattttcctgctggagccgagcaatcgttgaataggccggcttgagcaatccttcaacctgtttgaacaatggcaggtacttttgatagacccgcaccgtggtctgctccggctgataagcaccaacgctgccgatcaagtcttgtaccgcgtccagatcatcaatcattcccagactcttcatcgccatcgtaaccgcgccaagacatcccgattcataagactctggaatgttgaccgcgacgtccaagacatccgccagcatctgcttccagacctcagaacgggcaaagccacccgttgccgttacgctggcaggcttaccaaccagatcgcataccgcatcatagaccgtggcaatgttcatgcagatgccctccattaccgccctcagcatgtcagcacgggtatgcagcggattcagaccaaagaagctgccgcgcgcgttggcatcccaaagcggcgcccgctcaccgccaagaaacggatggaacaataggccatgagcaccggccggaacgctggcgattacttgattggcaacgtcataaaccgatttgtcctcgcttttggcagccgaactgtcgaccaaatgattggccgcccattgaaaaacatcaccgccattgttcaaaggaccaccgactacccagcgctgccgatcaattgagtagcagaacaggcgctgttcgggatcgactactggatgatcagtagccacgcgcaccgccgctgaagtcccaatcgtaatggcaaccgtgtcctgccgcgtggccccgacgccaagattggaaagcgcgccgtcaaacgcaccatagacaaacggcgtctcatcatcaagccccgttgcctgcttggctgccggtgtcaatccagtttcctgggtcgtcccgtcaacgatctctggtagctgtgagcgcgtaatgccagtcagcttcagaatctcatcatcccaatcctgcgtatgcatattgaaaaatccagtgcagcttgccgttgagatgtcgactctaaacttgccgaacagtttccagaacaaatacgacttaatgtcagcaacatatgcggcagctgccattttttcaggctgcgtctgttttagccacatcagtttggtcaaaggcgacattggatgaatcggcgtcccggtttgcgcgtagatgtcggctccatccggggtggccttcagcttagccgcaacctcgcgcgcccgcgtatcagcccaggtcatcgcccgcgtcagccgctgatgattcttatccagtaagatcacgctttggttggcattggaaaacgagactgccaatacatgcccacctaatgatttggcccgatcagccgcgtcatgaatcactttttcgacggccgcggtcaggtcatccggattctgctccgccatcccattgccgtcacgataaagctgatacagttctttataagaatccagtacctgagctttctcatcgaacaggaccgcttttgtgctggtcgtgccgacgtccacaccaattagatagttcatcttcaactctcccttatcttcaacaattaatgaaaacgctttaggttatcgatacacctagtataataaatgcgctttcatgttttgtcaacgcttccagttaaatttgggaaatcgataaaccgaaacacgttggcgctgttgccttttgcttttttaaaaaattttttagacagctggtgatcagcgcgctatgatggtgtttaaaaatgatttaaaggagtcttttccatggataaccaggcacgtatcgactttttaaaacagctgattgaaatcgacacggctggcggttttgaggatcgcttagccgttgttctgcagtcattcatgcaagaacatgacgtcagctgtcggctattgccagtcatgaaaggccgcagcaatttctatgctgagctgggcgatggaaacaataacaaggtcttggcgttctgcggtcatcaagacgtggtaaagactgaggatcccgccaaatggcagtttccgccattcagtgctcatattgaaaacaatcgcatgtatggacgcgggacggctgatatgaaaggcggtctggcggcgatggcgattgcaatggccgaattaaaagatgaaagcgcgggtttaaacggtaagctggaactactgggtaccgtagccgaagaaagctccaagatcaatcacatgcaaggggcacagcggtttgcaaaagacggctatgttgacgatctgaccgccgcaatctttgccgaaccgactaatgccgacattgcctacgcacataaaggatcaatcacctaccgcatcgactcgattggcaaagccgcgcacagctcacggccggatctgggctttaacgccattacgcccttgattcatttttatcaggaacaggaacgatattttgacgaactggtcgctaaatacgaaaatcccgtcttaggacgtgtcgtgccggtagttactaagatcgatggcggtgagcagctgaatgccgtgcctgatcatgcggaacttttcgtcaagcttagaaccatccccgaaacgaacaatgacgaaatcatcgctcatttaaaccgcatcatcgccaatctcaacgatcaggatcacgcgcagctttccatcgagattctcggcagcaagattgccgtcacgacggagcgtaatgccgaaatcgtcgctattgcgcaaaaggcagccgccgatcatttgggacacagctttaatgtccgcggcattgcttttggcacggatgcctcggaaatgaccaaagccaaccgcgacatggacgttttggtatttggtcccggcaacgccacggcccataagatcgacgagtatatcgacttggatcagtatctcagcatgattgacatctacaaacagattgcccgcgactatcttaaataagctctaaaaatccgtaatcggttcattgccaagatgcccaccgaaaatccaggtgaatcaaaaaattcagctggttattcgatgagctttttctaatttcaagattcagataaaaaacggcctgactacggaaaatccgccatcaagccgcatcgtttatttatttttcagccgcgattgtaccgccagccgatcctttattttaagcaaccgtttcactagccgtaatttcttcaacgcgggtaatcgcccgtgcaacagcctgttcacccgtatcgattggcaggaaatgaatctgcgtgccgtctgcggaagtgtcgtgggcaatctgcaccaccacgtcttggtctgagccatcaagattcagatctgcaaggcatactggcagacccatgctgcggtaaagcggcaaaagctcagccatttcatcctcacgcttttcaagagccaaaagtaccagaatcccataagcaacccgttcgccatgcagcgaatcactggtttctggaaagacggtcaaagcatcatgaactgaatgagcaccggttgcccgtgcaaagtagtcgccccagccgccaaccaggccggaagttacgatcaccgtctcaaccaccttacgaaagaccggcgtcacctcacccttcttcatgtcagcaattgcctgttccgagttttccagcagatcgtcgcggcaagcctgagccattgcccgcgagatcgtcagctgcgtattgaactgttctggctgcatgttttcaaaaatcatctcggattcgtagtacttggctagcgtatcgccaattcccgcaacaaaatagttgattggcgagttgacgattacctgaggattaagcagcataatgtcggccgtttcatgatagatctcgtgattgatatgctcgccgttttcatggtagtgcacgcttaaagccgaccatggcgcgcagttgctggccaaggttggaatcaggcccagcttaaagttggttccctgcgtaacgcttttgaccgtatccagacacttgccgccgcccagaccgattaccatatcaacctggttttccgttgcgatctccttgacgcgcgcaatttcttcataggagcactcgccattgaagggcacgtcaatgattgctacgctggctggcatctctggcatgtaaggcttagccgcggcccatgacttttcaccatgcaggaacagcaccttcttgatgccgccttcctcaaaataggttggcaggtagtcataggcatcattggtagaaataaaacgttgtggtccacattgtgaaaacatcatggtagattccctctttcatgtatcttatgtcgcattggtcaaaatcttcatccggcaaaacaaaagctctcattcgctttgaatgagagcttcatttgaggccctcagccaagctaaagaagggccaaattattttcagtcagtactgaataataatcgggtccttgattgacagcatcagcagggcttgttttttaagagccgtttgctgattaaattgaacattgaattgaaattccattttaaacggctcctttctgttttaagcctggtcaagatttaatggtgttagtttatgataattaaattagaatgtcaatatattttttaatttaaatcaaaattaattagtttgatttattaaaataagtcaatgccaaacgcggataattgctattgacgaaagtggaactgatcagcagtcagcgttttaaaatgcagctgcagccagcaccaaatatcgcctggcaagatagcatctttgaaaagtattagcaattcattaattcagctctcatcaatcaattcgttcgatcatcaggtaattaacctggcagctcctcatttgctataatatttttgcttacattaaggggggagttttcaatggctgatacgaaaggaaaagccgcacgcttcatgctgatcaagctgctgacggaaggaatggtaaccagcagcgagatcgaagccgtagccaatgtcaaatcagatgccatcaacaagaacttcaataaaatcaagcaatggctggcaccaatggaaatcaccgtccagtcgttcaatgatcatgatcggatttttcggttaaacacggcacccaagacgatcgatttccgccgcaccttgattatcgccaagatcatcattgccagccgggccttcagcaaagccgacctttccgcggttatcaaaggattgatggctccatttaaggtcgtcaataaagatgagcttttcaaggtacttttaaaacccagtcgtgacgagtatcagccggttcaatcgctggttgacgtcaatacctttgaaacgatctgtcacgccttgtcggatcagcacgtcttgaaaatcatctaccaagatgcgcatggccagattgctcagcgcgaattggatccattaagcatcgactttaacgatcattacttttatctgcgcgcaattttatacaacgtgccggaaaaagctaacaacattcgcaactaccggatcgaccgcattcaacaggccagtttaaccagcctgccgatcgactgtgatcccgatgctattgaaaccagccgcagcgccaacatcaacagtctggccaacatgtttggcagcatcaacggaacggttgaaaaaatcgtgttccgctgtgcgcgccgcatcatcgagccatcactcgacaaatttccctatgcggccaaggtctatcatgaaaatgaccttactgcgccgatctatgacgccagaaaacaagagtcgtttgactttgatcagctggctgccgatgaggaaaacgtcgtcattgaaacccacgtggccaatattcaaggtgctttgatctggttgctcagtgctggctcacaagtcaagatcctgaaaccaactgccctggttgaccagattaaaaccgagctgcaaaatgcgctgaataactacaaatagcctgaaagcctcaaaatcgcggttcaattaaaaaatgacgctgggtcaattctcgatccagcgtcatttactattctaaacgattttagcgaacgcgataacaagccatccgctgctttttgaaagtcagctaagcggctggtctgagataccagtccagccaaagcgaaaagatcagcccaatcagtccaccaaccaaaagcagcccgcgcatgatcgaccagctgcacagcatcaccaggcagctgaccgccagactgtacttgagcatcaagcggccaggcgcctgccagcgtgctctttgccagttacgattgatgattttcacatcgcgtttgatctgctcacgattggcttcattatgatcatgctgcagatagacgatcatttctttttgattgctgatcccccaccaactgtagcgcggttgaacaaattgactgcgtgtgatctgcgctggatcaaacgtatgctggtggcgacgctcggctcgacgaatcacgccagtcatcaactcaacattgccatgctcatcatacgccgaaaccggtacgttgatcaaaacccctttaatgatcaaaaaccagtcttgacgatgctttttttcgtgctgccgcattgcatactgaatgtctctgggcaattgataccagtgtttttgccatctggcagctcaacttgcacccaaaagctgtaccactttttgcgcttggcctgctgaatctcagctaacgcccgcttggcaaacgaccagtctcgcatgtctggctgatgatccattctcattcccccattgatagactatttttcattataggttaattagccacccgcagcaaacatcaaaaaatccccgacccaaactttgagccgaagatttaatttcaacattaggcatttcttcaccgatttttaagcaaacatttgacactaatcgataaaacgtcgcaaaaaatcgatctcatcagcattgcagcgggccgcgatttcgggatccttttggttgacatggaaaacatgaccgcggggatgttgagaatcgccatagcttctaaactcatgcggaatttttcgatcaagcagatactgatcaaagcggacggccgtatcatgcaaaaagtcttggttggcagtcataacaaagaccggcaaaaaatccttggtaatatagtcttctactttcagatcatgtggatgcagcgaacgggcatgtcctgtaaaataagcatccagaacgcttggctgagccagctgccgttccagaaagtagcagccgcagttgagcagaccagctttcaattttaaatccggcatctgcatttccagcagctgcgcgtattctggattggtatacatgaccagatattgttctgccatctgcgcaccggcactgtcgccagcaatgaagacgttgttcatatccagatcatacttggcggcgtgctgcaccagccagtgaaagacttggttggtttcccgcagctcgcttgggtattcaacttctggcgcctttcgatagttaaagttgataaaggcaaaacccatccgcgccattgccagtccatagaattgataggtttctttggtaccatagacaaaaccgccgccatgcacgtgtacgatcaccggcagttttccttgatggcgatgcggccgatacaaatcgagcaggttgtcatcaccatgatcaccatagcgaatgttgtcaaagcgatcaacgttttctgggtacggattcagcccggcatcacgcgcgtcgtcatttattttggcttcatggcgaaacttttcaacgaccggcagccattttaaatccacgtatgaattgatttccgtcattaaaaatccctccgcttctaaatcatctaatccgattataacgcggatggaaagcgctgtctttggttaatttccagctggcggccgcttaatcagctgtcccagatagctgaccactccgatcaatgcaatgccagccgtgatctcgattgccaagggagttacaaaacgggccaaaaacaaacaacaaagcaacgctatcacggccagcaccatttcataaatatcaatatggtcaatcttgccttgtgcatgccgccgctttaaatccgcgaattcaagcttgatggttgccatcgccacgaatgcgtactgaacgacggcaatcatgatgctgcagggaatcagcgccagataatctcctgtcattaccaaaatcaaaacaatgccggccgttaaaagcgtagccacgtatggaacgccatttttagtcttaatgccgataaacttaggcagcagcgctttttcattagccaaggaagaaaccacgtatggcgtactgtaaaacattgaaatcgccacgccggcaatcgatcccagcattccaatcataatcacgatctcgccaattttgccaaaccgctgaccaaatgcccaagccaatggcgcgtccgcattgtcgatctgatcgccaagcatcccgattgccacgctcatggtaactatatagatcagtgcaacgcaaatgactacgctgatcaaaagcttcggcaggttctttttagaattatgaatagatgaggcttgcaccggcaaaaacgaaaagcctggaaacataaagaagatcaacataaatgcatgatcaaaatttctgactgaggagctggcggccacgttaaaattatccagatcgagataaaagatccccagcacgacaaacagccccaaaatcgtcagtttcaaggccgtagaaagatcattggcccagactgatgcctttttgcccaacagccgaatcgtcagcaaaatcaagatcaggccaacccccgcccagcgatagaccgcaagctcgcttagctgaggcagccatggccgtagtccgcgcaaaaaggccgcgatctcagtagcaattgccgcggctccctgcagccaggtaaacagtccgatctcaaagccccaaaatcggccaaactctttgtaggtgtaataacagcccgcgccattccccgaaaagtgatgcgccatctcggcataacaataggccattgccaagactgccaatgccgccagcagaatcaaggccaggctccagttgccggcatcttgaaacagcacgccaggcaataaaaagatgccggacccgaccatgctgttgatgccaaaacaaaaacaccgaggcaaagctgattttacctgcttgatgatttggcatatccatcccccctttttaatataattataattaatctatcactgaattgactgcttgataagttttcaaaaacagaattgtatagcaaacgactttattgattgaaattgagcatctcagcctaattgaatgaattaagtctttttaaatttgaattttctgctatactaaaaactaagttgaatatttttccgcactaggggagtccatgttctggactgagacgcgcgcagtgacgcgtaaactctttgaacctgttaagtcgatgcttgcgaaggaaagtgcttcttttttgaattggaatcaaccagatccgcgagcgttttaacgagttcgcggattttttatttcagccaatcaaaggaggaattcatatgagtctgattgcacagctgcgcaaacaaaatccggtcgtcttaacggttgccaatatggttacgcccgctgacgttgccaatggcttaaacgttttaggcgcttcgccaatcatgtccaaagcgcccgaagaagccgaagacatggttaagattgcccaggccgtgacgattaatctgggaaccgttgaagccgcacaaagaaaagaaatgctagcggttatggacgccgcgcagtttttagaggtcccagccgtttttgatccggttgcgtgtgccggcagcgcctatcgtacccaggtcgccaatgagcttttaaataagtatcattttgcctgtatccgcggaaacgccggcgagattgcggccttagccggaattgactggcaaagccacggaatcgacgcgggatctggggatggtgatctgaccgccatcgcgcaaaaatgtgcccaaaaatatcaaaccgtcgttgcaatgactggagccgtagatattattactgatggtcaaaaagtcatcaaggttccatttggctcgccattatttgccgttcatgtaggaactggcgacatgctttctagtattatcgcggcttttatcggtttgggcggcagtgtcttagaagcggctgccacggcttgtgaggtatttgccttagccggccaggccgctgccaagcaggcccaaacgccaagccgctggtacgacatgtttttggataatctttaccaagctgatgatcaattgattgcagcctggcaaaccgaattacagaaagaagactgatgatgatcaacgaatttccacaagccctttcaattgccggctctgattcaggtggcggcgcaggcatgcaggcagatctaaaaaccatgcagatgcggcatgtttttgccacgactgttttagtcgccattacggcacaaaacacgctgggcgttcaagacgccatgccgctgcctaaaaaaatcattgatgaacagttcgcttcattaagcgccgatttaaaaattcgcgcctgcaaaacgggcatgctggctgatactgaaaccgttgaaaccgtcgtcgccaatcttagacaatccgattttggaccactggtagttgatccagtcatgattgccaaaggcggcgcgcatctgttgaccgatgaggcgatcagcacggtcaggaccaagctgcttcccctcgccgatctagtaacgcccaacctgccggaagcagaggcactggctgaaatgacgatcaaaaacaacgccgatatgaaaaaagctgggcagcggctgcaggctttaggcgccaagaatgtcttggttaagggcggtcattttaatgatcaaaaacaggccagtgactttgtattgctggctgatggatccagcttttggatgagctctcctcggatcgacaccaaacgcacgcatgggactggtgatacgatctctgcctgcattaccgccgagctggctaagggcgtatcaatggaaaacgcgattcgcatcggcaaggcctacgtggaagccacgattcgcgacggcatccaggttggtcacgggcatggtcctttgaatcactgggcagtctaggagggcagtatgcaatttagagaagaaatgcttcactgctatctggttggcggcacccaagacgtcaatcatgatccaaaacggtttctaaatgacgtatcaatcgcaatggacagcggcattaccgcctttcagtatcgcgaaaaaggcaccagccaactcaaccaagaacagcgcgtgcagctgggattgaaactgcgcaggctggccgatcagcaccatattccgctgatcgttgatgatgacgttgaattggcccaggtaatcaacgctgacggcatccacgttggtcaaaaggatcagcgtgtcgaacaggtcttagccgcggttggcaacactatgtttgtcggctattcatgcaatcagccagcacagatcgagcacgccaaccaattgccggtggcctatgtcggcagtggaccgatttttccaaccagctccaaaaatgatgctgatccagcgatgggacttgaaaaactgcatgagctggtcacgataagcacccatccaatcgtggccattggcggcattaccgaagctaacatggcccagacgcttgctgccggagtcgctggcctttcaatgatctcaatgattctgcaaagcgctgacattcaaaaaaccgttcagcatatcaattctttatactaaatcaaccaggtgaaatttttatgaacgactcaaaaaccactaaattttctgaaaaactgcatcaagcagctgcaccactctggcaaaaaagcattcaccatccatttatcactgaactggccagcggtaaactgccattggcaacctttcgctattatctgacgcaggataccaaatacctaaccgcgtttgaaaagctgcatgaaagaaccgccgccctgcttcctcaatcacagggcgcactgctcttaaagctggccaatggttccggagaagacgttcagcgcagtcctatgctgcaacagctcaagctcagcccagcagagattcagcaagctcccatcgctcctaacaactacgcttacatcacccatatggagcatcagctgagcgttgatcccgctgccgccgtgaccgctcttttaccctgctactggctttatgatgagattgccgactactggaaagatcagaccagtcccgttcccgtctaccaagcattttttgacagctatcagacagtcggctttgataccagtacccaacagctgatcggcttggtcaatgaactggccgccaacagtagtgaaaccgtcaaacaacagatgatgaccgcctttttgcgcagcagcagctatgagctgggcttttggcaaatggcttatactcaccagacctgggctgacctggctgataattaagcaacagatatgtaaaacgctggattgcatctgacaacccagcgttttttttaatgttttgcaaccgcgccgtttaactctttgcggtctcctaaatagatcaagaaaatgattggcacgatgatcagcatgaccggataaaaagctttaagcggcagatactggtcaatcaagccccctaaaaccggtcccagcgtcatcccaatgtcaacgcccaggaaaaacgttgaactggccagtccctgttctccttgtggcgccagcatcagagccgttgattggcagactgagtagatgatgccatatcccattgccatgccagcggccgccaaagccatttcccaattggttttcataattgacagcatgatcaaataaaaaacattggccaacaaactgacgatcagccatttaccgaaacgaaccgtgtcgaatttagtgcgcagacaaagccggattaccagcaaaacagccgcatagatcataaagtacgcgcccacggcaaccgttaagtgacgctgttcaacataggtcacgatatcagcctgcgtggcaaagtaaggaatcgcaaacagagccgtcatggccgcaactggcagcgcgcttttttgaatgatcttgattcggccagacccatttgagcgtaatttctttaccggtacggaacgatcactcacaaactgaacgattaccgcaaccaaaagcgccgccgcggccgagacgataatggcaggccggtagccgatgacatggtacagattaatagaaacggctggcgcgaatgccattgccagtgcattcatgattccatacagtcccatcgcctcaccaacatgcgacaatgggaccaagctggccagccaagtcgtcatgcagacggtacacagaacgtaccctgtcccattgatcaagcgaaacaacagcagcaggccactgttgggtacaaaaatatagccagtcacaccaataaaactcagcaggccgccccaagaagctagccgatactttgagattcgatccgtcagattaccagcaatcggtctgagaaacattgccaccagactcatcatccccgcgatcacgccggcaaacgtgctgctggctcccagcttttgcgcatagccattaatcagcggattacagtacatgttgctgaacataaagcaaaaagacgcaatcatgactaaaatcacgtcttttgtatagattgattctcgctttgccaaaatgccactccctataaattgataacattttctcattatactctaataatcaacgtaataaaagagcaccgccgtttttaacgaccgtgctcgtttttttaatatttagccaggtattcatcgaccgcttcgtgaaaatcattttccagctcttcaaaatcgcgaccttcatataataccaagtgacgaacgccaacgatatggccaaagagtccctgcttgccgctcatttgctcaaccgtgccttgttgaccgcgatagttaagcagcagctggtttgattggcctgatttagcattttgacgatttttctcgtcggttttcttgccaaaatagaatgcacctggcaaagcaaccaccaacgctcctaaaacggcccagccatcatcaacggccgtcgcgactggcagactggctaaagaggataacgctgaagcagtgctttccgtagcatcgatgctggctgccttcgcgggtaccgccaccagcagcagaccaaacagtaccagactaaacatcatcatgcgagttttcttcattgttatcccctccttgaaaataaaccatctgatatcttaccataccatcataacatgtttcgtaacgttttagcaatcgtttccaagcccgtgtttaaaagatgtataacgttgtacttttttgacataaaaagactgatgcacggttaagcacatcagtcataaattatcttaaagtagcttcataaccgcggcaatgctggagtaggccatgaaggcaaccacgatccagcccgtccaagtcagccaagcaggatgatgataatcgctccccatgatcttggacttgtgcgcggcaaccagcagaatacccaaggcgattggcaggataaagccgttcagcgcgccaaccacaaccaggaccttggctggctgaccgatgaaatagaagatcgccgtggcaaaaacgataaatccgatcgtaatccagctgcggaactgatcaaacttggcattgcccttcttgctgacggcatagtccagaaatgagaccgaggtaaacgttgagcctaaaacggaagacagtccggccgcgatcaacaccagcccaaagaacttgtagccaaaattaccggccgcggatttaaaaatcgaagccgcgggattggccggatcgagcttgtagccagccgtaaccactgccagaccagctaagaagagcattacccgcacgattgatgccagcccgatccccgtcaaggcaccttcattaacgtacttgatgtctttttgaccactggcaccgcccgccaacagacgatgaccaccggcaaacgagatgtagcccccaacggttccgccaacgatcgtcaaaatcgagtaaaagtcaatgtgggttggcttaaacgtatgaacgaccgcggtttggtaaggcaccttcataacgcacagaatgtagatcaaaaccagaacaatgatggccgccaagacctgaaccgtccgatcaacggctttaagagcatctttaattaccaagacgataatggaaaagatcccgattaacaccgccccggcttgcggcgagatgccaaacaaaacattgagtcctaagccagccccgccgacgttcccgatgttgaaaaacaaaccgccaattgccaccaatgcactcagcagatagcccagaccaggaaaaacgtcattggcaacaacctgggcccgtttgccggcaacgacgataatccgccaaatattcagctgtacgacaatatcgactaaaatacaaattaaaatagcaaaaccaaagtctgctcctaattgtcccgtaaaagtggccgtttgcgttaaaaagccagggccaaccgcggacattgccattaaaaacgcgccaccaatcgcggccgaacgtaatttcttatcatgagttgccggcagctcagatacgccatttttggagtgcttttgcatagacatcttcctcccttatgtaatctgtcgttagttacaaaatcaagcatggtgaggatcaaaaggtgcgatttcaattgctgcatctttaagtgctgagcgcagcgcccgtacgattgccaacgcttcttcattgtcaccatgcacgcaaatcgtatcgacttgcagctcaacgtgctcaccagtaattgcagtaacagcctgatcttgaatcatatggaccgcacgtttggcaacttcttgcggatcatgcagcactgcatgcggcttgacccgaggcaccagcgtcccatcagcctgataagcccgatcagcaaacacctcgctggcataaggcaaaccaatttcacgagctgccgtaatcaattgactgccagccagcccataaattggcaattcaggatcaacgcgcttaatcccgcgacaaattgccagtgccaatggcagactcttagccgcggcattgtaaagcgcgccatgcggtttcacatgatgcagccgatgtcctttgacaaagccttgcagtgccgccacttggtaggtaatcatattttcaacgttttccggctgcatgtccatgtgccgacgaccaaagccaatccggtctggataactgggatgggcaccgatagctacgccatttttttcagcaattgctaccgtttgagccataacgttgggatcaccagcatgaaacccacaggcaacgttggccgcagtaatcagcggcagaatctgttcgtcatttcccaaaacataatgaccaaagctttcacccagatcactgttcaaatcaactttcattttgcagcccctttcttaaataccttagctaatgtttctgcttctgcaagtcatccaaccagttgaccgtagctgttaagcgttggaatgatggctcttttaaaatctgagccaataatccaagattggtctgaattccagtaatcacggtttcatcaatgatggcctgcatttgttggagaacccgctgacgtcgatcaccataaacaataattttagcgatcattccatcatagctgttgggtacgacatagccttgatagatcgccgtatccacacggacgccctggccgcctggcaaatgcagaccagtaatcttaccaggggtcatggcattgatgcgacattctaaagcaaaaccgtgcgtgacaaccaactgtggctctaattccgcaccagccgccagtcgcagctgcagctcaaccaaatccacattggtaatcatttcggtaatcggatgctcgacttggatccgggtattcatctccatgaagtaataagagccatcatggttatacaaaaactcgatcgtcccgacgccctcgtaattcaattgggcaaccgcatctgctgagcgccgcagcatctcatcacgaattcgcgcgggcactaccacagccggtgcttcttccataactttttgatggcgtgcttgaatcgtacagtcccgttcacccaacgcaattgcattgccgtaacgatcggcagcaatctgcacctcaatatgccgcggattggccagatactgttccagatacatctgaccgctgccaaacgcggctttggcttcatcttgggcgaccgtaaacttagccgccatttctttaggtgaattgacgatccgcatgccttttccgccgccacctgcactagctttaaccataattgggtaaccgatctcttgagcctggtccaaagcatcagccaaattgtcaatcgttgtactgctacctttgacgaccggcagaccagctttagccaccgtcatacgcgcctgttccttatcgcctagcagtcgcattacatcaccacttgggccaatcaatttaatcccgttttccagacaggcatctgcaaattcaggactttctgacaaaaagccataaccaggatgaatggcatcagcgccagtcagctgggccgctgagatgatggctgcaatgttgatgtaactggcattaacgttgtcgggaccaatgcagactgcctgatctgcaagctgaacggccagcgatttggcatcggtttcggaataaacggccaccgtcgccagtcccaatactcggcaggtacgaatgatccgaaccgcaatttcaccgcgattggctaccagcaccttatgaaagggccatttactaacggaattatttaatttgaataagcggctggtcatattcaaccccctcttcattatttaccaaaaccttttcaacgatgccgtcacgatcagcaaccacattggtaaagaccttcatggcttcaatcaccccaacgacatcgccttgcttaatatggtcgcctggcttgacgtatggaggatcctgtggtgatttagccgtataaaacacaccgatcgttggcgcgttgatcgtattgctgctggtaacgacttctttcggggccatgatgtgatggctgggattgctatgctgtggactgacactgaccggctgcgcatacgattcgctattggcacgtttaatgcggatatgctcgtcatctttttcatattccagttcagttagatcgttttccttgagcagattgatcaattcttcaatatttttggtatccaaatctatcactccttaaaaagtcgttgaatgcgctggctggcctctcgcgtaattccatatggcatttgatagcgtgccattttgatgcgatgacgcaactcttttaaattttgctgctgctgttttaacagttcctgggctgcattcagctcgatcagttcgaatttaatctgctgttttggacggcactgcaccagcttagacaagtccgctgtcgccacgactgccaatagtggatagccgccagtcgtttgtcgatcagccattaaaacaattggttcaccattggctggcacctgtaaaccacccattaccgtggctgccgataacatgctttcctgtttggtctgcatggcatcgccttttaaccggtaacccattcgatcagattgattcgtcaccgtatacgttccagacaaaaatcgctcatgatctttttcatcaaacttttcccactgtggtccttttaagacgcgaatcttaactggtgttttcaaatcaggcaattccggcattggtgcgtgtcgatgataataactaactaaagtaggcttagcttcgattggcaagcgatcgccactgactaacgctcgtccatccataccgcccagttttaaacgcagcgtggttgaacgactgtcaagtactaatggcaaatgcaagccgcccgccactgccagatagccaatccgtcctctaattgcgggtccgattttcaatatatcgccagtatgcacttgcaggcagcgatatcctttgactggctgaccattaagctgagcattaaattcagctccggttaaggcaatgaacgtcgtcgccataaaacgcaatgttggcccagtcagtgaaaactctaaagcagcggcatacgacgagttgcctaccaacaaattagcaacctgcaaagcggtctgatccattgccccagaagccggaaaaccattaatctgatgcattggccgtcccagatcctgtacagtggtctgcaggcctggttcaattacattaatcatcggcatctgatgtcaccgcctttacttgatacttgccaagccgatcagccagctggatcttttgaaactcctcttcgtcaacggcaaagaacttaacactgtcaccagcatgataaaaactagcgggatttttttcgtcatagagtttcaaaggtgtttgtccaataatacgccagccgcctggtgaagcgactggataaaagccggtctgctcgccagcaatcccaacgctgcccgccggaatctccaagcgtggctgttctagacggggcatggcaatcttttggtcgacgctgcccatgtaggcaaaaccgggtaaaaagcccaaaaagtagatcagataagactgggcggtatgctctttaatgacatccgccgtgcttagcccagcaaaacgcgcaacatcctccaaatcaggaccatacttgccgccatagcagactgggatcagccaggtcttagatggcggcagtggtgcgttcatcgatttttcaattaacggctcaagctgatcttttagttcttcaaagctggtctggccaccatcaaaggttacggtcagcgtccgataggctggaataatcgttttgactgccgataaatgctgctttaagatataacgcccaatctgttgcaagtgccgattgacaactggatcgatccgattggcaaactcaatggctaaagcctgatcgccaactggtataatctgatagctggtcactgaacatcccccctttagccagtgacttaaatttttaaattgaccattataaaatgattagagtaactttcatgctattggaattgaccgggcttgtcaaccatccttatattcacagtttatcaacaaatttattttgctttttcaactgtgaccagccatttaattttttcttaataaaataaataaaacaagctaataagttaataaaattaagaatttgcatattttaaaaaaatctagtatttcaaaaaaatagcgttatgcaaaaccgttaaaagctctgtataacgctatctaatattttttagtttaaaaagcagtcggttcactaaacctaggaccgacatactgatcaaaccattcacatcatcgttatgtctagccggaaatctcgtgactttagtcgatgatggttgacgaaccgctttgaatctttccgctattcgatcctaaattcatatccgcttgaccaggctatttttgccgccgtggccgacgacgaattacaaacatgcctgacagcccgatcagcgccgtcccaagcaaggccaaggcagatttttcgtcattgccggtttgtggcagcgcggtctggctggcttttcgttcggttgacttaaccgcgatcgcaactggagctgtctggtcctgaccattaacgatctttaattgcggcgttgccgaattgtcgaccgtaatttcctggttctgctttgcatcagccgctgaaccattagtactgctagtatcttcggtattagtctgaccagtttcgctgttcgctggcgtatccggcacaacaggatgcagcaaggcttcagcttctgccggcgtcaagtagtttttgcgatcagtaactggcgccttgattaaattaccagcattggtttgatcagcaatgtagctcataaagacttccgtatccgcgccaatcactgcaatctgattggtacccttaaaggccgtaaagccatcaccaccgccagctaaaaagtcgttgataaccacgcgataagtcttgttcatgtctaacggctgcccgttttcatcataagcggccactacgcgatatggctggttaggatcgtcactgtcagtgtagtagtacttgagaccagcaatctgcagataatacttttgatcttcgtcatactgctggtttaaggcatcaattacctgctgccccgtcatctcgactacccgtaaaatattgccaaatggctgaactgcctgggcagcaccccaagtaatcgtgcgatccggttcaactatcagatccgcccgtaacccaccagtattggtcattgcaaagtcagcattgacgcccagttttctggcttcggccaactgtccatcaactgccagctcaccagcctggttttctcgagttggcgtattatgcaggcggccggtgatgatttctggcgttgctgcctccccaatcttttggttgatgaccggcgccactcgcttggtagcatcctcaacgattcccgcaacggtcgggtcgctgatggcagccggattgtctttttctgaaaggaccgggagtcatgtgagacgatgctgtcaggcgcaaagtcgttagtcgccggattgatataaccaatgatgtcatcataagccttaccggtgtagatggcctgcaccagtttgactgaaccaaccgtggcattggcatactgatgagagtgcccagccaggtagatgtcgacagaattgtcagaatcgatctggtagagcttttggataatatcaaccgccatgcccttggtttcaccattcttggtctctaccccagtatgtgccaagacaacgatcgcattgacgccttgattgcgcagaatcttttcataatgagcaatggtttcggcttcatcaagaatctcataatccttgtagttgtcatagagtgtcagaatcggcaaatcggtcgtctcgatgccgataaagccgatttttacaaccttgttatcactggtatgaatttccttgatgatgtaaggctgaaaaccatatggaatctcgccatagttatcatcagtcttggtgcccttgagaatcacgtttgccgtaataatgttgatgtctgaagcttcatgcgggtaggccatttcagcatcattatactgcttggttggctggccaccgattacgattcggttaaattcgcccagtccctcgtcaaactcatgattccccagcgtgccatactcaatgtgcattgccttgagtgcatgcatggtggattcatcctgcaaaagtgccgagttggctggtgaggcgccgaccatgtcaccagcttcaacacaaatcgttgtccccgctggtttagccgccttaaagtcactctcagcttgattcaaagagccagccagtcgttctgccgtccccgtattttgataggtctgatcaccaatctgagcggtaccggtattggaaagcccaccatgaaagtcattgatccccaaaatttgaaccggtacgtatccttgatatttggcaagatccgaccaatcagtagcctgtcccggctgactggccggatcaggattggtaaccacctgaacggaactggcttgactaacaggcgctgtcgcagctgcatcatcagcactgaccggcattgccgacatcgttaatcctaaaattgccgaaccaaataagaagatatagtttcttttttgcatatctttaattcccccaatagttaactctaagcgctttcaatctaacataaatcattaactctcgcacttgatttaagtaagttgttggttaaaaattaacagtttatagcggaaattggcatttaaaattatttttttatttaattatattaattttttaaagtttaacgctttatttatttttgatgatcagccgttacttttttcgcttttctaaatctaaattcgcgctataatcaatattgtgaatacccaaacaattggaaggtgaaatcatgtcagaaaaagtttttgttgctcatgtcacgctcagctggggtgaaaagcgcgactatctaattgctaatgatgttgaacccggtctgcagcatcgcttggatacttatggcaacagttggaatgaagtaatgcaaaatgccttgatgaacgtgccagtagcaccatacctgccaagcaactcggttcagccgccaattgctacggccaaggtcagcgatgtcgaagctcgtgatttcggtccaactgaagaaaaactgcaacggacgcgcagccagtttatcatggccgcaatgtgggaaaaacagtctgccgagaccactgccaactttttgcaccatgactatgatcaagccagtcaagccgaaatatttgctgatgtcgactattgggttaatggtaccaagcaccctgatgtctgggcccataccaagcagctgattagagaccaggaaaagcgtttaagcgaagaaactgctaattaaaaggcataaatacgaaatcatcccgatcacggttaaaagctgtgaccgggattttttgagaatgatattttaggcttttagtattcagaactgtttcgattagctgcgattccccgatcggcatgcgtcaacgatatttcggttaattgattccgtagctgatgtggagcaatgatgtttcagttagccgtttccgcagtcgccgcaactcaatgatagacagattcccgctctaattaacctccactccgccactgataagacgtcaaccgcagctttacctactattttgaattttttagccaatcgtaggtaactgtataagcaatttttcgaaatttacctactttgcagattttttgcctcaatagtaggtaattttgtatatttttggttcgaacggcctaagccaaaactgtgcaaaactttattttacctactatttttatcttttcttcaatttataggtaaagttagggataccaaactcaatttggcagattgcaagaaataacttgaataaacttagtaacgcagattacgcaaaaagatctcaatcggtgttcgccaatttaaacatttgagtggtcgggaattcaaataccagttaatttgaatcaattcatcatcggtaatctcatcaatcggttgacctttgggaatgaagcggcgtagtactcggttgcgattttcattactgcctcgttcatgtggcgaataagcgtgcgcaaagtacagcggaacaccggtctgttcttcaatcaaattgtagttggcgaattctttcccatagtcaacagtaagggtcttgagattatctcttaactggttagccaattctaaaatagccttggtcattgaagtactatctcgcccattaagccgtttaacgatggtaagccgactcttacgctcgacaaacgtagctactgcttgacctttacgttttccagataaaacggtatcagcttcaaagtgacctgaagtattacgatcagaaatttcagctggacgatcttcgatggaacgtccatgactaaaagtaccacggggttctttagctcgtttgcgacgaataccatggtcaggtaaatcagtcacattaatatccagtagtccctgatcaatccaattatagatggttttgtaggcaattttaactacatgagccacttgttcaattgaccatttttgaatcttgattttttcttcaattggatgtctttaaatatttagagaccctgcttagcgcctttacaaaacgcgaaacgccagaaatagaggcttatttgccatgggctcgtgaaattcaagaaagctgcaaagcctaattgataaatgaacagcggtcgaccatgcagaaatgcgccggtcgaccgctgcttttttattctttaacttttgaaattgtctaccgtttagtaggcaacacggttcaatatgatgtgcttacattaaatatgcccacaccgttaattagtaaataccatcgtatgccttttggtaaaggtcaatgatgtcttgcttcgtacccttacgtgggttggagaatgcgttcccatccttcagggcattttcagccatcaacgggaagtcttctggcttagcaccgattgccttgatggatgatggaataccaactgccttgcacatctcacgcatcccgtcgattgacttctcggcagcttgcatggtggtcaggccggtggtgtcgtaacccatgatccgggccagttcggcgaaccgatctgggcaagcaatcaggttgtactcttcaaccgtggtcagcagcaatgcacagcaaacaccgtgtggagcatcgtattgaccaccgagttggtgagccatggcatgaacgtaacccaggttggcgttgttgaaggccatcccggccagcatttcagcttcaaccatcttgtcagcctcttgatcatcgtaaaactgtattctcatcggaattttctcctcatttcgcgaatctggtcgtcagggaagtttaggtagttgagtgtgaatcgatacgtttggcgaacctcagttataatatcaagcaacccataatactcgcaattcgccagccgagcaatggggatggatcggctataggcgttgcgcggctgaatgttgaaaaacagattgtagccatgctccggttcatagtagaccacggagacccagtacttagtgcgccagcgattggtaaagcagcgtttgattcgctcacagatcttttcgctttcggtttctttattccaagctttgtccaccggcatgacctcctaccaactgacttctttcgataaacgtgccacccttctccaagctggatgcccgcatgattgacgtcttgccaaagcgtttgcggatggcgtcaacggtgtcttccagcttaaccatgtcgtatttgggcggattgaacagatcgagctgctcgccatagcggtcggccaagcgagtcgcggccacgctgatgcgacgaaccggcgataccccatcccagtatgtatagaacagataaagcagctgctcgttgatgagattcgaatcgaccgttgaatcagaaagcttcagcgagtgggcaaagccggtttctttcattggcgtgctcagcgaatagccgattgaaaggtacacgccccctgcctgcttgtcatgcgcgcggagccgagaagctacctgtgagccgatttctcgaatgacgacttcaatctcctcggctctcgtataatcgcgcggcaggacctgtgaattgcccaggctcttgtcttttggcagaacctcctcagccaggtcggtgcggtcgattccccaggcagaggcgtacagctgcgcgccgataacgcccatcttttccttgagaatgaacgggtcggcatgagccagctcagccatggaatgaatccccagtccggcaagacgtttggcggttcgctcgttgatgccccagacgtcagtgatctcagggatggaccagatcttttctttgaccgtgtcataggtgatctcgccaatgaagcgcggatcatgcttggcatagacgtccaacgcaatcttggcctgcagcggattctcgcccacgcctaccgtggtaaccagcttcaggcggtcatgaacggtcttttggatctttttaacgaccgcaattggatcatccccgaacagtttccaggaatgagtgatgtccagaatcgactcgtcaatcgaatacggcagcaggtcctcatcggccacgaactcgcgatagatgttgttgacctcaatgttcttttcgatgtacgtattcatccgtggcggcaccacaatcaaatggttgtcgcgcggcagatcacgctgacgattgacgttggagatgccataaagctttttggccattggagatgatgccagcaccagcccgccattggtattttcggtttccgacataactacgagcggcgtggtgagcggatccagcccgcgcatcgtgcactcaaccgtggcatagaatgatttattgtcgatgaccaggaaaatcccccgcggctcttctgaacagtccatcttgctaccctcctcgaacttctgtttgcataatattataatatgcgaataagtgttcgcaaaggcgaaaacgaagataaagggtttaagggtaataatacggcaaataggcccgtggaaattccgcgagcctgttttttgattgccagaactgcactataactgagctgaattgtatttggcaaccgagccacgttccttgatttgatacggcagctcaactgaagaaacattctggttggtcaagtgttcaattgccaaccgtcccatctgcttgaatggctgatcaatcgttgtgattcccggatagatcatactggctactgacgagttgtcaaaacccagaactgccaattgctcaggtactttaatgccgtgttcctgagcggcatagataaccccggctgcggcatcgtcactggctgcaaaaattgcctcgggaagttctccttttgctaaaagaagttctgcggcctgctttcctgctgcaaacgagtagtcgccgggaataatagatggtgtaagtccagctgactccattgctttttgatatcctgcacaacgcgttctaccagtttgcgggtcgccggtatccacggcaatcagagcaatccgttggtatccgcggctgattagataattggtccctgtagtggcggcttttaggttgtcgatggaaatcattggttggttggaaactttgacgcctagagaaattaatggcagctgcagttgatcaagtagtttcagattatcctcatcaaattgaaccgaaactgaaatgataccgttgactttgcgcccagccattagatttaggcatgtcttcagtcgttcagagtcatttaagccacagtgagccaagagaattcttccgccattttggtaggcccagtcttcaatgctgtcgataatgggggcggcaaagctcgttgtggcattggttacgattaccccaatcagatttgaggtctgtgcaaccagattaacggcagcttcgtttttttgatagtgtagctcatctgcaattttctcaacccgacggcgagttttttcgctgtatcccccactatggtttaatacgcgggaaacggttgatggggttacttttgctagtctggctatgtctttaatcgtggccatcgggatccttctttcgaaaaaggttattgactttttaagtcagctgtatttataatactccgtgaaaacggttactgataccgcttttattattttagcatttactcaaacgtttgcgtaacttttatttttagaatttttacaaggaatgataataatggcatatacaccaaaatggtggtggcaaaattcagttgtctaccaagtctatccacggagttttcaagacagcaatcatgatggcattggtgatttaaaaggtatcatcagtcggcttgactatattaaaaaactaggtgctgatattatctggctcaatccaatctaccgttcgccaaacgttgataatgggtatgacatcagtgattatcgggcaattgatccaacttttggctcattgaccgactttaaggagctgctgacaaaggctcatgaacttggattaaaaataatgatggatctggtggtcaatcactcatcagatgaaaatgaatggtttaagcaaagccgccaaggaaaagaaaatccataccgtgactattatatctggcgtgatccagtcgatggccatgaaccaactaattggggatcatacttctctggttcagcttggcagtacgatgagacaagcggtcaatactaccttcacctgttcgctgtaaagcagccggatctaaactgggaaaatgaagccgttcgtcattcggtatacgacatcatgaattggtgggcagatctcggtgtcgatggatttcgaatggatgtcatcaacttaatttcaaaaccggctgtctacaaagacgttccgaccgcgcccagaatgcagtatggcgatgtcgagccggttgttgccaatggtcatcggatgcacgaattccttcaagaaatgcatcaagctgtaatgaccaaacatgatttggtaacagttggcgaaacacctggtgccacaacagatgatgccaagaagtacgccaaccttgaacagactgagctgaacatggtttttgagtttgagcatgtcggcttagacggtaacgacaacccagctttaggaaaatggagcgacaaaaaagtcagtctgccagaattgcgagataacctggtgaaatggcagactcagctgagtggtaaggcctggaactcgctttactggaacaaccatgatcagccacgcgtcgtatcccgttttggcaatgatgatccaaaatatcgtgtcgtttcggctaaaatgttggcgacaatgctgcactgtctgcaagggactccttatatctacgcaggtgaggaactgggaatgaccaacacgacctttaattctttgtctgactatcgtgatttagagagcattaatgcctaccatcagctggttgacgaagagcatctggttgatggaaagacaatgagcagatatctggcaattcattctcgggacaatgccagaacgccaatgcaatgggatgacagcaagaatgccggtttttcggatgctgaaccttggatcgcggtcaatcccaactattcagagatcaacgcaagggcggcactggcggatccatcatccgtcttctatcactaccagaaactcattcaaatgcgccatgacctaccagtaatgactgaaggaaagtttgcactggttaagggcaacgaatcggatgatcaggtctttgcctacacgcgtgatgatggagaaacaacgctgcttgtagtagccaactttaccaaggaaacgatcaagcgagaatacgccgctggtaaaggtaagctcttattaagcaactacgaggatgacatgggagaaactctgcgtccatatgaagctaaagtatatgaattcagctcaaagggggaatgagtaatatggaaaatcaagcaacaaagactggactgccgagtctgccaataagtaccctgtttgccatgacttttggtttctttggcgttaacatggcattttcgctgcaaagctcacaaatgggaagaatctttcaaacaatcggtgccgatcctaccaagttgggtttcttctttattctgccaccacttatggggatgattgttcaaccattagttggcaaatattctgatttaacgtggaatcgctttggtcgtcggatgccttatcttttagttggtgcgccaatcgcggccctggttctgattcttttacccaatgcgggatcatttgggttcggttacggttcactggccgcgctttggtttggagcgattgcagttctgttcatggatctgtcttcaaacgtctgcatgcagccattcaagatgattattggtgatatggttaacgaagaccaaaaagactttgcctggtcctggcagcagattttctccaacatgggtggaattctcgcgaccctgatgccgtttatcatgacgtttttaggggtttccaatactgctaagaaaggttccctgcctcactcagtcatctggaccttctaccttggcgcggctgtactgctcttaaccagtatctttacgctggccaaggttcatgagtataaccctcaagactatgccaagtaccatggcgttgatattgcagccaatcaagaaaagcttagtttcgcaactttgctgaagaacgcacctaaggcattttggcagatctcactcgttcagatgttctgttggttcgcgttccaatacctttggacttacggtactggcgctgttgcaaagaatgtctggaatgtaactgatccgtcaacggctagctatcaggctgccggcaactggttcggtgttctgtccgcggttcagtcgatttcagccgtactgtggggaatggttctgtcaaagaccaagccaaaccaacgtaagacgatgtatcgtttaggtctggttcttggcggacttggctttatgtcagtattcttcattcacgataagatgcttttgattctttctttcgctctaatcggcattggctggatttcaatgaattcgattccgtttgccctgctgacgactgcgctggccggtaagcatgaaggggcatatctgggactgttcaactgcagcatctgcctgccacaaatcattgcttccgttgccagctttgccatcttcccattgattggcaagtccatgccggggatgctccttttggcaggtattgtttttgccagcggcgcactgtttgtcggccgaattcaagaacagccgaatgcttaattgaaataatttatagcttactcatatctatcctaaaactcctaaaaatgaaatccttgtctcaaaatcgaggcagggattttgtttgtcagccatttcagaagccattgtgccgcacagaattcgtaaatcgttgatggacgcattgcggagtcattttgggcagcgaaacgtactcgttgagggtgcattataggcgcgtaccgagaaaattggtatccacgtcaaatccccgtcactggcgggtccatgagcattcatggatcgatttcccttatgttctttaaattacagaaaactgaaaaaggagatttttagctgcttgaaaaattttgtcatcgatcggcatcgtagaattttatatcgtatatataatttgcgccaacattccttacgatcaagcagaatatatctctaaattgagttatccttaatatacaaacaagcattcccgatctgattgggaacgcgaagtaagacgttaggggcggtatgatgagtattgtggtaagagctttggggattacggttatattgatgatggcggtattggcaattcgacttttaaatgaaagagaacagctgtttcgtaatttagaaaacaagtccagattcgataaaagcagtcgattgagatggaaaatgaagatcctagggtcgagaagaaagcttaagcagggaagacgcgctttgagtcagatggtactagcttttttgattggcttcctaacgatgcgcgcctacgcgaatgagtatttctttatgattggcggcggcatcagcgtgattatttttgtgcgttcgttctttgtttggaaaaggattacgcgcgagagcaggccagtcattcttagtggttcagcagccaagatcatcaaagagttctttgatgacggggcgaagaaaaactcacaaaatgatgacgtatctaagaaggacgattagaataaatgaaagcgtgattgttgcgagactatttattattttcggtgttacctttaggggtactatagattcttgtgagaataaaaagaaaggagctgtagaacaatcgaaaatgcaattgaagtcaggcatctttccaaatcttatggtgacttgaaagttgtcaatgatatttcttttgatgtccgtgaaggtgaacttttagcttttcttggccctaatggagctggcaaatcaacgacggtggactgcttatcgactttgaccaaattcgattcaggagagattaagttggcaggctttgatataaagacgcaagctcaaactatcaaacagaagattgggattgtgtttcaagagggacttttggataagaaactcatggttgctgacaacttaacgcttagagccggtttttattatcccaacaaggcagaagttaaagacgccgttgatcgtgcagtcgaatacacagagatcaaggacctgcttaagcgtcagtatgggaaactgtcaggtgggcaaaggcgccgagtggatatcgcaagagcccttttaaacacgccaaagattctcttcttagacaaaccaacaacagggcttgatccgcaaacaagacagcatatttggaagacaatccaacgcttgcagaaagagcatgggatgacaatttttctgacgacccactataatggcagaagcagctatggcagactatgtaataattctagatcacggggaaattgtcgcgaagggaagtccaatcagtctaaaagagcgctacagctatgatcgattgagactgtacccaaagaaagagcagcatctggatagtttactgggaagcttttcatttacctggagcaagatggaagactactatgaggttgagttaacagacacactggatgccattgatattgtccaaaaagcacggaaccagctacagagttttgaagtgttgcacggaacgatggatgacgtgtttttgaacattacagggaggagcctacgagaatgaaaataatggtcaagagaaacctcaagatttactttcaagacaaagctgctgttttcttctcaatgctgagtgtaatcattatttttgccttgtacatcttttttattggtgactcgataagcagtggtttaaagtttttgccacatcctaaccggctgatgagggcttggatgttggcggggatgttggcttcggcatcgatcactactagtttgggagcttacggggtaatgatcagcgaccgagagaataaaactatcaaggacttttattcatccccagtcagtcgacgacagattgcaggaggctatatcattactggctttatcataagtatcatcatgtcgattttcaccttgatttttggagaaatctacatgggtatgattggcggagcagtactggatatggatattttactcaagctatttggtgtaatcgtcttgtcagcctttgcttcatcagcaatcgcttccttcataatttcttttttgaagaccaacagtgcctactcagctgccagtatgatagtcgggactttaatcggctttttggtaggggcatatattccaatcggtaatctgccagaaaacgttcaatggctggtaaagtattttccgtgtgctcattcagccgtcctctatcggcaactattaatggaaagttctatcaaagagaattttgcaaatcaaccgacagcagttttaaaagaaactaaggagattctaggagttgtatttgtgtataacgggcataccgcgtcagcatggatgtccgtagtagctttgttgattaccggtgtagttttctatttgctggcagttttagtgttgattcggaaagagaacgagatttagaaaaacagacatagcgctaggctatagtcctgtcaagtgtacaagataaatagataaaatttgattatgtggcttgatcgcggaattttccgtgttcaagccgtttctggttaagagcttaccgctagtgatattattggtttccccgcccgttgcagcttcctgagcttagtagtaaccagttcttctggaagttcagcaaaggatttggcgtttcctacatagattccaatgttggcctgtgctggtttcgtgcgttgaatcaaaagatggtttgtgaacatgctggtcagccattttcttaatcgttccgcttgttttgaggttatcctttgacctttgcctgtacagacgatatagcagattgttttaggcaagcgatcagttggtagtactctgccatccattagtttcatttgagcgggtatgattatctctgttcgcgaggtaatattttcactcacggtctttttagtcaattgatttatcgcggtactgagttcattacgattaaaaaggtaggcatatacttccgcggtcatatcaacatctgtaatggcgacatctttcatctttgccaaagggagatgatattgattaacggtatctcttagactgggaagattggccagattatgtttcttcattaaataatgatcgattgagaagaattgaatggcactgctgtttagacaggacagtgaatccaaacagctgcaaagaacgtccaagtcatgccttacattccatcccacgaacggcaacgactttttcgtaaatgaattcaactcatcaacaacaagtgatagttgccctttcttcatgtattcagaaaattgaaagctgctgtggctgatccctctttttaggtcgcgtgccagcatattgggccaatagagatactctgataggcagcttattcgttttccattaagataatggccaattgcaatctctaaaggaacgattcggatctctttagactggagattcagctcagtagcaaattcgcagtccagtaaataatattcattcggaggttctaaaagctgcttgaaagtcattataatcaactcccaataattgaatttctttagtgattatctattttaaagttaaattggtctacttatataaaaacagtttgttaatcagaaatcaacattactaatttccctatgcaacagaatccagaaaaaagcagacacaccaaaacccttggcgcgtctgcttttcatttacccaaaatcaatcttatccagcatatgctcacggctgacctgatcaagccctaggtaagccagggtcatggcctcgctggagtggttcagcagcttcatgaccagaccaatgttgtagttggactggacgtacacacggtaggccccagtcttgcgcatcgtatgcgtgcccagatagttgatgtccaacaaatccccgactttggccatcacgttgtagaactggcgctcgtcaatatgcttctgcggccgcgtggtagaaggaaacagccattccgtcgtaccctcatagccgttgcgtttaagccactgctgatacatcaccagatccatcatcaccggtttgagatagagcgtgttccgcttgccggtcttcttgtccttgatgaacgcgtgttgcttgatggcgccatagtcatcgaaaacgtctgcctgcttgagtcgcagcacgtcactgacccgcagcagcgttgccttgccgacttgaaagatggtgtagttgcgccggccagacttgaagttgttcaacagcgtatcctgcacctgcttgagtacctcatcatccttgattggcagtacgatctgtcgcatttaatcacccctgctttcccgtcaaacggaagctttcatcaatcagtctcattacgtcatcgtcgcccagctgatcgtcaagtacgactgaaatccagtacttatgattcatatggtaggccgggaaaacggaccgaccgtcaactggcagcgtgtcgcttttcagattgatgatatcaacgttttgttcatcatcatctttagtaacgagtccccgtcggccgttcatgatcaggccaaaccacttgcctgaattcaaatgtcgaaaaacgccattatccttgttattcttggacttccaaggaaaatccggcatgacgcgatactgatcataaatcctgcccgcgattcgattggcttgtggggatgcgaatggcatggtcagacagcagtgatcgacaatccgccctaagatctctagatagccggatcggacggaactgacgaacttgccctgcattgccggcacgtcaatctggtaatactcatccccggttgagcagtcaatgacctggccatcgactttacagtttttcacggtgacgaccgcccgaaatgagtcatcgagaaaactctcttcgtatgtatatgtgccctcgattttctgaaagccaaattcgctcatctgctcggggatgaatttttggtttttaaatacatcgtcaatcaatctggtcatcttgtcactccactttttttcgcaaaatcgataagtatcatttttattatatatgaacaaataacacgtcttaattttagcataaaacaatacagttaaagcaaaacgccatctcaagcaaccattagcttggagatagcgtttatcagtccttaatattaatttttccgtttctttaatgcaagaccaacatttaaagccttgaaacaccatttaattggctgaccgcgatcctacctatgctttcatttaagagtgcttatcgcgacgcttgccacctaagagcccgccaaacagcatactcagcatccccaaaattgcccagatatgaccgtgctcttgttcattgctgccagtctgaggcaagcgtttatctttaacctgctttgatttagctgtctgatccggcaaaatcgttgatgcttctttaatggcatcagcatttccagttctgtttgactgattgtccgactgtacgggctgatttggtagtatcgtttgatccggtgttgtcggttcatccggcggcgttggctcatccggtgttgttggctgatctggaacagcggatttgatgtattcaacttcaaccgtcaaatcatgcatatccactgttacgtgcagtgatggaataacttgcatcgttgcggtatagccttccaatgccggcaccgttacgctgaccagttcacgatcaccgatagcctgccagtcgtggtacgtaatttgtccagtaacctcatcaaccaccgcacttcttgcaaaccgcaccatctgtttgatcgccttaatatgaccatcggggagcttgaagacaatcgaccgcgtaaacattttgttcagatcggcaaaggcaacgccacttggatagtgacaatctggattgttcggcagcagattttcagttgtcttaggatcatttggcaaaaccgtgactgtagcgtgtgcaacctgaagcacgatatctgacgtggtcgccgtaaatgtaacgttgtcaggaacgacttgctcggcggtcagtttccaacctgccggaactttgatcgtaatcggtacggtctgatccgtctggccgctaattggatccaaagcaattacctgaccatgctcgtcttcatatttgacatgaatcgtctgttggttggcaacataattaatgacaattatttcatcagcatcgccggcttgcgcttcatgttcgtcaatcccgcttactgatgggtgatatcccgctacctcgggaacacgatatgcagccatcagcggattgccgactgcctgccaatcgccaaaaccaacgaatctttggttaaccagatcatattcacccagtcgttcaaaatcaacctgctgcttagtaataaatggctgatcttgatgcggcatcaagactttgatctctctgacaatggtttcagcaagctcgctggcatcggcgtgattcaatttggctgcctgttcagcgtcaactgtaatcacgcgatgtttgataacgattctgactggctgatcagcgctctcatcaaacacaactgtatccggaaccttgccggcaacgatttcccagccagttggcacgctgctttggaccgcgactgtttcgccagtccggccaacgatggcatcgcttctgatcagttgattgttttcatcaaccacggcttgacttggcacccatcctttgatcgtcggtatctcaatctcggtaaaacgatcggtaacaccgctgccatcgtcttcggcaatccagggcccatagctgcgctgcttggtaacctcatcttcaaaagccagtcgaataaagttgactttttgctgaatctgcctgctttgaccatccggcagtttgatattgatcgttcgcgtaaccgtggtatgacaatccggatcattttcatcaattacctgcagaatatggccaatccgaatctgcagcagctgctcgccggcttttaggacgacttcatctgggattgagttggcaccaattaacttccagccagccggcagctgtgaagtaagcttgatcgtctcaccaggttgcccccagaatggctgggccgcaacgtaattaccactggcatcaacatactgaatcacaaatacgctttgagcctgactgtaggtaaccgttgccgtactgtcaggcgtgtttgcatttggccgtgattgcccaatttgagctaaacttggctgccagccctcaatttctggtacagtgacactttcaaaaacatcatcgccataccatttaccataaacaatctttccagtaacctcatcttcagttgcgctgcggtcaaatactgctttttgaacaatggtttcgatctgtccatttgggtaagtaatcttaatcgttcttgtcacggttcgttcagtatcatcggcaatatcggtaacatctttttgcttatgctgaatcaagattacgattggatccgcctgggctttgatctgaatcatcgctggtacgctttgagtattggcaagctgccagtttttaggaaccgtcaacttgaatgccagccactctcccgtctttccagccaaggactgttctgcaatcacctgactggcagcaccattagcgtagacatattgaatcagctgcgtttcaatttgcggctcgtactgaatttgaacggtactgtctgcagaatcggcagttggtacaatcattggcacctggttaagattagccaaatagccagcaatcgttgggacgtcaaactggtcaaactgtccttgacgctgccactcgccatagatgaactggttggttaccagatcacgggtaacggttcgcgtgaattttacggtttgaactttggtctgaaccttgccattaggaagatttaatttaattgaacgactgaccgttcgcgtttcatccggctgatctaccaagccatgctcaatctgtacggttaatggcacgttgactgtttgaatgaccaatgattctgggagctgctgacccgccagcagtcgccagccagcgggaagcttgaatcccagtttgatcgtttcgccaaccttgccagcaaagttttgcgtcttgatcagattgccgttttggtccacgtaattaaccgtctggagctgtgattcaggcagatactcaacatccaagacaatatcggcagtatccggcgtgactacaagttggcttaccgtttgcgaaggcttatagccagctacttccggcaagatcagctcatcccatttggcaaccagtggaatccaagcgccataagtatcggtatcgctgaccagatcatggtaaactgcccgtttaaaggcggccgtctgtatgaccgtcgttacggcattttgattcagcggatttctaaagttgatcgtccgcgtaatctggcgcagctgtggtgttttctcagccaaccgatgaacaaccagaatgtcaattggctgattggtggccttgatctcaatgctgtcaggctgatcgtcttggttggccagctgccagtttttcggcaggttcaatttaactggaaccatcgtattaatgtcgcccgttaccgtctgcgttccaatcacgttgtcgttttcgtcaacataattgatgattcgttggccagtcttggcttggtagatcacgttgattgtctgattgttcgtagcacttggcgtctgtttgtcaatcgaaatcagctgttgacctgtgtcagtatccgtaatgatcgcctggtaaccatcgatttgcggaatcgatacagcgttccagattgatttggtattcagcgtttgccaatcaacactttccaatggaataattggcagtcccgttactgcatcgacccaaacaatgcggacaaaatgaacgcgttgaacgatctgagtctggttgccttgaagatcggtaattacgattgtccgcacggcataacgattcagcacgtcttcgctcagatcaacttgatagtgacgatctttggtaccagcaattaaatcacctttttgcacgggatgatcaaagtcaacttgatatgccatgtgccgcagctttaatttaatcggtgtgtcaacgactttcatggctaccttacctggtacggcctgattttcatcaagcccccagccatctggcaggtccagcgcaaaatcaaccgtagttcccgtttcaccatggataacctgagcattaccaatctgctcaccggtatcggcatccacgtatatgatggtctgcgtcgtatagcggttgtagtaggtaatcgtaatgttgccatccacgtcttctggagttggcgtggatgcttcgaccactttaagacttggcaagtagtcagccaagtcatcaggtgtaaattgatcaaagctgctctgaccaataacttgccattggccatacgaaacggccttggtgaccgtatcaatggttgcactgcgcttaaactgcacggtttgtttaagcgacttagtatggccgtcgggatagatcaccgtaatattgcgggcaatggttcgattaagtttgttatagtcaaccccgttaggataaaagtcatttttggtatgcggcaggcgatcttgtggcgtctttggatcatcgggatcaactgtgacttgaccatgtacgatcttgactataattggcgccattgccgatccagtaaatgtaatttgctgctgatcagcctgcccgtctgctagcatccaaccatctggcaatgcggctgtaaagtcaattgcgaggctttgatcggtttgtcctgaaacagcagcttggccgatcacgttgtgctgatcatcttgatagatcaccacaaccgactgctcattagctgaataggtaatgttataagtcagtaccgtatcctcgccaactggctggtaggctgcaatctgatcacgactggcagtataaccggtaatctgtggaactgtatattcggtaaatgccaggttatctggattttgccatgcaccataggtgatttgattggtaaccaggttcttgattgctgttcgttttaaagtgatggtctcttttggcagagtatattcaccctgatgcggatcaaagatattaatgatccgggtaacggtcttttgggcatcgggatcagtttctgaaacgtctttagtctgatgctcaatttgatatttgatgatcgtatccgttacgggaatcttcaggctagccggtacgacaactccagcaaccagcttccagttgtctggcagcgctgcattgccaccctgattggtatccagttttacgttttgatcaaccaagccagtgattaaaagcttagcgatcacattgcccgcactatcaacgtactcaatcgtctgcacgccagggttggccgtataagttacgtcaatcgtcgtctcactggccatgttctcatccgggtcagcggctgcaatctcgttgacagaggagcgatagccagcataagtaagcttggcagcatcaaccgcatcaaaacgcttggttacttgccaattggtatagacgtcttggcctgtgacctcatcatgcgtctgatcagccgtcatctgcgcgatctgttcaatcgtctcatcaccacttggtttatgcaaaatcacggttcgcttaaagtctttagtgatttggccggtagtcgtctgatgcttgatccgatagacaatggctcccttggcattcatgtcgattgagatcgttgcaccatcttgaatggcgctatcaacaaacgtccagtgctctggcagtttcaattgataagcaacgtgagaatccacttgaccagaaattgtatcagctcggatcagctgatcattttcatcaacatattgaatgattcgcgtggtaatcggcttggctgaataagttacgtcaacgacttgatcgatcgtacttggcgttggttccatgctgtgaatgacgtctgggctggaatagtagccatcaaactgtggcacgtcaacgactgcaaaaatatcattgccctgccaggtaccatattcaacagtattgtcaaccagatccttaatggccgttcgggtaaatttcgccgtctgtgtaactgtctgcttactaccatctggataagtaaaattgatcgtccgcgtaatgattttaatggcattggaatcagttgatgaaacgtcttgatactggtgatgaatcaaaatcacgattggtgcagcattaggactaagcttgacactggccggaatcgtcgtccccggtaccagttcccaattagctggaatggctggcacaattgcgacactctgatcagtcagcccattgacggattgggttgcgattgggctgccgctttggttattttcatcaacgtaattaatcagttgtgtctcattttgtgcaaaataggtaacgttaatcgtaatgtcatctgccatggcagttggtgtgatcttaggcaccgtatcttgtgaagccttatagcccgcaatcggatcaattgtcacggcttcaaagctgccatcaccttgccacttgccatacgcaatctgattggtaaccagatcaagcgtagccgtccgcttaaagttgaccgtctgggtaatcgacttggtctggccatctggaaagtggatattgatccgttacgtctcttagctgatgctgaaccaaaataacgattggcgtatcggttggcttgatcgttaccgttgctggcatggcttgtccagccatcagttcccaacccgttggcaaaacgcttggtacgttgacaatctgatcggtagcccccgtaataatctgggttaatacgacaaagccgttgacatcttgatatgagatcgtctgttgacccggattagcctgatagctgaccagataaattgaatcgctggtatctgccgttggcgtgacagcctcaattacttgatagtttggcgtatagcccgcaattgccgttggtagcacttatctaaaggtcttatcgcctgactgccattgccaatcgccatagctaattacgccagttaccaaatcctgtgttgcctgacgtttaaactgagctgactgcttgatcgtacttgactgtccagttggcgtagtaatcgtaatctgccgcgtaaccgccttattagtctgaatattgagtttttgatcaagcccagtaacgtctctggtctggtgttcaattacaactttgatcaccggtaggtcacgttgcccttggcatcaacgttccagtccttggtcaaagcttgataatccgtcgtctgaactgccaattcggttgattctgcagttgcattaaccatggccaccctggcgattcgattagctgttgccaacttagcactggctacacttgatttttcagcagctgaaatcaccgtgctttcagaaactgcattggcagattcaacagctgaactggtggcagtttgactatctgcagctgttgaagacgcggcatcattttgatcgttgccagcactggctgctgctgaactgcttgattgcgtcactgagtcagttttggagtcatccgtacttgatgatgctgcttgactgtttgatgaaactgtcgaatttgaagcaacagtcgcaactgcatttgaattgcctgcgttatcggtagttgctgtagcggctgaggggccgttggcttgcgatgctgtactgctgattgtaatcaagcgattggtcgaactggtggtatccgccttaacgacatgcccacttagactcatcccgatagctactgctcctgctgaaacggcaactcgctttaaaacggcacgatttaaaaaatagcggcaaatttggcatgatgtaagccagttcttgcctgctttgtacattttgacgcgacagctgtgatccgtttcggtctcctttcctaaccgttgtagtttattcattgaaattcccccattttaagctactctaaataataagttgggtcactgttcagcaaatcacctttatttcgtcaacttattatttatcacactaatattttcttaccataatattatataactgcacatgaagccgttttcattaaattgctcaactaaggatccaaaaagaataacaatatttttgtaacaatttaagcccttcttatttataattagaatattataatgattggggatgaatgcattgaacgagctgacaaacagacacctgctgattgttggacagaccggcagcggtaagacgacctcgactttaaccttgctggatcaattgcaaaacagcggtcaagcaaacgttgtcctcgaccctaccggtgaatacgcgcagctgccaaacgccatcgtttaccgcttgggtgagaacgcttatctggagcccggcgaattttcagctgcacaactggtggaggcgttaggactgcaattcaatgaacagctaattgtcgcggtcacttcagcaattaatgatttgcggattcaaaataatctgcttaatcatcccggctgctatcagcgcatcaatcagccagttgccgaccaccagcagacactggccaagcttggacgctggtcaaaatcgtatgccgttcaactgctgcccgaccaattaattgaagaactggtagttccatatgctgatcagcgggccaactatcatttgcttggtcaggaatataatcgtcaattgattgcatccgtatggccaaaaatcattcaattaagagaaatattggccagtccggcaatccgcgaactgtttggcactattcatcagccacaaaaagtcaaaaccgagcttaatttcgtactgcagatgtttttagatcagcgcagtgctcacaaaacgctggtaatcgacctttccgcgctgaagacgcttgcaattggtcaacgagccgtcatctcgcttttaatgaaacggattctggagcaccgtctgcagcataacgcggcttttcccgtcaatattattatcgacgaagctcatcgttacctgccaaccaatgaagacgtgctgagcgaaaacgggatctttcaagtgctgcgtgaaggtcgcaaggttgggctgaacgtgatcttaaccacgcaatcacctttggacctgccagctaaactgcgctctcagtttcctaatctattagtccatcatctggccagccccgaagaagttggcagtcttaacctggattcgcaactgactgccaccgtcagcggactgggaatcggtcaagctattatgtgtcttttaaatcagtcgccgcgcgtaattgacgtcccgttgcccagctggtcgaacaacaaggaggatttttaaatgtgcctgttcatcattttgatggttttatttttaattgctgcggggatcgtgatggccatggcaacaacgtttatgtgggccatcatttttgctgcggtctgcggaattctggtctatagcatgctggcctggctgtttcgttggtatcgcagcgcggccatggtcgatcatccttccagtcgctcggctctgctctatacgatcgtcatcatcttgattttgatcggaatcgttaaatggcatgaccatcatactgatcatcgtttcgactatgcgcagccacagagcatgcagattgtatcttcgcccatcaaaaagtcttaaattcaaaaagagccggtgtctaacatcgactcttttttcgatatcgtaaatctattcgcggcaacgatgccatccaacgacatttatcaaatctcgttttaattattaatcatatttatagttaaaaaccaatatgaattaagtttttagtgttgagtgcttaatttagccagtttaccgagccagcgggtttgcaaacgtccatttagcaattatcatttaatgtaaatctaatcttcacatcattatataatctaagaggtgaaatgcatgcctgcttttgatattcaaccctatatccagcaagcgcccgcccaggttcgacaaaggattcgcacgggcatcattgattttcctacagccggcatggcagcgggctatgcacaggctaatctggtaatcttgccgcaaatgtatgcgcatgactttcgtgaatggattcggcaaaatccgcaagcctgtccactgttggaaaccgtcaaacaagcacccttgaccaagacaatcgcgcggcacgccaacatctgtacggatattccgcgttaccgtctctatggaaacggccattttactaaagaggttaccgatgccactcagtattggcaggcggatatggttggctttctgattggctgctctttttcgtttgaagaagccctgctcaaagccggcattgagattcgtcatctgactgaaaagcacaacgttcccatgtataaaaccaatattatgaccagcccagttggccgctttaaaggtccaactgtggtttccatgcggccaatgtcgccggctaaagctcagctggcccgccagattacggcccagatgcctaacgttcatggggcgccgatccaaattggcgatccggctgcaattggcatctctgaccttgatcatcccgattatggcgatgctgacacgatcaagccaggcgaagtgccagtcttttggccatgtggcgtaactccacaggcagcaatcgaaaacgccaagctgcctttagtaatcactcacgcgccaggacacatgtttattaccgatatcaagaatgctgatctcaatgcctaccttgacgcgcatcagccaaaatagcctaaagcagcggattgacattcaattaaacgtcaacagctgaccaaatcaaaaatgcactgccgcgaaaagttcgggtcagtgcattttaagattaaaactagtcaatcaacgaatgatagcgcgtgtaagaaactggctgatcaagctctaagttcatggaaacgattggcttgccgtcatgctgctcttggcgggccgatcccggcatgtagcgacacgtgcctagataataaaaggtcttgtcgtcatcagcatctgattttttgacaaagagtgccaggcgtcgccgaccatccgtaaacttcttgacatcaggactgtctaagcgccgtttgcctttagaaaagtagtgcatgacgtgatcatttaaaaattgatcctcatattgaatcgaacggctgatgtttttagctttatggtaagtgacaaaaatgacgccatcatgttcattaaaaaagtagccacctatattttgcgcggtcgtattgaccacattgttgaccaggcgcatgacgtctttacgcgtatacttctcacccagcgtaaaccgctgatccgcttggtagcgcttggcccgcaaaagcccggtcttgatgccatcttgccaaaggcggctgaaccacgcatcgttttttaatgaattgcgcagctcatcatttagccgatagatccgcgctgcctgatcaaaaatcacaactgggcgaccgccataatcagtacgagacggcgccgctttcttgttataaaaagttaggtccaaaacacgccgcatcgaagccagcgttgctccatcaaccagacagccggccgcttttagctgctgcttgagttctttttccgtaaccgttgcctgattcaacagatcatccaataagatcagttcatgacgccgcttgccatttaacagttccgcgtccaaaaaagtcaataggcgattttcataatcattgatctcaactggttctttttcgccaatcaaaaactgcgcgtaattcttctttttattggctaaaatctcaggatcaattgaatcggcagccataaagtcagccagcagcggcacgcgtcctactcgctgcttcatattttggtaaaccatccgcaacttgcgcatgtcatccagcttaacctggcgcagcgactggtagatccgctccttagcaatctcatcaaacgcaatcgttgacagcccaatcgttggctcaatctcaacggtttctcgcgcgctgtctttggaatacgaggcatcccccgtcaaggcaattgggatcatgtagctgttcttgtagttgccgataaaatccaacacctcaacatagtctttgttttgggctttgcgcagaccccgaccgagctgctgaacgtagacgatgctggaattggtgctgcgcagaaaaaccacttgattgacgcatggaatatcaatcccttcattgaacagatcaactgtcacaatatattcgattacaccatcttccagttccttgaccacctgttgccgaacgctcattgaatccgcgccggctagtgccttagctggatgatactgtctggttagttccgctgccagctggttggcttcttgcaccgttgcacaaaagatcagcccatgcagcttgggaccagaatagccatagtattccgtctgctgcagaatatagtgcacgcgctccgtactggtcagatgctcaatggcttgaacttcttttttatgatggctggcggcattttgatagctggcaattgtttcattgaccttggcatcggcaaactgataatcgctgatgcccacataatgaaacggacatagcatatcagcttcaagagcctgctgcagtctgatttcgtaggcaacatgatagtcgaacagctcaaaaatgctgaaatcgtcattccgctctggagtcgccgtcatccctaaataaaatttaggcttaaaatactgcatgattttttgatatgagctggccccagcatgatgaacctcatcaaccaggatgtagtcaaattcagttggcgaaaatgcttgtaaatgcgcatcatcttgtaaggtctgcactgtagcaaataaatacttggcatctttttcatgtacgtttcccgtatacaggccataattttccttaggaccgccaatgactttttgaaagctgcgggctgatttgcgcaaaatttcttctcgatgcgctaaaaacagcatccgctttggcttggcattgcgaacatcgaacgcgcccaagtaggttttccccgttcccgttgctgaaatcaccaagccccgatcatgccccgcctgccgcagctgtgcaatctgtgccaaggcgtctttttgcatctgattaggctcaattagttcaccatcaattaccggttggccgtttttaaccattttggccaccgcatgacccacttgatgattcttttgataaaccagctggtactgcgcaatccattggtcggtcaatggctgcgcgtttcgccattcattctcgatgttttcactgacttgccgcgtaatatcaccattgttcagtgagttgacctgcagactccattcatagttgcgcatcaaggcattttccgtcagattggcactgccgataatgatcgtttgatagtcatcatgctgaaaaatatagcctttttgatggaacccatcgaccttggcaattttaaccgtcaagcctggaatcttgagcagctcattaaaggccttgggttgattgaagtacaggtagtcagaagtcaacagccgaccttgcacgccatgactggccaattgtttaaagattggctttaagcatgaaatcattgcatccgttacaaaagccaccgcgaaaatataactgcggcaagtctgcaattcgtgacgcagctgattccagatctggttacccgcttgattggtcagcagcttagggccgagatcgccaaccgtggcaaattcatcttgatcgacatagccgtttaaaagcgagccatggatttcttctaccagctgatcattatcgcctttctgcaagcgttttaaaatcttaccgtagtcaacgccagccattgttaaaacgccgcctttcccagatcagcctgggcaatggctttggcaatcggcaagtcggcgtcggcccagtgcagctgcatcagctctgcttgatcacaccacttaacttgactatgagcaatcagatcaaaatgatgcgtatccagtttggcatagtaaaccgtcagatgaatctcaccaaaatcatattgtttgatggcggttggcgcggcttggcgtccaacttcaatctgatcattgaattcttctcttaactcacgctttaaggctgtttggggatcctcacccggctcaatcttgcccccggggaactcccacaatgcgcctaaaatacgatcatcactgcgtttgcttgctaaaatctggtgctgctcatttaaaatggcagctcccacaacatatatttttttggtcatgtttactgattcctttttgcatagattagtttcattataaagcgcgctaataattggatccagcgactttttaatcttcatcgtgaaagcgttttgattaaaataaaattaaaaaatcatcagaattttgcttgccattcatttttttaagtgatatattaatgccaatgaaatttacgagtggtcgtcaagtagagctgcacctcagcgttcagaaaaccggtggtcgatgcgaaccggacagggtgtctgttgcgaaatacccgacaaaataagcccgtacggattgggccggtaccgttagcaactggcaagagtgaaaagctgtcattgactcttttcagttgggtggtaccacgtttaggcgtcccgattagatttaatctagtcggaacgcctttttatttgctcgagggggagaaaattatgaaacgatattatcgtcattatctgcaatccaaatgccgttaaacaaattagcttaaaaacatgaggtgtcgatatatgactaaaaaaattgactttaaagaatctgttgcaatcttgttgattatgttggtcatcttgggcagtggcgtaattggcttcggtctttcgccacaggtaccggttttgaccgtgattgcatttctggtcttctggctggccctgcgtcacgtatcttgggatgacattatgaaaggaattaccaaagggatctccactgccatcattcccatctttatctttattttgattgggactttgattgccgtttggattcaagctgggatcattccttcactgatggtcctgggctttcatttaatcagtgcccgtttcttcgtgccatcggtcttcattgtctgctcgctggtcggactggccattggctcgggtttcaccaccgtctcaaccgtaggaatcgccctgtttgggatgggatcaaccttaggcgttaacccagctttaacggcgggggccattatctccggtgccgtttttggtgataagatgtcgccgctttcggattcgaccaacctggcatcggctgttgctgaagacgatttatttgatcacattaacaatatgatgtggtccaccatcccagccttcatagtttccttaatcgtctttttcttcttgggtcaaagcaataagggaacatcgcttaccagcatcgcttcagtaagttcgactctgactaagcattttgccgtttcctggtgggcggcactgccaattattttaatgtttgtctgtgcctggaaaaaactgccagccatccccaccctgtttttaaatattatcgtttctaccgttatgatttttatcaacaatccgcggttgggaatcgctaaatttgccacgttgattgaaagtggctttgtctccaagactggcaacaaagctgttgatgccctgctgacacgtggcggcatctccagcatgatgggcaccgtttctttgatcatcatgaccctagcgcttggtgggatcttgatgcatatgggaatcattgaaagtgccatgaagcctttagtggctaaattaaacaagccaggtcgtctgattacggcaacgatctttgcaggaatcggcgtcaacctattcgtcggcgagcagtacctttccgttatcctgcctgggaatgccttcaaaccagcctttaagcgcattggtctttccccgttggcgttgagtcgaacgctggaagacggtggtagcgtaatcaactacctgattccttggggcgtggccggttcattcgttgcctctgccctaggtgtcccggtattggaattcttgccatttaccctgtttagtctgttatcgccactcttctcaatcttgagcggtttttcaggtatcggtctcaaatggcagcctggtcacggaccaaaagcataataaatatgaagaaaactgccgagttgataatcagctcagcagttttttattggtttgtcgcgttaacgaaaagacgggctaaaagcagttttatcagctgctacaattggacacgctaattatgaaacacatccaactagtacgctgacattatcccaaaacttgccgaaacccgatcgcacctgctttcatctgattcagttaccggcaatcttaaaccgttgatgtaaattgcaaccattttaatggcatccatatcgtgattgactactcgctgtctctaaaagctaaagcagatcaatatacattaatttttacctactatacagcggttttttgaaaatagtaggcaatgagatttttgtcatatgtattatgcaaaattatttgcataatacatgatgatcaccatttctttcccggtgcgagccgcttgacgccaaacaaaaaccgagatacagtcaggatcatcccttctgtatctcggttttacggtttcgccatttcacacattgatcattggcattttacatttcaaattagctcagtcctgttctgctgactctgagaaagtgatactgaggttaggaagttcgtccgcaaataagactgatccaatcagaatgcaaatatcaccatcaccaatctgctgcccacaatgccaaaccgcttattgatagcagttgaaaaactagattcagcacgacaccgcttgattacagcagttgaatgccagctttttcgcacttttcccgcatgtcttctggccagatgcttgcctgaacctcgccaacgtgtgccttgcccaacagcagcatgcacagccgcgactgaccaatcccgccaccaatcgtgtatggcagttcatggttcaacagcatcttgtgaaatggcagttcggcacgagcttcttcgccggcttccttaagctggtagcgcattgcatcttcatcaacccgaatccccatgctggatacttcaagcttgcagtcaagcggttcataccagaagataatgtcgccgttcaaagaccagtcatcatagtcaggggcgcggccatcatgtggcttgccggaacgacgcagcttgtcaccgatcttcataacaaagacacagccgagttccttggcaatgcgatcttcacgttccattggcgtcagatctggccagcgatcctccaattcctgtgtcgtaacgaagtgaatctcatcgggcagatggtgaacggcttgtgggaacttgtaccagacttcatgttccatgtgcttgataaccttaaagatttttttaaccgtggcctttaaggtttcttcggttcgttcttctttagcgatcaccttttcccagtcccattggtcaacgtaaatggagtggaagttgtccagatcttcatctttgcggatggcgttcatgttggtgtagagaccttcatgcatcccaaaaccgtacttctttaaagcatagcgtttccacttagccagcgagtgcacgacttcaatcgtttcgcctggcagttccttcatcgtgaatgaaactggctgctctaccccgttcaggttatcgttcaaaccagttttcttttcgacaaacattggcgcactcattcgctgcaggttcaattcgcgcccaatctcatcttggaaggtttcacgaatgtagcgaatagcggcttcggtctcacggactgacagctttggatcgtagtgttctggaataatcagactcataataaaaatctccttgaaacttagacttgaggacaaaataaaaagccttttgtccccgtagtttcatgggacgaaaggctttattccgcggtgccacccaagttgtccagagatatccagaccgctttgatcagagcacaaacatgctccatcgactgtaacgtgtcgaaaacgtctgagcctactttggacgaatccatttgggtcagcaacgcggggaagtgtttttcgctgcatcagggtcggccaagttcccattatccttggctcactttgcgaatgaaaacagctactcgtctttctcatggtttttcaaaactgtttgattgttttttattttaatccattcttagttttttgcaagtagttttttaattttttaatggttttgattaaaatcgccaagctgatcagccatacagctacctccaaaacatcatcataatcatcagcacgacggcaatgatcacgaccagattcataaagaagcgcggcaagcctgaatggtgatgacctctttcataagccttcgcctgttcttcttgaatttttttgagccgcttgttggcatgctgctcgacgacattgtcaagtgaatcgtcggacccatggtgattgattctgcgtgttgccatctaaaatcagctccctaatcatttcaattttcaggtgatagtctaaacaaaatatacaacaacctcaccattttcattcaaagccaccgtgcttaacaacagattgcgaattgcttcttgagtaactgcatcaatcatctgtttaaaacgatcatacgctttttcatgataaaccgccattggattgcgctgcagcagcgtccaaggctgaaccagcgtttttagatagccaagataggccacctgatcaacccagcagtcatccattgccttaagcaatgccgaacgataaaattgttcaatctgtttgggatcagcaattgaatcttcaatctgatctaaaatctcattggtccggcgcattagatagcttttgacggctgccagattctgatagtttaaatcagcaggaatctgagcatcatcataagttatccaatgattaaccattgcctttagatgaccataatcccagcttgaacgcttgcttaaaatcacgtcaaaaccgtgttccatccagttaagcgcggtcttgcgatagtcgtcagcgttcatgatggcatcccgcgattcataaaaggccattcgctccaagcgcatactgttctcataactgtacattcgcgcgcgggtctgccgctgactgaccatgaccttatcgcgtaaaagcagcagcgacagtaaaatacgaggattatgcagacggtggggcttagcctggtggttgaaatgtttgatgtgacgacgatagtatttgcgaatcacgggactgctgttttgcgaaacaaaattgtcttccagcgaaatgaaaaaccagctgtcgccaggatctccttggcggccggctcgcccctgcagctgctcagcaacgcgcggatcaagcatttcagtaccaattacggccaggccgcccaatttagcaacgcctgggccaagcttaatgtcggtaccgcgtcccgccatgttggttgacacggttacggcatttttttgtccagcatttttaataatcgcggcttcattggcttcgttacgggcattcagcaggttatgcggaatcccacggttgagcagaatctcagaaacgatttccgagttttcaaccgaaccggcaatcagcaaaatcggccgacctttttgatgcagcttttcggccagcttgatcgcttcaatcagtttttcactggtcgtaagatagacgcgcggctgatggtctttgcgaatatttttgcggtgtcgcggaatctggacgactttcatcttatagacgtcaataaattcatcggcagcaatgcgcgcggtccctgtcattccagcaacgttgttaaacagccgaaacaggccttgataggtaatggaagcaacggcttgccgattatcagaaatcttgacgccctctttttgttcaacggcttgctgaatcccagtattgaccttcattccgcgcatcaagcggccattggcttcgtccagcaagaccacctcgccatcctcaaccagatagtcgtgcccacgctgctgaacaaaatgcgcctgcagagccaagctgatatgccgatacaattcacgatgctgctcattgaacagatcgtcaattctgaaccattgctgtgcctttaaaacaccttgatgcgtcagccaggctgatttatggttccggctgcggcgataatcggttcctgactccaagctgcgcacgaactcgtcagtcaagcgataaagatttgactgcagttccgtcttgctggcaaccaccattggcgaattagccccatctaaaaacaccgcgtcggcctcatcaacgattgcgtagttgtaaggtcgcagatattgatcttcaggccgtgaagccagattattgaacagatagtcaaaggccagcgtactgccagtcgtgtacaaaatatcggcttgataccattttcgcttgtcggcaacggtggcctgattgcccgactcatcatcgggatcaaaacccaggctgcaggtcaatcccagccattcatacaggacgctcaattcttcttggtcacgctgagccagatagcgactgggcgtcaccaaaattgctcctttaccagtcaaaccgtttaaataaagaggcagcaccgcggtcagcgtcttgccttccccggtcttcatctcggcaatccagccatgatgaagaacgatggccccgatcacctgtacgtcataaggatacatccccaagacgcgcctggctgcctcacgcgccgttgcaaacgccattggcagcagactgtttaaggatttgcctcccttaagcattttacgcatgcgcggggtctgcgcctgcagttcttgatcgctcatttcccgcatcattggcgccaaggcattcactttggtcaagatatgcctggcgcgctgcagttcaaatgaaaatgccgtcgttctcacctctttaattcatctttaatctgatccagcgtctcttgaattggtactaattccaagtgcttaaagaaatggccctcactgccggtcatttcataattgctcagtcgatagtcagtcagcacgacattcgcgtcaatcagccagcctcgccaataaggactttccttaaccaatttgcgtacgactggatttaagcggtgagccgtactgataaagtttatgcgacgttcttttagattttcaaaataagtcagcagctcactggcaacctgatcaatctcctgccaggcaaccatcatcagcgaaaggttcggtacgtcatgactcttatcgatctcttcacttggaatcattgccgttctaagcgagcgcagcagcataatgttgactggctgttcggcatcgatttttttaggcgtataaaacatcagattgccggtctgttcagtaaaggcaggcgtcagttccagccgccaaaaggtaattgaacgacagccgccattaatcagctgcacctcatagcgggtcgccgcgtacggataggtaaagttgagctggtagccatgcgtgattttctggtcgatgatctcgccttgaatgtcataaaaaatgattcgcagcattaccgaatcagccggtttggcaatgtacttggccttgatgcgatactcaaccccgccacgcagaatcggcagctggggcacaaaacggctggcttgatagttaaccgctgaataccaagtaatcattgctcgtcctggtgccatccactcgttttcaaaatggatcacttgattgtcgtaggcatcgatccgtgagccataacgataggtggtgtcattttgtggcagccaatagatatagttgataattcgcatcggctcacctcccaaaatcatgctgcagaatctgacgatagcgcatcaaaaaccattgcagcattcccgcgctgtcatcattgtgacgtccaggcagactatagctgttcaagcgattggcccgagtcagcaaatggcggcttagatcagcaaaagccgtgggatcataatcatcgttttccatataggcaatgctgaaattggttttggccaggtcctgctgatccatcagccgcaaaagcatctcatcatcaacaacttgaccatctgcctcaatggcacgcttaatatcaaatgccgtctcaaattcatcgggacgggccagacgactgcgtgtagcaattgaatccagatgcaccaatggcttagccgcaattacctcatgcacgcccatcaaagcgccaaacttaagcgcaccatacgttcccattgagattcccgatagaatcagctgctgacgcgtaaagcccagtttctgcagatactgatcgattactttagggatggcctgattaaaatactcgcctgtataaaactggccaccttccagccgggaatcggtaatcagcagatatggcgcatttaagcgacgcatcatgaaatatccttcgaagctttttttggagtgatagccagcaaagtatacgcatagcggcggtttaagatcgccaggattaaagtagtaggccagttcttctctcgtcttgggatcgactaagctctgccccccattcagataggtccccaagccatagcgtgtccaccgatactctacgttgcccagacttaattgaccatagccacggacatagacggccatcgtgatgtattgatgaccattggaaatcttggtgttaacgatctgcggacttttgagctgctcttcggtaaattcaaaaacgcgccgctcctcaccataaacaacggcaaatcgatatttcagctccacatcggcatctttttgaaactggggccaaacctccaattgacgacccggatcaacgtagatattcttacgtgaactggccagtggctgccaatcaggcgtatgaacctgaacctccacgcaagatgaatcctcataatggatcacatcgcaaaacttactctcaaacatcaatgccgctggtgtcagaccgatcccctgctgaccaacaaaatagtaatgctcaatattgttgataaactcttgaatcggtatagtcagctgccgcgccgccattttttgcagaaaggacgctagatgatcgtcttcaatcgccaaatccgcagtctggatgacgttatatggatcagtacgctgctgtaaaagttgccagtcggtcggtgccaaggtgacagattctgaaatgactatcagctgcagccgggctttaggatcttttaaacaacttagatcgttaaaatgccagtttaaagcagctggaatctgataggccgtctgccaattattttttccaagctgtaaaacgttaagcttcaaaacgcacacacctcttccaaagcaattgccaattatgcaaaatccgtttccctgaatagttgttgatctgctgaaccgcatcaacccgcgctcgattccagttctccatgctgcccaaataaaactgcagagctacggttagatcagcaacgttggcaagcagcaagccattttcatgatctcttaccaagtcggttttgatcagatttatctgcggcagaccaacgctgattgaagccatctgaacgtatgaatccgggttgttgcccagatccacgactactcgaacttggtccagcagctgcaacaagtcggtcgtctgcacgattcttttggtgtagatcgggatcggctgccaacgctgctgtttttccatccgagggtcaatatctttatcaaccaaatccggattagacatcatctgctcttcttctggatcgatcaaaagccggggatggtcttgagcaatttcttgagcgatttggcgagcctgattcaacagccgcccatcgcaggccgcaatctgcagccgctcgctgttttgattttgatcaaccatttccataagctgagctaagccttttctcaaattcaacatcgtcgtctgctcactgacaaacagcagaattgtctgggtagtatattcgtcgctatggccaagactaaactgtgacgcaaacgttggtagtagattggtctcaatttgatcgcccatgattttatgtacatggcgatccgcagcctctgaatccgtgacgatcgttaaatcagtccgtccattcatcggctcccaaaagcgatcattagcatgccattgactcgcctgaataattgttttaaaaccattaaactgttttaagtcaattatctgctggtcatcagccgttaagacgatctggtcgctgtctttatcaagtcgtttttgaatcaaaccggcaattgcttcattaatcaaatcatgacggctggcataatctgactgggtaaaatcgccttgatactgtgaattgatatggcagcgaccggttttggcatcctcaattacgcgccaatcaccatgcagattaaagaagatcgttttttgcagttggttctgcttatcaaacgtttggatgcttgagacaaagccacgcgtatccataatgatatcttcttgatgatagccgttttgccaccgctcaatccgcaaaatctgaccaatattattgaataaaaggcgtgcgatatgttcatcattgcaaatggcgtctacactgaacggtccatactcaaaataggttcccttaggccagttgaagtcctggatatccacgattcggctgttgtcttgcaaagcagtatcctgaatccaatcaaaggccgccagcgtatcagtcggtgcaaccccttctgcattcagctgggtaatcaattgtggcttatagtccccaatgatcaagccataattttcatcagcgtgattcatgattcgcatattgccaattgcatcatcaaaggtaatattttgctgagtggaggcccagtcgccaataccaagatgccaagacggaacaaaatacttcatatgctttttaataccccttctttaagcttctgatagcgtttaggaatcatcagctcattaatcatttcaaccaaggattccataaacagtaccatcattacgattgaaatcggcagtgcgtatagcggctgccagatcttaggggctaatagactacccgcgatctgcaggccaaccaacaatcccaaaaccaaagcactgaaaaggttaaacagaaccagtcgtcttctgatgaaacgccgcgttggcttgccaatttctacaccaagcaggtaattaccgctatgccgcatacccttagcgatttgacgtggactaagcatgacaaacgcaaagaaatagtcgattaaaaacgtcattacaatcgcaaagccaatctgaaatttaggactgctccaaaaggccggcattttaaacaacgatgccactagtgaaggaataaccagaaaagacatccccagcataaaagtcatcatcgttcctaaattaaagccaatcggaaacacagtcggctcaatctgacttggtaatgagatttggatctgtttggtttcatagtgagccgcatggaaaatgatcgtcagccaggcaatcaacaggctgccaatgatcagcgctgccaacagccagatgccatttttcattttcaacagctgacgacaaggcagaaccaagcgattcatattggaatgcagcatattgccgacgatcagaaccaccatgccgccaatgccgtaaatcgtagtcacgttgcctagccattgaacgaacatcgcgccggccgtcaaggttacgataatcatcaaaaccttcaataaatggtcgctgccggctgccagactaaaaccattggcaataatggctgcttcaatcaaggcaaaaagcagcgacaaaaagttttgcagatacatcaattgacgctgtgatatttcctcaacgatcgaccatttcatcattaccagcagctgaataatcatcatcgcggccatataaggactaaatcctagcgaaaacagcgataaatccggcagattagcgccggtcaagatactaagcatactcatatggtaatgacgaatcatagtttgatattcaactgtcatcttaaccaatggaatcggtatctgattgcccaatgaatagacaacaattgccatcaccgtaaaaagcgctttttttaggaatccttttgtcgcaacatttaatttttttctttgcaaatctctttcctgcactttctagccaaattattgacgtttaccaaaacctagcatcgtctttaaagtgtttaaaagtccagaattacgctgctgagtttgacttgatgctgcactgacggaaagcgagttcgttgtatcggaaagctgctgagcctgcgtatcactcatcgaatcggcaactgccagtgtctccacggtgctctgctgagtcgtgccattaactgagttgctgcctgcgtccaggttgctcttagatgctgaaagcagactgttaagcgaagtcgaattgctgattgcatttgatgagctgtttgaacgcgaggcaaacatgctttcataaagcgtctggctttcagtagccgaaacctccaagctcattgaatttgaagcactcaacgattcaaaattgctcttggatgccgaaagctggctgttgagagaagttgaattgctgattacattggaggagctgtttgaacgtgaggcaagcagactctcatagactgcctgactccgcgaagccgactgcatcatgcttagcgaagctgccgttgacgcgctttgtgaattctgaattgagctggacgtattgttggtgttggctgaagtcgatgaagttgccgtcgatacagcagccaaccgtgtcataactcgattctgggccgtggtgctggtcgttgctgcagcagcactggcagaagcgctagcagacgttgactggcttgctgagttggcagccgtcacggttgatgtcgaggcactgatggaattagcaatactcgttgaagctgaggtgctaattgagcctgaaaccactgctgatgtggatgcagacgtactcgttgattccacaattgacgtcgaggcagagtttgacctgctgattgaagcagattcttcactttcactcaacgatgtgctggttgatccagatgcactggctgatgtcgagctactcgttgaagcagactcagaagctgaggtactggtcgaaacagactcctcgctttcactcagcgacgtgctggtcgaagtagactcctcactttcactcaacgacgtgctggttgatccagacgcactgattgatgtcgagctactcgttgaagcagcttcagattcacttattgagttggccgccgacgttgaagtcgaggctgattcggaagctgaggtgctggttgagcctgaaaccactgctgatgtggatgcggacgtactcgttgattccacaattgacgtcgaggcagagtttgagctgctgattgaagcagattcctcactttcactcaacgacatgctggtcgaagtagactcttcactttcactcagcgacgtgctggttgatccagatgcactgattgatgtcgaactactcgttgaagcagcttcagattcacttgttgagttggccgccgacgttgaagtcgaggctgattcggaagctgaagtgctggttgagcctgaaaccactgctgatgtggatgcggacgtactcgttgattccataatcgacgtcgaggcagagtttgagctgctgattgaagtagattcttcactttcactcaacgacgtgctggttgatccagacgcactgattgatgtcgaactgctctttgaagccacttcggattcacttgttgagttggccgccgacgttgaagtcgaggctgactcagaagctgaggtactgattgaagcagagtcttcactttcactcaacgatgcactggctgatgtcgagttactcgttgaagcagactcagattcacttgttgagttggccgccgacattgaagtcgatgccgactcagaagctgaagtgctggttgagcctgaaaccactgctgatgtggatgcggacgtacttgttgattccacaattgacgtcgaggcagagtttgagctgctgattgaagcagattcttcactttcactcagcgacgtgctggttgacttagaagcttcaactgaagtcgatgttgactcagaggccttgattgaagcacttgtggattcagaagcagttttgctttccgctatggatttgctggttgcttctgatgctgatttactttcactcagcgacgtgctggttgacttagaggcttcaactgaagtcgatgttgactcagaggccttgattgaagtactcgtggattcggaagctacctcgctttccgctatggatttactggttacttctgatgccgactcactctcactcagcgacgtgctggttgacttagaagcttcaatagatgttgactcagaggccttgattgaagtactcatggattcagaagcggctttgctttccgctatggatttgctggttacttctgatgccgactcactctcgctcagcgatgtgctggtcgacttagaggcttcaatagatgttgactcagaagccttgattgaagtactcgtagattcagaagcagctttgctttccgctatggatttgctggttacttctgatgccgactcactctcgctcagcgatgtgctggtcgacttagaggcttcaatagatgttgactcagaggccttgattgaagcactcgtagattcagaagcagctttgctttccgctatggatttactggttactcctgatgccgactcactctcactcagtgacgtgctggttgacttggaggcttcaactgaagtcgatgttgactcggaggccttaattgaagtactcgtagattcagaagcggctttgctttccgctatggatttgctggttgcttctgataccgacccactctcactcaatgaaccgctttccaatgcagacgtcgattcggattcactggccgattccacttctgatgtgcttttagaactactagtcgatgcagaagatgcactttcggattcaatcgttgaggctgacgtgctgattgagttatatgtagaagttgatttactcttactttcgctgttgctttgtgcccgttcttctttagttgaaatcaactgaccgttcaaatcccagcgtctatatgtacccttggtttcaatcgtgtcagcagcaatgttcccggcaaaatctgcatcagtaatgacatgagcattgggcgctaagacgctaccagcaaatggactttgaaattcaattgtgctgctggtcgtgccaaagttccacagcaggtgattaggttctcctcgccagacattgctactgttataccagtttccaccatacttacttttccaatcttcgtactgtaattgcaggtgacgattgatctgaatcgtttgaccttctggaatatccgtcacgttgattaccaccaccgggccaaaattagactcagtcaggccgacaattctagtgttgcgtgctcccgttaggtattcatatggaacattaacataaattcgattatcatctggacttgctccggagacatcaattttgtaatcagtattagaaggattactgtcgatccgtgagtgttcatatccttgccaaacgccctctgtatcagaatcatgctgactcaagcgctgtgcgttgccgctaagaatgttaaaaatctgttcaaaatcaatgtagttgctgcctgctttatcttgagtaatgtctgcattatcgcctggcgagacatgatccatccgattgttattcacatatagcttgccatctttttgccctattccgacattgacgtcttttccaaaaacaatgtgattataatcagctaaaaatgcattgctgccaagccagccgctgattttctgaatatagtcaacgtcgatgttggtcagattgccattaatatcatcttgggtaccaaactgctggccaccttgataatcaccagttgccagattaccgcgataatcagcgtcaatttttaaatgctttgaaaaagtcccaaaaatcgatgccagatcaagcgtgccgttgccatgataattttgaatgtagttataaaaattaccccaattcttgttaacaatactgtctaggatttcgccccaggtgtcgttaaatatgtgattccagtcaaaagtgtatgtattcttattattaagatactcatcttctaaaatagtattaggatgagtaacttgattagactgtcgtgcccatagctgacttaaaacagcttggagataattggccgcaactgcttgaggatcaatacttgccgcagttaaggtattagcagactgactggctgctggctgactataatcaggtgttttctctgcctgtgagttctcacttgctgaattgttgacatcacttgttattgagctgctattggcagttttactgtcggctgataaactatccgccgtggtttgattactttcagatgaagtgtttgaatcacctgctgaatttagactgtcttcgctactggtcgaattggttgttgaattttcagccgtagtcgtatttgacccgctttcagccgcctcagatttgctcgtactggtttctgtggtcgtactgttggttgagtcaagactatttgagctatcagtcgaaccgctaaccgactcgctttgagtatttgaggaaagaccaattgccattgagctgcgcgaatccaacgtccgctgtaattgtgtactgtccgccattgccgtcgttggcagcagcatggttgccccagcgatcgtcccaattgtagcaattacttttaagtagtcttcatatgaagtttcatcatcttcatctaccgaagccgctttcaaaaaggtccaaaaacgtgacaacgaactgcaccagccccgatgcgtcttataaagttttacgcgttcagtttcatcaacttttgaatttttccggacatttttagatttcacgttaatcttcctttatgtataaaaaattttactgccaaagatctattatcttagccaatgaatgcttattaattttgaaaacaagcgtgatcgctaaatcataatttataaattgacatttattcatagcaatcaagaagaaaggttttaaatgttattataaatcctttatatcgtaaatatgtaaataattaaactttttaagaaacgttaagtatatatgtttatagtttatgttatctaatgaaaaattaccagaaataaattagaacccttcttagttttagcgaaaccaaacaaaaatcacgagcgtcatttgcataatcaccaaaaaaatccatttaatgatctatcacttgaatacatgaagaaaattgcattgataatcgtttatctaaatttttcgatcatgattgaagtatgaatgatttttgcttattttgggaatttttagctttttcctatgcttagccgacaaacatatttataatcacatttaagacttcaatgaatcttttcaaagggatattcattttacgaaggggctttttatgaagatcaaatcaaaaaaatgggctggaattgtaattggcatcgcggcactgtgttttgcattggcaatcggtctgggaatctacctgcactcaaccagtcaatctaccaagacacagcgcgaaactcattcatctaaaatcacagttaatcaattcatcaaaacgattgcgccaattgcccaaaaagaacaaaaaaagtaccacattccagccagcatcatcattgctcaggctggtaccgaatcaaactggggtcgcagcaagctggcttataaatacaacaatctttttggcatcaaagcaacctctaaaaagaatcgcgttcgcatgtataccaaggaaaacatcaatggtaagacggtcgaagtcaaacagtattttactgtatacaatagctgggaggcttcactaaaggcccgcgccgagctgcttgcccatggtaccgaagctaagccaaacgtatttaaagacgtgctaaaagccaagaactaccaagaagctgcccaggcgctgcaaaaggacggctatgcaacagaccctaattacgccaatgaactgatctacgcgattaaaaaattcaagctttataaatatgatcaataataattccgcatctttcaaaaatggcatgtgggattacaatctggtattggcaaacgtcgataccagatttttatttactaagaaaggcgcttagtcagatcatctcgaccactcgaactttaccatttcaaatatatttagccttctctgattgcggtgctttgtgaagaaaaattggctttaatcggctatcggtctttgattttcctactattgcttagtgttcacccttaagtaggtagttgtatattcagccagtctacctttacctactttgggctgcgtttttccaaatagtaggtaaaaatgtatatttctggactgattgggtcagaccgactttgtgaattacctacgattcggcaattttctgctaatagtaggtaatgttagggattcctaactcgatatacactgagttttacctactatgcagtcgattttcgaaaaaagtaggtaatggtattttgtcggctatcattatgcaggaatttttgcataatcgctgctgatgaggttgcttatgacgctaattatctctagattatcgcgagaacgtttggagccgtgagtaaatattgcttgtggatgaagcacttcaatcgtcagccgcattaatgaaagttttcaactgctatcaactggcagccgtagatttctacccaggccctatcatcacgttcaggtttcaaattgccttgatcattattggtagttaagatcttttaccgccatgatcagcagcatcgaatcattatcgacactaccaagccaataataaaagccccgcaaccacttcggctgtgaggctttactttacagattcaattcaaatgcccagcgcagtggatcattgggctcatctaaaatattgatgtgaccgcgtctgataaagccattgctagttgcgacgtgctgcattggctggttcaaatcatgcgtatcaacgcggaagttatggattccctgctcatttaagattgaaatcaaactgctcataaaatatttggctaaatgttgtccacgataatcctggcttaatgctaaacgatggatggctgcgtatggctcggtattattttgccaggcaccatcaatctcttgatagtttggatcatcaccaatgattgccgccgcataacccgcaacctgatcattgactttcagcacccaagctgaatgattggctaagtcttgagcaacggtatcagtatttggatatcccgcttgccactgcggactaccggaagcctttaaaaatgccttggcttgttcaaaaattgccccgattgctggaatatcagcctgcatggcgcgagtaacataaataagactcataattttccccctttcaaatgcatttgaacttttagataagcttaacacgaataattgtattaaagacggccattttctttcaacctttcatgatccattgcctcagccgacttgagcagagcaaagcgtcgccgtaaagtcgaaatactgattccagtgcgcattgaaagttcacggtaggtcagtcctttgtgatagagctgatatgcctgccgaattttttcgtccgagtagatttttggtcggccttcatgatatttcggattatgacgacgagcatatgacttgccttcttgcgttctgataacgatcatgtcgcgctcaaattgggcaaatgccgaaaacacggtaaaaatcaagcgaccaactggcgtatcgtcaatcgtgcccatattcaaaatattgatcttcacctgattttcaaacaattgctgaatcacctgcagagcttcacccgtattacgcgcaaatcgatccagcttagtgacgataattacatcgtttggctgaacgattgctaacaagcgagcaaattctggtcgtttggtagtcgttccggtatatttttcctggaatatttcgtcaaccccaacctgtttcaacagttgcaactgtgtcgataaactctgactttccgtgcttactcgcgcatatccgtacttcatgttctaaacaccacaccaagacaatttaagtttcaaaagcatgtgtgtggactctcctttctttaatcagttattaccctttttggtacattgccttttcaaaacttttgattgcaacaaaaccgttctattgtagcaaatgatttctttttataaacactttttccataaaatgaacggttatttttaatgaatgatcattttagaatgatattacattacatagatacatttataaatcattagtatatttttaatcataaagacaaaaaggcccaacctttgaaaaatcaaaggatgagtcttttctatctttgatgaatctgttcttatttcttcatctagttttcgtgacgcttcttcttagaaccgaagcccaggccaagacctgccgcaaacattgctcctgccaagcccagtgcgcccttttcattgttggcgttaccagtctgtggcaattgttgagcaccagcattgttttgggtttgacctgactggccgttttgagcggcttgaccagtcgttgaaccgccattcgttgcttgaccaccattggaagcattgccgccttggtcagctgccttgccggaatcaagcttcttgtaggtgatattgatcgtcatgtcttggtcatttggcgtaaccgtaatttctggaacagatgcggatggcacgtatccatgaatgtttggtacgtcaacgctttccaaaacgacattcttcgaccatggtccataagttacttcaccggtaacctcatcaaccgttgcactccgcgtaaattcagccttctgcgtgatcgtctgcgtcttgccatctggcgtcgtaatgttgatcgtccgcgtaaccgtcttgttcagatcatccttggcaacgccgcttgggtaattcttaccagggttgtctggcaatacatcagctggcgtctttggattgtctggcgtaacggttgttgtagcgtgcgtgaagtagtacttgaagtattggtgaacttcagaattcttgtcgtaggccgtaccagcgacaaagacattgttgttggcattgtccttgtcaaagacgtagcccttagcttccagttccttaacaacttcatttggatccttggcaaagctgatcgtttcatcagtcttgccagttgcaatttcacgcgtgttggcaatttccttacccgtcgtctcatcatagaagatggcttgggcttcttgggcatttccaacataaaccaccgtcttgacaacgttttctgaatctggcgtaaccgtgatttcatcaatctgcgaatagtttggcgtgtagccttcaaccgctggactagttacagctgcaaacgtcttgctgtcagcctgcttgccgtcaatcgtccatggatcgtaggaaacaaccttgccggtaacgttatcggtcgtgtagccacgcttgaatgttactgctgccgtgtaatctggcttagcggtttgattgttttcgtaaacgtagtgaattgtttccgtaacaatcttttgttcagcattcttgtcggttgcatcggtgtgcgtcgtgccatgcttgaagtgaacttcataagttggcgtgccgacaccaaacttagtacctggcttgaagccatccgataccagaacgtagccatcgccttcgaacttcttgatgccttcagccgtgctgtaaggaatcgtttcattcgtgtagccgtgcagatcatcttgacgcagcgtctcgccggtcgtgtcatcaatgtacttgacataagccgtttgcgcgtccgccgtgtagaggacagtaagcgttgggccttgttcggcatcactgttggaactgcgctttactacggcttcgcttggcgtgtaaccggcaatcgttggtgaagtcaaggccttgtagctttggctagcttcgttccacttgccccaggctacgatgcccgtgacgtcgtccaagacaccattccgcgtaaacgttacctgagccgtctgatcttcagccgccttggtgccatctgcgtacttgtagtgaaccgtttccgtcagcgtcttcgtacccttcgtgccgtcagctgaggagtggttcggatcaacgttttcacgatggtgcttgaagattaccgtgtaggtttgatcgttggcgtcatcgttgtcaaacttttcaccagctgggaagttgtccttaaacagttcatagccatcgccctcaaacttcttgatgccttcagccgtgctgtatgggatcgtttcgtccgtgtagccgtccaaattatcctgacgcaacagcttgtcggtttcaccatcaatgtattgaacgtgaaccttttgggcgtccgccgtgtagatgaccgtaaccgttggtccctgttcggcatcgctgttggaactgcgctttactaccgtttcgcttggcgtgtagccggcaatcgttggcgaagtcaaggccttgtagctttggctggcttcgttccacttgccccaggctacgatgccagtaacatcgtccaggacaccattccgcgtaaacgttacttgagccgtctgatcttcagcggccttagcgccattagcatacttgtagcgaaccgtttccgtcagcgtcttcgtacccttcgtgccatcagctgaggagtggttgggatcaacgttttcacgatgatgcttgaagattaccgtgtaggtttggtcagtcttgtcatcgttatcgaacttagtgcctggcttgaagtcattagatacaagttcataacccttgccaacaaattctttaatcttgtcagcagtgctgtaattgatcgtttcattagtgtgaccatcaactatgtcgtcagtcttctgcaaattttcactagtctcgccatcaatgtacttgattacagcacgttgagcatcagcctggtacgtaacgttaaccgtttcattaaccggcttgtcgtctttaaatgatggcgtcttttgagcaaccttagtgcctgctacaccgttaatcagcgtcgtgtagcctttttgaggtgttggcgtatattcttcccaagctgaggcaccatctgcttgccattgaccgtaagtaatatgcccgttaaccaggtctttcgtggcagtccgcttgtagttaactgtttgcgtttcagaactagtcttgccatctggcgttgtaacgttgatggtccgggttgccgtcgtcttagcctctttatcagtatcagaaacatcctgggtgccatgcttaaagtagtagttgaagtactgatgaaccgtcgaatcattgtcataagtcgtcccagtggtaaagacattattcttagcattgtccttatcaaagacataacccttagcttccagttccttgacaacttcatttggatccttggtaaagctgatcgtttcgccagtcttgccattttggatttcatgtgtaccatcaatttgttggccggccgtttcatcatagaagtttacttgggcctgctgccaatctgcttcgtatacaacagtaatgtcttgactcaagtcgctgacgtaatctgcagggttaaacgtgtagttcgtaaccgtcttgccattgatcgttggcgtaaagccgggcacttttggaattgtgacgttgcccgccttggttgagtcgttttcatcgtttggatactgcgtggtcgtcttgtcctcagctggaaaggccttggaatcagaatcaataatcagattgccaagtttttcataaacatactgaatgtttatcgtctgcggaatgtagatgctgtgaatagtaactgatttatataaatcatagtgaactttctgtgattgacctggagcaagatcaaactcttttactgttcgccaacccaaaaaataatggtatttcacaacaacatgcatcaagccggtagtggtatcagtttcggtaaaggtagctttaagcccatcatgccaatctttagtgtaggctgcaccctgcttgccaaatggcgacatgaagccattagcatttgatggttctttggcaaaatagccattgattaccttaccgccctgtgttgtatagatttgaccatccaaccctttttgaacgactgggtcgctgaccgtgttgcccttgccatcaacataagtcgttgtctgtgtttcgacttgcggaatcatgaaactaatgctgccatagtctccattatcctcacccgccttagggtcaaagacgttgaactttgacttccaggaaccatcagcggaaacgaagacacctgactgaccatcattgtaaactgtgccaaagtctccctcgtcatcagtagctacttctgttgatttatttttatcaaccgtgtactgacctaaaacattgttattacggcccagcaagaagacgtaaaccttgccatcaccatttcgatcggttgaaagaaccaggttatacttgccgtctgagctttgtgcccaccagtaggtatagtgactggcatctgtgtcctgatacatcccggctggataagttggatcagtaaccgtaaatccggctggggcctgttgattggcagcttgttgaacggcttgagcactcaaaatattggtggcttggctttcattggcattagcggctgacgttggcaactgtgccgtttgcttgtcagcagcgctttgactgttggcttcactagctgcctgtgagtctttgcttacagtagctgcggcatcgctggcaactgagctggatgccggctgactgctgatttcactggcattggcagctgaagcttggctgtctgaagcagaacttgcagaagctggtgaatcagaaactgccgcgctcgaagctgactcggcacttaccggcgtagcactgcttgtggacacggctgcactgctattagatgctgaagttgagtcgctggcggttgaattggcgtcctgttgtacaacttgttcagtcttagctgatgcatctgattcagcagttgcagcttgtgccgttgtaccactgcctaaataaaaaccagccgcaacagctactgaaacgactccaacgctcagtttacgcagtgcgaaccgttgaaaatgctcattagatttactttcccttacataattattatttttcccaaccatattgctaaaacactcccttaaattttgcattatggaaaatttcgacattatttcgtcgtataaaaatcggtactcactgctgcaatcggttcccagccaaccacagcaaattttccctgcataactccccccttgctttcctgaagactttgccgctttcaagtcgtcttttggctttaaattcttttatgaaaatttcttaaatagttaggctgcatttttaaacgcttacactatttgcaaaattaaaaagaaccaaaacttaggagttacgaacccccatttctaggcatgtatgcacataaggctaaaattgaatgaaatctttggcaaattgatatcaacaaatctcaaacctacgtacgatactgcttttatatatttaactttaatgtttgttgaacaataagtcaatgatttccttaacatatatgccaatcccttaaaaaaaattttgcattctttaataactcataactcctaagttatgagtcaccccacctcaacgcatcaacgcagttcaagccgctaaatccccatttttgtggtgacatagcaaagatgctgttgcccgacataaattaccaagtttgacttttgtcatttactcgttcgcggcgacgagacttggttcccttgaaatcccaggtgaaacgagacattcttgccccgtctcaccttttttgtttttcgtaaatttccaaatcaagtaaaaggttaaactatatgcatttaaaatttgtaaaaaagcatttcgttatgaacaccagattgtgcatatagtaattaatctgtttcattgaaaacgaaaacatgccgaatagcagctgctactcaacatgcaaacgctttaaattcagaaaaaacaaaacggagcattccagttttctggatgctccgttttttaatggttaattatgacgacgtttcttcagaccaaacattgccattattgtacttaaactagttaagcccagtcccacggctgcttttgcttgattgttatcattaccagtttgcggcaatgttgtctctttttcgaaaacagcagctgctgaccgttcagctgtcactgaattacttactgttgcccgttgcgttgaattgcctggtacaggagaaatcgactgctctcgaggtgttgacgttgccaaatgttttgaatcgtttggcacaatcgaatcattcgtttgatcaggcgtcgtcggtattgttggttgctttgaattataaggatgatttggcgttctcggctgttctaaattgtttggtacagctgggttcttaagttgctccggaataactggcataaccggtttttgaggtttttcaacatatattaccggtgtgtctttacccggattggttggcacaactgaatcgcctggccgcttatcttttggctgccagctatcaatgctaggcacggttggattcaaaacctttgttggatcacctggatcagtcgtgtacgtcggcgtgtcggcacctggaattggctgattgtttttgttaactggaaccagcttgccaacctttttataaataaaatgtagccgtttggtcgccattaccaaacttgccgctggtgttgtcttgttttactaaaacatagccggggattaccttggcatccttggttcatcgccatttttgtaggagctgcccttaggtacggcgacagttcatagccatcttcgtctacaaatttctccgtcagacggtaccgattctgggtgtacacaactttatactcacggttgagtgaagaatcattaggtaataccgtttctccgtcaacgctgggcttatctgtcgtgtaaccctcgacaaaataatttaaccattcactcgatagtcagtctcgtgttataaaagcctgagccgtttctttgctgcgactcaggctttttaataaaatctgatttgctagtcgaatctttgacccataatcactaaatcgcgttttttccatcaagttccgcaacggttggcaaaaagccccactgttcaaagccgaactttttgaatagacccagacttggctgattatgctcaaaaatataagcagccagcgcggtgacgtttaaactgggcagctgagcaatcacaaactggatggcctgtgaaccaaggccctgatgccgtgcgttttgatcaatatagatactgacctcagccgtgtgttcataggctggccgcccataaaacggctccagtcctacccatccccaaatctcatcggcatcgtttctgataacccataacggatgagttggcgtaaaactgtgaaaccaagcctcgcgatcggaagtcatcaatggttctaaatctgccgtggccaatcgtgaaggaataatttgattatagatttcgacaatccggcgcagatcctcatgcctggccttttcaaaacgaatactcaatttgctgctcacctcattattgtttttgccaaattatagaaaagctttctttttttagcaaattcgtctcagatcagccactggaaaggttttcaaattaaagttcggttagaagtggcgttttggcgttgttttttcaagtttagcatgttaatgtagcaatacaccgaattttaacaatcttaaatttattattgttcgtgtttaattatataagggagagagaatacaatgactaagacaaggaatcgttacggcgtcgccttcgcgggtatcgttttgcacttaatgatcggtggcgtttatgcttggagcgtttttaccaagccaatcgcgcagcaggcgggctggcgggaagcctcagtctcatttgcatttagcctggccatcttttgtttgggtatgtcagctgcctttatgggtcggctggtcgaaaagtttggcccaaccgttactggtaccgtctccgcaatcttttacggctccggcatcatgctgactggggttgccatccacacgcaccaactttggctgctgtatctggcatatggcgtcatcggcggactgggcttgggatctggctacgtaacgccggtctctacgattatccgctggttccctgacaagcgcggtttggcaactggtctggcgatcatgggctttggttttgctgcactgttgacgggtccaattgctcagcagctgatgtctaacgttggtctttctgcaactttctatatcttaggcgccttctacctggttgtaatgctgattgccgctcaattcatcaaaaagccgcggccaaatgaactgccagccgctatcgcccaaaaagcatcccgcgtcagcctgatgaacggccaacagctgacggccaatgaagccgttaaaacccgaacttttgctttcctgtggctgatgttcttcatcaacattacgacggggatcggtctggtctcggctgcttcgccaatggcccaagaaatgacgaaaatgagcgcggctacggcagccgtaatggttggtatcttaggtctgttcaacggtttcggccgccttatctgggctacgctttctgactggattggccgtccactgacctacagcctgatttttatcgttgacattattatgctgatcatcctgattttctgccaggtacccgcaatcttcgccattgctctttgcctgctgctttcttgctacggtgccggcttctcggtcatcccagcctacctgggcgatgtttttggcactaaggaactgggtgcgatccatggctacgtgctgacggcttgggcagttgccggtatggtcggtcccgtcctcctttccgttacgcaccaagttctgcacaactactatgtcacgctgctggcctttatcgtgattgacgtgattgccatgctggtatcactttggattcaacgtgattttgtctcacctaaagaaacggcatccgctaaataatctatttttattaaaaacgataaaataattttttaatctgctcatacaacagctatatcctaatcatcataaggtttatcaagctgtcaccatgcacaattctttgaaaattctaattttattgttgacagttgtcactaataaccggtatgctatttgcaacgaatttcgaaaggaggatttcaacgccatgattaagtttgactcaatgatgtgttgtcaatgcatgtgctgtactgtaatgtactgcgcactatttggcataccatcactgaatcaatctggacttagctaatcgggcgttgattcccaacaaaaatgcttgccatatccaggtcggcaactaggccgtgattcctttgatggagtcacggcctttttttgttggttttgcagctattattcaattttaaaggggttttataaatgaaatttacgaagatcaaactgctgattgccgcacttgccttagggggaaccgttgcggctgctcccgttgctcatgccgagactttgacggttggtactacggcacagacctatccgacttcctacaaaaaaggcgacaaggtgaccgggttcgacgttgccgttactaaagccgttgccaaagagatgggcgacaaggtgaagttcaaggttgttggcgacattccgagtctgtttggtgagctggacaaaggcagcattgatacgattgccaactcggtaacggtcctgcctgaacgtgaaaagaaatacagcttctcaccagtctactcctactaccctgcccaaatcgcggttaaaaaagattccaagtacaaaacgatcaaggacctggaaggcaagacggtttctgcaacggttggctcttctaacattgacttgctgcaaaagtatgattccaagatcaagatcaaaaaatacgatgatcgcaatgccgtcttcaccgatgccaacaatggtacggttgctggggtcttaaaccagcggcagttcctggaagaaaccatcaagaagcaaaacctggatctgcggattctcaaaggcgtggctggctggaacaagtctgctttcccatttgccaaaaacagcaaagctcaagctaagcagaagaagtttgacaaggccctgctgaaattgaagaaggatggcacgctttcaaggctgtccaagaagtactacaacggtgaggacgtaaccaaaaagtccatcagtaacgactaatcatcagtcaacggaggaacagatatggattttccctatatgcttaaagtctttcctgaaatcggcaaatacgtcccagtaacgcttctaatggctgttgccgcaatggtattagctattcttgtcgccgctgttttgagcgttggccagcatcataaatccagtcgctggctggttgatttctacgtcttgatttttcggggctttccgaccttggtgatcttttttgtcggctattatggtctgccacagctgctgcacagccgctctttggtcccggcctcaattgctgcaaccgtctgcctggcattaaaagaaggcgcctatctggttgagattttccgttctggcattgcctcagttgccaaaagtcaattggaaaccggcctggcgttaggaatgtccaaatcactggtctaccgcaagatcatcatccctcaagccattcgtatcatcattccgcccgctggcaatacttttgtcggcctgttgaaagaaacgtccttggccttttcaattggggtaacggaaatttttggtgccggtaagcttctggcaaccgaaaactttgaatatttcgatgtctacctggttgtgggaatctggtacgtgattatgatctatgtctacacgctgctgcagaaattattggaaaaacatctggcacggcgctttggagaggaggctgcctaattgagcaagaatcagtatctgccaattgccattaaaactgccaactggctcgatcagcatgtcgttaaaactgaacatggcattacttgggacattagcaagtcgtttaaaggaccttggcgctattacgatgaagcatcaatgtatgccggcgctagcggaatcgttaagttttacctggaactggcccagatcagcggcaatcagcgctatctggacacggcggtcgcggctggtcatgaactggccgcccgcgcgttggtcaacgatccgcagctggacaaagcttttagccgctatgcctttaccactggactaagtggtgtggcgcaggcattggactggatcaatcaggaacatcatgaatccgtttttgacgatgccatcaccaaaattctaaacggtatcgtcaccgatcaaaagcaggatggttcctggagcggtcagattggcatcgtggctgacggtggcacggcgcttttgttggggcgacttggctcaaaatatctgatcgatggttggcaggatgctttgatcaaatttggcgactatattttggcccacaagcaggttgatgagcacggacagtcattttatgtcggcttagaccttaaattcgtgggcggtcccatcggcaagttcaataccggctttccgctgggaccatccggcgtggcgtttaccctgcttaaattagccgagctgacaggagaaaatcgttttattgatggcaccaagggtattcgcgaattttacgaatactataatcatggtaagggactgctcttaccgcactatcatcccgacaccgagcatatctgctacgtcggctattgtggtggacccgtgggcacggcgcgctatttttatgaactggccaaacagaccgacgatgctcatgccgtggatgattttgaagcagctatcgcgggacttgagcgcatacaggcaccccaaaaacgttcagccggctattgggaaaccgacaactactgctgcggtacggccggaattctacagctgtttaccggcgcctatctcgtaacgaataatcaagactatcttaaaagcgctcagcagactgccacgattttagttgaacgagcaactcaagatgagcagtttgcctattggaagcaggcctttgagcgcaagaacccgcaaaacgttacggcggctctaggtttttacgatggtgcggccggcattgcctcatatctgttgcagcttggcgaagtggaaaatgatcagttgtcgacgcaccgtttcatcgatgacccctaccccgccgtttggcaacaaaaccattaaaacaaccggctcaagcaggcgttgaaccatgctgagccggttttgaatcaaccattaatttttatagattggaatgatttaatgtttaatcgcgcgatccgacttagtcccggtatttatgtcaatgaacccggcgcactaaaaaagctgcccgaactgattaatgaatttacacttaaaagtccggtcatcttgactgatcaaaccgttttaaaaattatcccccaatatctgccggctgattttgtgactcggtatccagtcgaaatctttaatggcagctgcgagtttgccgaaatcgatcgtctaaccgaacagctaaagccttatgatgggatcatcgcatttggtggtggccagttgatggatacggcaaaagtcgtcagcgatcgtctcaacaacgtcttgatcaacgtccagaccgttccttccaactgcgcggcctttactaccaaaagcatcgtctattcgccaactcacgaaatgattgccagcgtgcgcgaaaaaaagcccgttgatgccgttattctggaacctgagctgttaaaaaacgcgccgcttgaatatctgcgttcaggcatcggcgacacgttggccaaatactatgagattcggcggcgcctgactgatgataaaatgcattcgctatcactgtccttagcccgcgatatgatcgaacggtgtcgtgaagaaatgctgaaagttgataatccgcggtcgcttaacggtcttaacctgcagaactttatcgataccatctttttagcaacgtcattggttgatggctttgcagacctggatggacgcagcgtggcggctcatactttctataacgcctatgtcaaaatcatcggcccgcaacgctttacgcatggcgagatcgttgctttaggcaatctgtttcaggttacgttggaaaacgatgccgcgttgatcaaagaaatccgcgcctactatcctcgcgttggcttgccgctgtcattagctgaccttggcattacccaggctgagcagctggactcattggctgaatatatggctaaacccgacaacgtcagaatgcagtcgattttcccaaaaattagcgcggcagctattcgcgaaacgctgaccaaacttgtttaataataaaacccccaattgattcgcaatgcacccgcgaatcggttggaggttaaattctatctggtactaaaacagctgcagcatcagcgccatgatcatttctttaatcagcttaccgcccaacgagattgcggcaaaaacgatcaaaccattgatgaccaaaacgatcagtgcgccatacatgcgatcaaacttctgactgtcagcctcaagcatcacatcagccaatgccagggcaaacattcccaaagtagtcagcagaatcacgccaatcagagtcatcatgccaagcgagctggttaatgatgccagcaacaagctgaccagcagcaaaataacattaaagttgctggaccacgtcaaccgattgatcatatcaacgtaatcgccgccttcaataccactaacatagcgtttaaagacgtacgccacggcactcgtcagcagcatcgcaaccacgatcagcagccacagcaagaaaaagctccccgtcgtcatggccttgatgtgaaaaacgattgccgagcctgacgcaagctgagcaagcttcgccgatagatgatcaaccatccagccaatcgtcacaaccgcaatcaaggcctcaagaatctgcatcgtcaaaccggtccaacgccagcttggctgctgatatgctccgggatgtctcaatgattcaatcagccagtcccaggcccgtttaaatccctgcttggtatgctctagatccagcgtcagttcaaatgagtcttcagccgtatttgattcggattgctttctggcttccgcacgactcttaaatgacgcggactcatgattttctttggcttcaccagccgcgctgactgctgcttttgaatccggtttggccggctggctgcctgctttgggatcgttgaccaaaggatgctgctgttctgcgactttttgaatgtctgaagcttcgtcacgacctggtgccagcgcgctttgttgcggttcagcggtcttttgtgcatggacaggatccgttgatgtttgcggctcatgctgtcctgctgccacttgaggccgttcagccgatattgtccgtggcacgctgattgattcagttgctggtggctcactgttttcgctggttatcgaagctggctgaatttcttggtcagccgttttgtgatcgtcaaccgcttcaaaatgccagccacaacgagtacagtattgggcattttctaaaacttcactaccacagtttggacagattttcatcttaattcctccgtcaaaccatcaattaacttaattatgcaaagtaaaagcaccccgcggcaatggcggagtgctgttttgattaagcgctgattagccttcaaagacgtccgtcaatggaggtaccacttgcttcttacgtgaaactacgcctggcaggttcatacggtggttgtcacccagcttcttgccgaatgcctgttcaaccttttccgtgttgccgccaacaaccagcagatcagaatcgctgttcaaaatgttggtagcaatcaagatgaacgtgtcatagccgttttcatcgttcagttgctgcatcgtcttttccaggtcggcttgacgagagaagacgtcatccaggtcaaccgtgtttacttgaccgatccgcagcttagcgtcacccagttcaaacgtcttggcgtcgccatcaacgatatcagcgtcagacttggcagccaggttggtaccagccttcagcatctcaattccgtaagcttcgtagtcttcaacaccggcaacctttgccaggtacttcaaagcttcgccgtcatggtcagtagtcgttggcgacttcagcagcagcgtgtcggaaatgatagcagacatcatcattcccgccaggttggcaggaatttcaatgtgcttttcttggaacagttccgtgatgatcgtggaaacacagccgtatgggcgcgccgtgatccaaagtggctgtgccgtgttgaagttggcgatccggtggtggtcaaccaagtgtgtaaccgtaacttggtcgatgtcagcagctgattgttgtggttcgttgtggtcaaccagcattaccttgtcagtttcgttggcaaccgtcttaacgacccgtggtgcttccatgttgaagtagttcaaagcgtacttcgtttcatcgtttggttcgcccagggcaacggcttccgtttcgtagcccagttcgttttcaaagtatgaaaatgccattgcggccgtaatggcgtcagtatctggcttttgatgaccaaaaactaattccttgctcataaagacaactcctttgattcaatcatcacgtaaaacgttaactgcaacgttttcgcaaattaattatacccttttattttagcacgaccagctcttaaatgggaatctaatttcatttcaggtgcatatttatgcagactatgaaattgaatccgtcagatcgagctgctcgcttgtcgctgtttcggtcagctggggcttgatgcgcagcttaaccggaatgccctgactttcggtatcaattacaaaagtaccgtttgaatgagccgttcccagatggtgatcagtaatcaaaacatcctggaacagcggccgatcggtaatgatctcaacggcgccttgatagtcggcatcataaggcaaaaagtcgaccagcttgtgcggcagcttcttcaagcggtgcagcaccagttcgccgcgtcttgcccgtgcaccaagcttgatgtcggctacggccatttctttaaaggccccgcgctgagttaccatggccagatgctgatcctcatcaaccagctgcaggtcaaccattctgtcatcgtcatgcagattaatggcccgtacccccgtcgttctgaccccggcaatcggtacttcagctacgtcaaagcgaacggcatagccttcatgactgattgccagcagcgactgcgcggtatcttttggctcataatacattacgttaacgacttgagcgtcatcacccttaagcttcatgtagaccgtcgccgtgctcttataacgggatcctggctgatattccttgaactcagtctgcttgacctgaccatcgctggttcccatcagcagcgttcctggcatatccagccgatcaaaaatcagtgccttgataatctcttcacccgcggccaggccgatcgtttgtgaaatatgctcaccaacgtccttccagcgcacatcagtcaattcatgcaccggccgatagatcagatggccaagattggtgaacatgaacaggtgcgccagcgtactggtttcttgaatcagcaacggatagtcgtcttctcgcaaaccgtcttcttcaacattggaagccttaaatgaccgcagactgctgcgcttgatgtagccggctttggaaaccaatacgaccacgtcttctttggcgaccgtaaccttagtgtcgatctccagtttttgaaccttgctttgaatctcagtccggcgcggcgtcgcaaattcttttttaatcgtccgcatttcttggcgcagcactttagccagctctttttcatcgtttaaaatcagctgatattcggcaatctgatcattcagacgcttttgctcatcttcaagcgccgtcacgtcagtattggtcagccgatacagctgcatggtaacaatggcttcggcttgcggatcatcaaagcccagcgattcaatcagattctgcttagcatcagcccggtttttagaagcccgaatcgtttgaatgacctgatcaagcatgctgagcgccttaatcagcccttcaacgatgtggagccgtttttgcgccttatttaaatcaaagcgcgtccgccgcataatgatctctttttggaagctcagataagacgtcaaaatatgctttaaacctacccgcattggccgctgattatcgatcgccaccatgttgaagttatagttgatctgcaggtcagtgttttttagcagatagtttaagatcccctcggcattggcgccgcgcttcagctcaattgcgatgcgcaggccgctgcggtcagtctcatcgcgcgcttcagcgattccctcaacctttttggccagacgcaggtcgttgattcgcttgaccagctgggccttgttgacttcatatggaatctccgtgatattgatctgctgccgaccgccacgcagcgtctcgatactggtcttggcccgtacaacgatgcgtccccgaccagtttcataggcttttttgattccttccttaccttgaatgatcccgccagttgggaaatcaggaccagtcacgaattccatcagcttatccagactggccgtgggatgcccaagcaggtagatcagtgcatcaatcagctcacccagattatgcgtcggaatttccgtagcataacctgccgagatcccggtcgcaccgttaaccaaaagattgggaatgcgggctggcaagacggtcggctctttttcggtatcgtcaaagttcagcgtcatatcaaccgtatctttgtcgatatccttgagcatcaaaccggcaatcttgcttaaacgagcctcggtataacgcatggcagccggtggatcaccatccatcgacccgttgttgccgtgtatttcaatcaatgggtcacgcagcttccaatcctgactcatccgtaccagtgcttcataaatggaactgtcgccgtgcgggtggaagttacccattacgttaccaaccgacttggctgacttgcgaaagcctttatcataggtattgccatccttgttcatggcaaacaggatccgacgctgaaccggtttgaggccatcgcgaatatccggcaaggcccgttcttgaatgatggacttggaataccggccgaagcgatcgcccatcaagtcttccaaagtcatattttcgatttttggttcactcattgactttcacctcttacttttgattccaggtattgatcgtcggcgttttagccttttgaccgcgattttccatcagctgatcagactcttcgtcatcgctcagcgtaaattgcacgttttcttcaatccatttccgacgcggtgcaaccttatcgcccatcaaggtagtgacgcgcttttcagccagctcggcatcttctatccgcactcgaatcagcgtccgtgtatcaggattcatcgtggtttcccaaagctgatcggcattcatttcaccaagccccttgaaacgctgcagttgagcgccgcgaatctttttggtcatttgcgtcagctgatcattggtccaggcatactgaatcttggttttggctcccttgccagactggatgcgatacagtggcggcaaggcaatgtagaccttaccggcttcgatcattggccgcatgtacttgtagaagaacgtcagcaaaagaatctggatgtgggccccatcgtcgtcggcatcagtcatgatgatgatcttgtcgtaattggagtctgcgacgttgaactcactgccgacccctgcgccaaccgtatagatgatcgtattaagctcttcgtttttcaagacgtcatccagcttggccttttccgtattgagaaccttaccacgcaatggcaggatcgcttgaaactttcgatcgcgcccctgcttggcactcccaccggctgaatcaccttcgactaagaaaagctcatttttagcggcatcttttgactgggccggcgtcagcttaccggacaaattgcgttctttccggcctttgcgcttggagccgcgtgattcgtcacgagccttgcgcgcggcttcccttgcctggcgagccttgagtgcttttctaatcagctgctgagcttcatcgccattttccagcagcatgtagcttagctggtcgctgacgattgagtccactatcttacgggcttctggcgtccccagcttgtctttggtctggccctcaaactgcaggatacgttccgggattcgtactgagacgactgccgtcaagccttcacgaacgtcagacccttccagattcttgtcgcgttccttgagcagaccgacttttctggcgtagtcattgaacgttttggtccaggcattgcgaaaaccggcttcatgcgttcccccatctggagtgcgcacgttgttgacaaagcttaagacgttttctgaatagccatcgttatactgagccgcaacctcaacttcaacgccatcctgcttgccgtcaaagtacatgatctggcccagggtatccttgtcttcattgaggtagccgacaaagtccttgatgccgttttcaaactggaatacctcttctttttcttgaccagcgcgcttgtcagtcagcgtgatcttcaggccctttagcaggaatgccgattcacgcagccgtcttgccaaagtatcgtagttgtagactgtcgtagaaaagatttttggatccggcttaaaggtaactgttgttccggaacccgcacgcgtattgcctaattttttgagcgtcccgaccggattgccgccattgacgaatttttcttgatagcgaacgtgatcgcgcacgatcgtcagtgtcagtttggttgaaagagcattcacgactgaggccccaaccccatgcagcccaccggaagtcttatagccatcgtcttgaccaaactttcccccggcatgtagcacggtcatgatgacttccggcgttggtttgccagaagcatgcattcctaccggcatcccacgaccatgatcctggaccgtgattgaattgtcgggttcgatcgtcacgttgatttcatcgccaaaaccagacaaagcctcatcgaccgcgttgtcaacgatttcatataccaaatggtgcaggccataggtatccgttgaaccgatatacatcccaggccgtttgcgcaccgcctccagccccttaaggattttaatggaggatgcatcatattgatattcttgttctgccaacgaaaggccctcctcataattttttagtaacgttttttaatataactgatttggcaaaatttagcaaagaaattttgcaaacatttgtgccccattattttaacacatcaaacaaaagttgccgatgtcactcaatgtgctattataacaattatgcaattattatcgagggagttttgaatgatttatgatttttaaaatctgtttaatggcagtcattgcctaccttttgggctcgattccctggggactttggatcggccaggtattctaccacaaggatattcgcaaattgggcagcggcaatatcggcacgaccaacactctgcgcgttttgggacctaaagcaggcgtaaccgtattgtttcttgatatgttcaaggggacgctggcagcctgtcagccatatttctttcactgtagtcagaccgtcagcccgcttttaattggcttatttgccgttttgggccatacctgctcgatttttgatcactttcatggcggtaaagccgttgcaaccagtgccgggatcctgctagcatataacccgctgctctttttggttgcctgggccatctatctgacggtactattattgaccagcatggctagcgcggctggcatggtgggcattaccgcaattttcatcattgccttatgcattcacgactggattttggcagccattgccgggttcttgacagtggtaatcatctggctgcaccgtgccaacatcaagcgcatctttaatggtaccgaatcgctggttcattttggcttgggctatcggcgacagcaaaaacacaatcaaaaataattaagctgatgatcgcatcacttggcattaaaggccgagctgaatgcgatttttattttattgataaatttaggcaaccgatttcctaaaacctcttgcaaaagcattgaaagcgcttataattaggtgtaacgatttcctaaaatcaaaatttaaacatcgaggtgctttttatgagttcatttaaccaacaaagttttcagcttaatggcaaggttgcattgattactggcggtgccagcgggctgggccaaaactattcaaaggcgctgtcgctttacggcgcggatatttttgtcgtttcaaattcacagcgcggctgggaagaaactcgtcaagcggttgaaggcaatggacaaaagatcggctttctgcagcgcgacatcactgaaccgggttgtgccgacgaaatcatcgcgcaatgcgttaaggaaatgggtggtctggatattttagtcaacaatgccggcattcagatccgcaatgacgtcttggcgttcaaggatgaagactgggacaaggtgatcaatttgaatctcaacgcgctctaccacatgtcgcaggccgcagccaagtatatggcgaagcaaaagcacggcaagatcattaacattggctcaatgcagtcctaccgtgccggcaagttcatcttcccttacacggcagccaaacatggcgtcctgggcctgactaaagcctacgctgatgctctttccaaatacaacattcaagtcaacggtctggcaccaggctacattttaacggaaatgactaaggcgctggccgaagatccggtgcgggggcctgagatcaaagaacatattccttctggtgaatggggccgtcctgaacaattgatggggccaatggtatttttagccagtccggcatctgattacgtaaccggtgtaatgctgccagttgatggcggctacctgctgcgctgatccaattcagctataatcaaaaagacgtggtgatcaagctcaccacgtcttttttaagtcgttagaaaggctgaatggcaaatgcatagtcctcatgcttgccaggtgccagccgactcatcacctgcttgtcttcgagtctgccgtcactgtggatgctgtcggcaatcccccaccatggctcaacgcataccaggttggcctgggctgggtatggcgaccagacgccgacaaatggtgcaccgttaacctgaacgtgaaccccatgattggtctgcggttccgtcagcgttgccgtaaatggcatgcccttggttgcaaagatcaaggcatcctcatcaaacagctcatgatccagttgaatgggctgctgcatgtgcaaaaccgctggatgttccagatcattaaatggaccaggtgcgaccaatttaacctgttgatagtcaatcgccggcgaaacactgaactgagtcgtttcaaaactgccctgctcatcaactggtacgttaaaaccagggtgcgcacccaaagcatagatcagcgtctggtcattgcttgggttttcaacacgatagctgaccagcagacgatcctcatccagctggtaggcaatcgtcaatacaaaagcaaacgggaaggcagcccgcgttttttcatcatcacgcagctcaaaaactactcgctcactgctctgttccacaaccttaaactcccgatcgcgggcaaaaccatgctgcgtttgatgatagaccttgccttgatattcgtactgatcatctttgagccggccgacaaatggaaacagaaccggtgcttgccgtttccaagactttggatcaccctgccacaaatattccaatcccgctgcatttcgcttaatgctgtgcatctgcgcgcctaatggatcaatctgtaccgtcagctgctcattttcaatctgaatcatctctcgtcatcctttcaactctcaatggacaatggtatatgccaaaagccctctaatctgcacaataacagattgagagggctttcgcaagtctatcttttaattttggattgattcttcgtagtcgccattaggacaaacgatctgcttgcccttcttgaccttcttttcaatcaagaaatgaccgtctttaggacagttacggccaattggcttgtcccatgaaacgaaatcacattctgggtagcgcgagcagccataaaagacgcgattcttcttggacttgcgctcgactacgtttccttgcccacacttaggacaggttacgccgatatctttgacgattgccttggtgttgcggcagttcgggaagcgcgagcaggcatggaacttgccatagcggcccatcttaacgaccattggcgccccacagatctcacaattgctgccggccagttcatcatgcatttcgattttagcaacctgttcctcggcagcctggacttccttagaaaatggctggtagaacttgtcaacgaccttaacccagttttccttgccttcttcgatccggtccaagtcgtcttcaacttcggccgtaaacttgacattgacgatttctgggaactgcttgacgatgatctggttgacgatctcacccagctcggttggctcaaagtggcgcgataccaaacgaacatagtagcggcgctgaatggtgtccagcgttggcgcgtaggtggaaggccggccgaccccattttcttccagcgtcttgatcaaggcagcttccgtataacgagcaggcggctgcgtgaagtgctgggccgggtcatcactgatcatttggacctggtcgccttgattcagttctggtaaaacattgtctttttcctgaccacgcttgtaaaccttggtaaagccatcaaatttgaccttggatccgttggcatgaaagtcgaccccgttttggctcaatgaaacggccatcgtatcaacaatctgcggcgtcatctggctagccacgaatcggctccagatcagactgtagagcttgtattgatcagccgtcaaatactgtttcatctccacgggcgtgcgattgaccgaagttggccgaatcgcttcgtgcgcgtcttgggccccttccggcagcttacccttgaccggcttgattgcagcatattgttccccatagttttcatgaataaactgagaggcttcctgtttggcaattgaggcaatccgtgtagagtcggtacgcatgtaggtgatcagaccgaccgcgctgccgtgcccaagcgtaatcccttcataaagctgttgcgcagccatcatcgtcttacgcgtccggaagttcagacggcggttggcatcctgctgcatcgtggaggtagtgtatggtggctgcggcatccgcttgcgttctttacgcgtaacgtcatcaatcgtaaatggcgccttgcgatcaatcttggccagcactttttgaacggcttcgttattaggcagcgcggtttttttaccattttcgccataaaaagatgccgcaaactcatcactgccctttttgaactgaccatcaatcgtccagtattcttcgggcttaaagtcgcgaatcgcctgttctctttggatgatcaggtttagtgcgactgactgcacccgtccggcagacagtccttttttgacctttttccaaagaatcgggctgatggaataaccaaccagccgatccaaaacccgccgtgcctgctgtgcgtcaaccaggtccatgttgatctcacgcggttccttaaaggcttccttaacggcgtctttggtaatttcattgaaggtaacccggttcttgtctttagtatccagctttaaaaggttggcaacgtgccaggcaattgcttccccttcccggtccgggtcagatgccagatagacggctttggcctgcttggcatccttgcgcagttctttgatcacgtcacccttaccacgaatggagatgtagtcgggctgatagtcgttttcaatatcaacccccatccggctctttggcagatcccggacatgacccagactggcgacgactttataggtccgtcccagatacttgccaatcgtcttggctttggaaggcgattcgacgatgaccagctttttcttggtcttagggcgcttggcagtcgcctttttggttgttttagcggccggttttgcagttttcgtcttggccgaagttgttttagcggccggttttgcagttttcgtcttggccgaagttgttttagcagttgattttacagttttagttgccatcataaggctcctatcatgatgaatttgatcggttttatcttctatactattatatggtctcttgtgcggtcaaacccgtctggctgatttcaatcagcaatgaaccgatcagatagacctagattaattcaaaaaagaaaatggtctaactagcgtatcaatataatcgagtttattaaaaaaatcaaggcaacgataaaatcattttaacgaaaaaaacaaatttaaaaattaaagagtgaaattttagtaccaaattggatttttggcatatagcaaaggtaaggagggaaaataatgctactgcgtgaatttatcctaaagctgagtctgtgcagctgcttgagccggcgcataaaatatcggcttttaatggctgccattcagcaaaaacagattaccaatctcgctaaattgactgatcacttgaacattacttttaacaaacgaatgcagtggtttgacgaatggtccagccaggaactgcggcgtcagactgagcaaaatctaccgatgccgttcataacgccgcttgacgcgatctatccgcagcgcctgcgagaaatttatgatccgccattggttttgtattatcatggcaacctaaaactgctgcagtacccttgtctggccgtggttggatcaagaaacatcactaaatatggtgaacaagcgatcaatcaattactgccaggagtcgtcagcagccaagtcgcgatcgtcagtggcctggccaaaggagttgacggcttggctcaccagattacgctgctggatggcggggccgcaattgccgtaatcgggactggtctagatggtagttatccacgctgcaatgcatttttacagcggcaaatcgcacagtccggtcttttgctgacggagtatccactggcaactacgccctacccgagcaattttcccgaacgcaatcggatcattgccggtttatgtcatgcctgtctggtggttgaaggcagtcagcgcagcggcagtctgattacggccaacctggcgctgcaggacaatcgaaatgtcggtgcggttcccgggccaatcgattcgccaacgtcgcttggagccaatgaactgattgctgctggagcacgaccgatcctaagcagtcaagacattttagaggagctgcctgactggctgttttctgcgaaatagactgtctcaataattttagaaacaacacgatcctacaagccaattaaaaaagcacggcctcaagtttcatcaaaaccaagacagtgctgttctttttatctagtattcaattatgtccagctagaaatcccgtgactttagtcgatggtggctgacttgctaatgcagatattgctggactggtgaaaacgagtgccgatgaatcgggcatggtccaagttttgctaagccctgcaaatgctgcttggtgccatagcccatattttcagcaaagccatagcctggataaagccggtcgtaatcatgcatcagatgatcacgatattctttggcaacgatactggcagccgcgacgctgatactcttttgatcgcctttaatcaaggttgtctgcggaatatcaattgccagggggacggcatcgacaatcaggtgggacggccgatgcgccaatgaatttacactgcgaatcattgcctgctgggtcgctgcgtagatattaagctgatcgataaccgtgcatgggttgacggcaaggctgacttccagggcttcattaacgatctgcagatacagctgctcacgctcatgcctggtcagctgcttagagtccgtaacccccaccagatcaaaatcaggcttgagaattaccgcgcatgtaactactggaccagccagcggcccccgcccaacctcatcgatcccggcaacgtactgctgaccatcttgccagagctgattttcatatttgaaacgctctttgaaggccgcgtagcttgctgcctgccgttccaatcgacgctttagctgggccagcgcggtttgaacgcctttacgctcatcttgtcgtagtgattgaacaaacggattatcaagcgtagacacgtcttttaagcgatccttgatttcttttatgcttagcttattcattgagaccctcggcattaatgtcagccggcttttccaatgagatcgttcccagcttgcccttgcgcaaatcaaagatcagccgttcactgccgcggtcgtagtcatcacgaaagcccatctttttggtaatcgtcagcaatagatccggatcagtcacgctttcatcaacatcagcgtcagtcagatggtagcgctgcttcaattcggtcagccgattggcgcgcagatactgcagtgcaaacagggccacgtcatccttggcaaacagactgtctttgatcgcgccagaaagtgccagcattaagccttctttttcggtcgcgaacttatgccataaaacgcctggcgtatccagcagctccaattcagccgacgaacgcagccactgctgaccggtcgttacccccggccgattaccagtagccgcaacgttctttttgaccaggtgattcaaaagcgttgacttgccgacgttaggcacgccgacacacattgcgcgaatcgcccgttttttcatccccttagcctgctcattggccagtttttcggctaagacctgcttggccgcgttggtaacggtcttggcaacgctgcgggcgcgcgagtccagtgccagtaccggctgtccgtgatccttaaagtactgcagccattctttggtgacttctggatccgctaaatcagttttggttaagatcaaaagacgcggcttgtcgccagcggccagatcaacttctgggttttgcgaggagtatggcacccgcgcatcaaccagctcaaatacgatatcgactaaaggcatctgctctctgatctggcgcaatgctttggccatgtgaccagggaaccattgaattgttgccattttagttcctcctaaattctaattcattttttctagatacagctgccaggcatcatcaaaaatcgtcattcctggcagatattcggcattttcttccaagtaatgagatatttcatcaaaatcttgggattgcttaggaaatgacgagtccaaaaaagcattattggcaaactgctcaatctcagttggctgattgggctgccttaaggtcatcaaaaaatgatagaagctttcacgaaacatctgccaacctcctgttagttatcctgcggcacggtaatcaagaacttaaactgaccatctgccaggttgatctcatcagcttgggcatgcactgccttatttttggtgtatttattcagatccagcagaatcgtctttttcttttggttaatgtagacccagtttggcagctgatagttctttttgatatagcccataacgaacccgatcggcagattaagccggccaaccgccaatcctttagctttcagcagaatattgccttcactggttttaaccggaatgcagttcatcgcatattgcacgttgacccccaaaaacttggcgcggccgatcaccgttgcatactgattgcctacgataaaacgatattgcggctttttggactttttctgaatttttttaatgtagctgttggctaaggcattgacctgtttttgattcaaaaccagttccaatgacgtatcgctggctttgggagccgtggtttcagctggtgtcttaactggtgcgctggctagatgaactaccgttagcagcgaaccgatcaagacgattaccaaaacccaaaaagctgccttccagccattatattgtttctttagcttatcttccatattcattcaaatcatcctactcttgctgatattcccagtcatcgtgctgcagcatcaccttgtataaagcattggtcatctgatcatagcccttgctgttagggtgaaaattatcttcagttgagatgtagttgtttaggttgtgcgtatcattgttcataatcgcaatgacctgcttttgggtaatctgatcgctattggctttttgagcctgctgtgagagtttttgccgctgcttggccgttttatactggccatatgacattaaatgattgatatcaacgaaataggacgggccatactgagccacggtctgttgcgtaatttgattccacttggcgacggactcgttgataatcgacacatcaggaaaataagtgtaaaccggatcataaatgctgtacataaaaatcggcgcagtggcattctgtttgcgaaccgcggtcagcaattcatttagcttttgctgataggtcgtgcctgcctgttcgatattgctctcgatcttatttgttgaattgctcaacaggttgctctccagtttctgcatcaagtcattgccgccaaccgtcatcacgatcacatcggctttttttagatttgcccgcatttctggctgttcattaagccgtttgagcatctgatcggaccggtcgccagttaccccataattatacgtagttacgcgattatggtagtgcttttgcagttttttcctaattcgtccgacataaccctgctcgtttttatcatcgccttgaccatgcgtcagcgaatcgccaatcgcaaccagcgttatttttttctttaaaacccgatctttttgtgaagtctgttgaaccgttgtcgataatgactgctgctggtgataccagtatccacttccgccagccaccgctaaaacggcgccgatcaacaacagcaagccttttttgccgcgcagcataaaattacctctcactaaaaaattcttaaagtcaattaagatacataagaaatattatagtgcattttatcatgccaccgcaaactcggaagcggatccaattgccaataatttatggattggatcgttcactaagtaaaaaacggttgatgacttaatcaagcctcaaccgcatgctcagcaactacttaattcgattacagattacgatggaagaagaacttctcaagccagcgactgtccttgcgcagcttaaagtaggcaatcactgcaaaaatgagagcgccaaagaagtcagcaaacagatcacccatcgtatccattaaagccgcccgtcccaacagcaagtgaccgttcctcatgtaccgctgcagattcatgccaaacgagtcacaggtaaattcataaaattcccatagaacgccgcaaaaaaccgcaaacgccgtggcatacatactgataaaaaatggcggtacgtgcttgatcccctcatcaggaatcaggccgccaaatgctgacagcgcaaaaccagccagcaaagcaccgctgatcagatgcagacctttgtcccagtatggaatgctgtagaagtgatagatcgtgcccagataaatggctccatagataaacattaaaaacagaccgtaaagcagcggcggcagataaacctttagcttgatcgccaaaaacttaggcagcatgacgatcagcaggccggccacgatttccagatccaaaaaccagacggcccctgctgctttggctgtcgcagccgtcaaagccgttttggtagttaaaatcagtgaaaccagcatcgaaattacaataaaccacaaaaaaacgttaagggctttttcactggtgcttgagccgtttttcatcatcatcacatcctttaatttgagcgtgctgagcattcattgctataatcaaggtcaaaaactgattaaaggagctgtagataatggcccagcaagcactcattgtttattattcacaatttaataataccactaaacttgccaaattaattcaagatgcgaccaaggctcccgcgttgcgtctgcgcgtggccgacagcgtctatccaaataacatggaagctactggtcgcatctatcaacagcagctaaaacaacgccagctgccgatacttatcaattccatgccacaactgaatcaatatgatgtcgttttggtcggcggccccgtctggaatggcaacgtggcagcaccagtgattgagtttttgaaaaccattcaaggataccaaggcttgattgcgccattctcaactgcctggagtgattctgatgattatcaagcaaatttcattaaatgggctggccggctgcaggtcactgatggattccacgtcacgactcacggctctcatcagttcaaagcaaacaatctggccgcctggctgcgcaaactatgataaagcaaaaatactgtcgccgactcatcaaaagtccacgacagcatttttctaagcttggcgttttcaaccattcttgtttcttaaaaaataaaattgatcagcagcatgtagcaaagggtcccgacaatcaaagttaaaaaaaggctgtgcttccataaatgcacgattaccgtcaccacgccggcaatgacttctggcagtccatgcgtgccgccaagccaattaacgttgcgatagcagtatacgaccagcatccccatgatcgcagccggtaaaaacctgcccagccccgttacgaaatcaggcgtggctgcttccgttctaaaaagcaaaaatggcgttaaccgggtggcaaagtttgccagcgcggctaaggcaatgcagataatctgatcagtcagtgtcattttggtcccccctctttgcttgacgccagtagataacggcgtattcagccactagaatcaacagtgttgccactaaaaagtacgtcttgccaaacagcagcagacaggcaatcgtaacgatcacgccgctggctgagctaagatgatccttttctttttgaaactggtcaacggccaaggcaataaacagcgccgtcatgacaaaatccatgccgggaatctctttgccaatcagactccccagtgcgccgcctaaaaatgcgcccaagacccagtagctgtgatcaaaaagcgaaatcagcgtatagactgagtaacgatcatattctttaggaatcgacagactatagttgacaacaaaggtttcatcggttaagccatagatcaaaaagaacttgcgccagcccgcaccgcgatattttttcagcattgaaaggccataaaaaaactgccgaaagccaacgaccagcgttatcaagacaacgttgcccggcaaaaagctctgaaccagcatggaagccaggataaattcaacggatcccccataaactaccgctgccattatcgtgggaaaccagaagccaaagcccaggttatgcatgtatagcccatagccggttcctaagataacataaccgaaaaaaatcggtaacgaactgttaaaagcaaagcgcacggtttcctggcgcgttgccggtggtgatgcttgcatattttcctctcccctgtgaataaatgattacagagattaattttaacgcaagccactattgattaacagagactttttgccagcaagatattttatgcattatcattcagatacatgctgctctgcaacaagcgcatcatcgcgacggtcactgcaatgatgccggtgagatccagccgtcaaccgatcttgactaaacaagccgccaatccgcagtcggctagcgtttgcaagacccaatacctataattctgatgctacgatatgatcagattgacaccatcatggaaacgaactagcgatagggcagccagcgattcaattcctggcgcttttttatctgttcttgacgccattgatgccaactgctgctggcttgactgacatgttcaatcagttcacgatcgattttttcccgatactcagcaactggtttggtatacaaccgaccgttttgatcgaactgatagccgccccacatatgctgactgattggatcaagcagaatcgactgaacgtagcgcacccggccgattgcatgatgcaggtcagtatagcccagggtcacgatgtccagtgagtcgatataattattgatcttattgcgcaaaatcgcggcttgggctttctgctggtcatcaagcagccagtagacgtttgggccctcataaagccaagcctcactcaggcatgccggataatcgcagttggcaagggcatactgggcgttgattgctcccagtgaatggccgtagatatagtaatgtgccgttaagtcctgctgcatcaaccgattcaacaaactggccgccgacttgagctgagaaggaatctcaccaactcgatgttcaacgatcgaacggccaatgggcagattggttgccagccattcattggaccatgtcgttggattgccatgtctcaagccggatgagccgcgaaacagcaccgttatctctttatgatcctgatggtgattgacaatgatggtgccccgcaggccatcttgtttatagaaagctcgtttgacgcgaccgactcgcttgccattggataatctgacgtgatcgccaacccccagcggctgatattccaaacctgccagctcgactcgctgctgatcggttagctgagcatttacatccattttttcaccccaatataaaaaacgacttcaatgatcgatatgatctattgagtcgattttatcacattatttatttgcttttattgaatcggcatttcgtagacgtatgaggtttcttcaggacggtagacgccatgcagagtccccacacgcgtaaaaccatacttttcaattaaatgctgcattggcttgttgtcctcatgggtgtcgatccgtaatgacttgacaccgttgggattttccttaacgtagtcgataacgctcgtaaacaaaccagaagcatagccattgccggcatggtcagagtgaatggcaacccggtgaataaccagatagttgtcagtatcaacgagccatttgccatccaattcatcgtaagagtggtccggagctgctacgattgcaaaagctcccaccgtttcatgatcgtcggaatgtaccaggtatgcaaagccatgttcaatatcttcttggatatgttcaacattcggataatcgccttgccattgatcaatcccgctttccgccagctgattgcggccatcacgcagaatttcgacaactcgatccagatccttcatttcggctttttcaatatgcatagcacaaccttctttccttaaagtatcaagcgtttatcaatttaacacattctgccaaaaattgacaataaaatggtcaatttcaacaaacagacttaaaataacatcatcaacactgatacgaggcgaatatcttgaaatataaattctggcttaaaattatgctggcggtgtgtctaatgatgaccatggcttcatccgccaaagcagctgcattgaattctcaaaaatacgttcagtcaaccacgccaacctttttctttcatggctggggcagcggggcgcatgccgaacgacacatggctcaggcggcgattgatgccggtgtcaccaaaacagtcatcgtagccaacattgcacaaaacggcaccgtcgagctagaaggtaagattcctcacggtgcgatcaacccaatcattgaagtgaacctgattgataatgagaacacaaactacactacggatggtcattacgctgccgcggccatccaaaaagtctgccaaacctatcatttcaaaaaatatcaggttgaggcgcattctatgggcaacatggcttttctttactgcctgctgcaaaacaccaacaattctaagtttcccaagctgcaaaaagaagtcgcgatggctggtacctttgatggcgtaatcggctggaatcaacctgccaacctgcagtataacgaacggaccggtgaagccacgccagctaccaaatcatatcaaaaactcaaaaaactgcgccacacttatccaaccactgcccgcgtcttaaatatttatggcgatctgggcgatggtaccgacagccaggtggacaataaatcatccaaagccttaaagtacctggttgccggtcgcgccaaatcatatcaagaacagcgcatcacaggggccaatgccaaacatgagcttttgcaccggaatccacaggtcgacgcgatcttgatcaagttcttatggggcaaataagcagcatgacattacaggaaataataatgcggcctttgtgagtatatgaattaagttttggacacatcaaggtgcagacacgacccaccttaaccctgcattaagcagtcaacgccaacctcagctgttgggatgcggtcaagcagttcaacaccccataatgactggctaccaaacggggaagatcctcgcaattggattcgacagcatctcggtttaaaaatcgagagcagtcgaatctataatctaatctatcatcagccatcagcatgaatgaacaaagcaagccggcagttttagacgaaagcacgttcctaatcattgataaatcgttgacgagatcgtctctgacaacgccacaccgctcaaaaaaactatggcggttgaatcacttcaggctgcttaatgcggcatcgattgactggctgccatcgtgcatcatgatgaccttgccaatcgtatttggatgttcaagggtttttaccaatacggcggcaacgtcaggaatcgcgttatgtcctgaactgccatcattcaaggcaaccatccccgtagctggccgctcatccaagactcctgcctggataatcgtccaatccaaccccggatgatcaatcagccagcgatccgcatagaacttggcaatattgtaatcggtaatggcttttaaagccgggatcgctgcccatttatcctgctcaagcgcgaaggcagagctcagctgaatgaaacgtttgatgccattttgccggcttgcttctgccagtttaacgctgccgtttaaatcaacctgcagcagatctttaccacgtgatccggctgcaaagattaccgcgtcaacttgacccagtgctttttgcagttcagtaatggaggcatgcagatcaagcttgacttttaagacatctggttgactgatcttttctggatgacgagcacccgcgactacttcatgacctgcttttcggagttcagtgactacggcttgtcccactcgtcccgtagctccggcgacaaaaactttcattgcaatcccctttcaactgcactagtaatttactatttgctttatactaactttttgtaagctaaaagacaaatttttagtcttccggcagctaaaatcgcataccttccgttttaccatccataaagatgccagcgattggcctttcgtcgatgttggaatgcgggaagtcgctaatccggctgcagggcagtagccgtcggagcagcttgactaacggccacctgtttaagcgcccgctgcgtcatttgaaagtaattcttataaagcgccgtgtagcgtcccgtgttcttatcgacgagccatggcttatgacgaccacaatagtgcagaattaccgtatgtttgatgacccaatccagcgtccactcaccaaagctgatcgtctcataggtctggcctttgcgggcatcaaaattatagagctgatcgggaaccgtcttaatatctttaccgtataaggcattcagcacgtcctggtctggcagcaacaagacgtgttctcggatatatgcgtagatatcttccgcatgaacccgctgccgtatcagatcaagattcatcaacaacacgccggaattataatagccatccgcgtcaaagttctgtaggcgaatcttattgatgacttccgtggtaccagtcaagccggtatgaattgctgaagcatacagatagccagccaaatccgtatcataaagtggtccaatatcattaatgcacaatacgtcagcatccagatatagaatgcgatgcagctgttttggcaagtattgatgagccagcaagcgataatagatggtcttgggataacgatcggtaaccggtgcctgatcgaattcctcgtctctgataataatcggatgatagttcatcccccagagttcacaagttttgcggatctctggcgtgtgcaccagttcttgtgattggatcacgtatacgtcaagcgggcgcggttgggaattgagtcggatcgagtttaggaccgtcagcatctggcgccaaaagcgatcgtcaattgaaaacaatagattcaaaattttcacctctcatagctgctgttaattctattttagatgaccagaccgattttgcacgaagcaaatgttgcaaaacgtttcttagaccaattcatctgccaagcgatctcattgccctaatttatggttttctacttgtcaaaccgcttaaattggcttacgatcgagtggtgacatttgcgactacaattattaagagggaaagatttatggaacaagcagcacaattggaggccatcaaacgctacaccatccaaaaacttggcagtgacagtactggacacggtctcgaccacatcatgcgcgtcgtacggatgaccaaaaaactgattgaaaccgaagctgccaatgagtttattgccgttgccgcggcctatctgcacgatacgattgacgagaagctggtaatcagcgtaaaagaagccgaggaagaattggaagatttcttgcggcgcattgacctgaccaatgagcagatccaagcaatcatggatatcatttccaacatgtcgtttgccgatacgctgggcgatgcacgaccaaccttatcgcgcgagggccagatcgtccaggatgccgactggctggacggtttgggcagcatcggcatcactcgggccgtctattacggtggcagccacggcgaacgcatctatgacccgctgatcaagccgcgtgagcacatgaatcgtgaggaataccgcacggaacgcgatgagaccgtcattaatcatttttacgaaaagctgttgaagatcaaagacatgctgaatacggaaacagcacgtaaaatagccgctcatcgtcagcagatcatggaagactttttaaacgagtttttcttggaatgggatgccaaagcctagtttgcaaactaaaagccaagctgccggatgcggtgcttggctttttgattgggcaagtaattttcccgtctctatttatcaacagtcaactttttgatccgttacctttgcttcttgccccagtattcactgcgctcttcaaattgtttcacattaacgcaaacaagtgacaattcaaagcataaattggagatttttggtgttagcttatttctgcttcaattaattagaaaaagaaagccaccattttgccacctcttgttagcctaaaaatagatttcttactattatatattgtattaatataaatatgcaaaaaagccctacacacggctagtgttaatcaaggagagaactttcacttccttcttcattgatatggtttggtgccatgtgtagggctttgccttatatatttaattgtagatattattcaaacgatccgtatgcttcattagtgcgtgcatctcgacaggcaacgtagccatactgaccattagctcgtggctggcgcagatagacaaaaccattagtccgtgcccatgcatcatacttaactactgatccgccatagagtaccgcaataacagaactggaaggcgtagctccccagcgtaagtgcaggacataaccagagcctaccgtaaacttaccattttcggcatgccaggtaactcccaagctgtcccgccaagtagtgccggctgatgtagactctgcagcagctttcttatcttgctgtggttgtggctgagtcgttggtcgaaccgtgccatcccctttggccagcttgtgccagccgtctgcatcaagataaaactcagagcggtccatcgtattgccggtgaactgccagccagtcagattggaccaaggggcaaacttatacgaactcaggaatgctggcactgcccagctgttagcataggtaggataaccagctccccacaagccacaagagttggagcaattggctacttgccaaacagcactgaactgtacataaataattggatagacaccagtctggctgtgtacgtagtctacaaacgtccgacaccagttagtgttgccccagctggcattctggcctgattcccaatccaagccaagaattgcttcaccgatgtagttcttgacattagcaatgaaatacttggcttcttcaacaggatcaccacctgcggcatagtgataaacacctagcagcttgccggcatttttcgcggcttgataatcggtatcgcaatatggattgatataacctgtaccttgcgtagctttaacaatgacgccttgtgcgttaggatctgtcgcatagctgcgtggcgagccagagtatacatctactaccttaatcgtcataatatcacctctacttgttgagtaccggttgcgtgttatttatatcatcagtgctcttttgcttatcagccactccagatttttcgtaagctgattgaacaacggttcctgcgtcttctggagtgatgtgatggccagacttagcaagtgacgtctgtaccatttcaacggccttagcgtacttatcagcgccagataggttgcgactagccatcgtgttgacagctgcttctgctacctgttcggccagcgtccagagttggcgcgattgctccgtcttggccgtcttagccttagcggtcagcaacggcttggcgtatgcccacaaaaaggccaccagtacggccagtgcgccagactgaatcaaccattcgataatgtcatttgctactttcattttttgtcccccttgacgattacatgttcctcaattcgagccagccggatatcatgtttgtcggtcgtatcttccagcttgtctagtctgcgattggtcgactctcgatcagcttttaggctatccaaaaccatgttgaccttaatcatcgttctattcagctgagcgattgagtcgccaagccggtcaaattcggctttgttggaatcatgtgcagtatggctgattgatgtcttgacatatgtcatggtcacaccaatcagtgtcacgatgctgaccagctcgccccagtcaaacccgaaaggtctgtgcatatccatatctcacctcactcttctaattcaaaaaagccgcccctgtaaggtactgttagctttctttggcgactatgttttagttagctaggcttgactggtatccgtgttggcagattcgcttgcgccggctgacgtagacgtgcttgcgtccgcgtagtccttgccagtgatttctttgtactgatctttagtgatcgtcttgtactgcacgtagcactcaatcgggaaaccccatgagtaaatcgtcttgacaaaatcgtaatccgtcatcatagtctttcactctccttagttagtcgtggtcgtggattgcgccttgagctgagcaacagtttgtccaagcatggacaccatctgcttgagttgcgtgttgtcctgcttgatctgtacgttttcggcgttagttttagctacctgttggcccagcaggctgatcatctgctgttcagcagttggcttagctggagctggcttgttgagcgcatcaatttcctctttcgtcagggtttcaacccacttgttttgagccgtgtcaaacttcggcttatacattcccgcaccattagcgtcatatggaacaacgatcgtttcgttggcttccagtggtgcgccgtctggaatcagcactgagccgtcccagtagccgttgacgtcgtagtggtaggctgtgacgagctggtcgccgccaacccacttggtaccgttaaaaaactgattgttgtcggtaggtgctacgcccgtctggccgtccgttagtgcagtgccttcagcgacactgatcgtgccggtaaaggaatgcagacggtcagtcttgtcgtacgtgtagacgagcacttgctttgcgttttcgtccatagtttacttcctttcttagttgtctgaacgtacgtaagtaaacgacgtgttgataaacttttggtcgctatttgcggttgtccagaaataaaaatcgttcaacaaatcggtattagaagtgttgatgaacgacgcctggttggcaacaaaagccaccggattagtaggcttgatgttgtcagccaagctcataatttttttgccaaaagcaccagtcggcacggttaagttgataatgtagagattcacaactttgaaaccattgaattgcgcataggtacatgcaatgtcactggcacttgcgccattggcaaaagttcccacgtggtctaggtagactctgccatcaacgggcaatttgttgattaaattcgaattgttgttaagcgttgcgagccagtccttctgaccagcggtaatagtagataccggcatttttaagtcctttccaggactggccgatatggttactcagtcatgatgatgccgaagtcgattgacgtgaacgtcatactggtacccgtgatgttagtgaacgccagttgattattaaaagagtagtagttaaccagcagtggataaccgttgttgctgttttgtacgtaggcaaaaccagcaacttttttgccacagcctttgactgtggccggcaactgaattactttacgttcggtttgaccgccaatcgatccagagctgattgacacgttaccgttaatcattagatacttccgtccgccaatcatgccgtagaagtagctgcaaccgttaagcgtgtagccattcatggcggttagccctgtgcttacccagctaccgctatcacggtttgcgagttcgtttaagtcgttgtttaaagtcttaagccagtcctcttggccagcggtaattgttaaaattgccattttatgtcctttctaaggactgaccgtgctagctacgcggcaataatcatactgatgtatgagccaaagttgccgatcgcgaagctgtaaccattggtgatggagatcttaccggtagtggagtcgaattccaagccactagccgaactgctacctaccgtgcctgcctgcgcgaagtaggtagagataggctcgtagatattgctggcaagctggatgatgtccagatgttggttagacgcgatattgctagggatcgtaacgtaccccgcaatctcgacaaccacgcgctttttgctacccacaacctgcgtggctttgcgccaacacagattcttgccgttgcccaagccgtttaaagccgtgataccggccgttgaccaatcggtaaaatcgccaatttgacttagattactgtttaaagtgctaagccagtcctcttgtcccgctcgaatttgtgtgattgccatcagcggtcaccgcctttcacggaaaccgcgctatcagtggggtttaagttaccccccccacgggttacaaatgtagtcataatgctacctcctttttaattccatgccgtagtccggcgccaatctgtccacgtgttagcaaagcgactgcggataaactcgttcgcctcgccgtccacgaagatctgtaccaagttgctagatgtgcccttaaccgacataaacccagctttaccgtttggattgttgctggcacttgtattggcaacgtagtaaaccttgcctggagtgaccagcgtgttaaggtcagcggttgacgtttcagcgttgaagaaactgttaacgtatgcttgcatctggtcagtagtaggcacttgcttattgttgatcaacgtgctgtacgcattaattgtgtcctgcgttgctttaagctgcgacgttaagccggtaaaggctgagccgtttaaaatattgttaagctgcgacttaacttcgttggccttgctttggacttcagccactgccttgtccatctcggactgataaggcgtggcattgacgcccatctcaaccatgttaggcaagacatgcagccaaacgttgaccgttgataccgcgcctttgctgtcctgcacgtaaaagtaggtgctgtccttgtcccaatcgccctcatgcttgaacatgccggccgggaagtagtacgtaacccgtcccgtttgagcattgtcgccaggctgatcagtgtcagcccaaccaacggcacgatataagtcgccaaccgggtctttgccggaaaaaccgaccgaccggttgtctttagttaggtcgtatggcaatccattggctttaatccaaagcttgcagaaagcccggctgtcaccgactcggccttgaaaattcttggtcaggtcgattagcgttgtgccgggctttaagatgtcaagctcgacatactcgttaactgccattgttcccctcctttacatatacatacggttttacgtaatcaaaaagccggtctaacgtatcgttagccgacttgaaatcgttgtttaagttgttcagcagctcatcgtttagcgacaaactgttaggaatccagagcgatacagtgctcgtcagctcgccggtttgctgatcaatcaacgagtgatagttgtagcacgcaacaacgctgttaaccgctgtctgcacgtcctgcattaggtgcttaagccaaatgtaggcgttacgattgatcagctcgtctgacaagtctggcaccgtgtatttaggcacgtcagtatccataaaaacgccattgacggcatttaacagccaagacgctttattataaacgtgctgtacacaagtacgatacgagcttgtcagcgtggttaaatcgctcatgagcatatagcctttttgatagtccatgtgctcacctcgctatgtccacaaggtggtttgacgccaagcagtccatgtaccatctgacagccacgaacgaacgtaaagctcgttgttgtgagtgtcatgcagaaactgtgtgccgttagtgccagtagtacttgcaaccacaatcatgttggcgtacgtctggccggacaaaggactatgcgtcaacgtttgcccgttggtgtagtagtagccattggacttaacgttgtttaggtcagccgtgcttaggttactcgtagcaattgagccagggtcacctttaggcccttgaatgccctggataccctgctcacctcgtgcaccggttgccccagtctcacctttcggaccttttggcccttgaattccttgcggtccttgtgcaagcagcatccagtattcttggtcggtcacgtcttcgccatcattagcccgtacgcaaacatagctgcggttgccgttggatacaatatcgagcacgtggtagtcagtattgagttgaaactcgccacgtgcatgtacagtgttagccatctagtcaccacctttcgctagctccattgagtcgtctgacgccatgccgtccaggcgccgttatgcttattgcggatataaagattgtccgacaccgtgtgcatggtctgcataatgattccaccggcattaatgaccttgagcaggccagtctcgccatttggcttaccgttaacactcgctgaattgacgccatagtatccagacgttgttagtccatcacacgtgccagaagtaaccgccgtaaccgcaaacgggtctgtcaaaacgtcgttagggtcttcaaccgtcatatgccagtgaccatcacttttgctgatgtacggcttatagcttttgccggacataccggttgcaccagtagtcccctgctcgccttgtatgccttgcgggccttgtgcaccttgaaccccttgcttgccttgtggaccttgaacaccttgtgcaccagacatatcagtaaccagtgacgccttaccgccagtccatacaaacaatttggcgttgtctgcgtcatttacggttgagtcgataattgcaaagtcgccttcgctcaaatcgtttggcccgttagcgttaagcagcgctacggttgcataggtcttcttaatgctgaaaggcttgccggccggcccttgaataccttgcgggccttgaatgccttgcttaccctgcgggccttgaataccctgtgcaccagtggcgccggtatcccccttaggacctttatcgcctttcggcccttgagctacgacgcccaagtcaatgtcagttgttgccaatttctcatcacctttctatgaccagaatgttccttgacgccaagctgtccaggtaccatcataacgattgcgtacgtagacttcgttatggtaatcgctgtagtaagtctgtacgatcatacggccggcaaccttaacatctagcagaccccagttgccttgatcagggccgttcttaccttgataacttggcgagattcgtatgtcatagtggccctcagatatcagattgttaaagtcggtcgacgtatcagagatggtgccattaaacgtgctgggtatgcttggcttgcccgagatgttagcccacgtcaggtcagactttgtagccacattaggtttacctgagatgttcgaccaggttaggtcgctgacatacgcgatcttatcccacgtgctccagccaccactaccgttatctcggtggctacgatagtagagatgttcattagcgctgctggtaccagaccaaccaagcagcagttgtccagcacctgttccggctacgttaagcacgttgccgtatggcaccggataaccgttgttgtagacctgtgacattgatacaccacttgtgcgtggcagaccagagtacgtcgagttgttagtcgtaccagatgccgttgcggcgtagttgcctaagtctttcaacgtatcagcattacttggcccagccggtccagtagcgccagtctcacctttcggcccctgtggtccttgtacaccttgaataccctgcttgccttgcggtccctggataccctgtgggccttgtactccagtatcacccttattgccctttggtatggtaaatccagacgacaacccagtaaccgtacaactcgttgagctgagcgaagtgatacgccagaaaccaatgtcaacgccattaccgttggggtactggtcaaacacaatgtcgccaaccttagcgatatcgctaggctgtaggtttgagcgagcaaaggtagctgtttgaccgctagcaccattgccggatatgtcaccgttgtacttgatgatatttgcccccgttggtccagccggtccagtagcaccttgcggacctgttggaccggtattgccttgtgggcctcgtgcaccggttgctccggtttcgcctttggggccttgtgggccacgcgctaccacgcccaagtcaatatcttgtgttgtcactcactcacctcctaactccattgcgtcgttaaccgccatgctgtccatgtgccattgtgacgggtacgggtatagcagtcggcagtcgcactatcaatgtacgtctgccatacttcgttgctattggccctaatcgtcagcagaccgctagttgacggtacgttgataaccgtgccgtcgatgcgataactgtcgtccatcgtaaggtcgttggcgttgccctgcgtgatcacaccaacgatagctggcatgtcaacgctattgatcagccggatatgccagtgtttgtcgtccgcaatgtaaggctgccacgtttgaccatccttgccggcagaaccatctttgccaggtgcaccatctgcgcctttcagcgacgcaagccattgtgactgtgtgccactgtagccattggctacggcaacttcatacgccgacttgccgtcagctccagcatcgcctttctcacctttgatcgtgccgaccttaggcttgatcagcgtccacatgttgtcgccgtcagcgttgttaaacaaaaaagcacccgtaggtgccaacttaggaattttatttttcccgtctgggctggcaaccagcatctcaccaccctgtagctcggtggtgctatgatcaaatccgacaaaagcgccaggcttgatcgtgtagttgccgttcgggtcggttggctcaacaatcgtgctgtccggcgttttgatcagcttgccggcaatgtcaacgtccttgtccagcgcgcttgtgtagctgcctagaccagtcttgctgtcatactgccacatgtcggcattgcttggctgactactgccccacgccgcaatccaacggtacacgccctgcttaacgagtgtcgcgttgtcaaacttagcgtagttgcttaacgagcagtacaggccggtgttccagccatagcccgcccaccgcttgcggaacgactcgaaaatgcttggccatgagccggcaatcgtgccttccatgtccaggaagtagtacacgttcggctggatgtttaggctcttggcattgttgaccgagtattgcagttcgccgtctacgccctcgtagtagtgatagacatggacaatcagcccagctttggtcgcgttggcaatgtggtctgctgcgtgctcatcacgcgttacgccatgaccgatacgcacgacaaccgctttgacgccattagctttcaggttggcccagtcgatactagttggctgccactccgatacgtcaactacgtttgctgttgtcaaatgccttcacctccgtttcgttccaagcgctgtttgaatcatccctgttattgctgctaatgatcaatgatttagtctgctcttgcagtttggacagattagtctgctgtgaccgctgaaaatcaagaatgttagcagcattgctgtttagcgtgactgtagacgactgcgtatggctgtatggatatttctgatatccaaccaagccaactttggtaacatagtcagccggccgaatctccagccgtaccatatcgccctcgacaatctctttgccagggtcaaccgtaagctgtagcgtaaagtctgggttggctttgaattgcgactcagcataagctttcatctgttccttgtcagtgatggtgtcgctggtaatgtcatccccaacgaacagtccccaacgctgacggctggcttcgtcgacaaaataaaaaggagcaaagtagtactgctccttagaatcggttgtagatgccgttccatcatcatcaccgctggatgaaccgccggcaacgattttggccatatcatcatttcgcccccaccatgtcggcggatagtaactgataggctctgttttgcacacctcaccaggttgtggttcataaatcatcgtgttgttatccagtgccaaacagatgtgatgactagcaccctttgatccatagaagcccatgtcaccagtctgcacttgatcacggctaatctcgtgaccataggattccatcgctaccgtataggccgggatgttgatcccaaaatcatagtagactctgctgacaaagctcgagcagtccatgccgttgtacggattggcagtgccaaccggtcggccatagccatatttatacgggacaccaagatacttcttggcgtcagcgataacgctttgagcaccaccgctggcagtcagtgatccattaggcaacccggtatcactggtagtctggatttcctgcgtcgctccaaccagacgggctgcgtttgacatgtctgtcgtgtcatactgcagctggacttccgaagtatcacgcagatagtcatagcggtggccatagtctttgtaaaactcgtcatgcgagtagatacgcagattaaggttatctggccaaaagaccgctgacgaccacgcccccaaaatccggctgatagcgtccttgccagaaccggctgcataaggattttcaaccattgcattgttgaaactgccgattacctggtaagtaacgttccagttcttgccattgtcaccgccaaaaaaggcattaaggatatcgcccggagacaccgactgagcgaccgtgtcagtattatttggcacgtctagggatgcgttgctgttgccagtatgcgagtactgtccccagtcaaccggatcactcccgtagatatgcatacggctgatttcgccggagatatgctgcagagtaacagctgtcgtaccaataccgccagagtagtccggctcgcactgtttgatgacaaaccactgcccgtcaatctcaaccatgttctgcacggtcagcatttgataggcaacggactcgtcatcccaagccgtaaagtacgcttggtacgtattgttgacttcccaactgatatagatgctgtcttccagtgccgagcggagcatggcgatctgatcatcaccatcaggcaccttcagagcatgatctttggtagcggctacctttaagactgcgctcatgacagatagatgaacggaaagctgaacgtgatgtccacgctgccggctccttcggcagcaaagctgttccatccagggttcaatgatatcgttccgtaatcagtcttggtgttggcaagattgccgtccagataagtattgacgccatcaagcacaaccgtatggctgccatcgttagactgcgtgtactgccagctagtgccagtggtcttgttagtaagcttaattgagttgccactaaacctacatgagattttgatatcatggcgctgatagtacgggtcaaccgcaatatcactggcgttgtagacgttaaagcttgccgaagtaaaatgatagctcggcaaaggcacgggcagattcataccgaactgccagccgtcagccacgctaggcaacgaatcactccgatatagcgagtagcgataaccgttcggtacgtcaaacggaattgaaaagttggcgtcattagaccctggggtaatcggcgcgatatcaaatggtgttgggatgccaaagtataccttgcctggactggtgtcagtccgtacccgaaccagcttgcgcgagccaaacaatcgatacagctcatgcttagccaataccagatcatcatatccgccaaagctgagccaaaatttctcgctgaacgtccttttagcgaaagtctggccggcaaatggcgagccatcagtgccagtcgtgtcttggtactgattagtaaattgtggcgacgagctggcatcgtccaatccgagataacgcagtccgggtatctggtcgcagagattgatttcatgctgatcgccaaccttgatcatgatatatggatccgacatctgctcatcccctttctagaatcctaattgacgcatacgcgcgtcttttgcttcctttttgtacagttgttgcatatcaagactgccttgtgctttgatcgcgtctacctgatcgccgcttagacgcaacaaaatatcaaacttggacagtaactcgtctaacttgtggctcagagcgtctgattggcgatcatttccgccgacgtattgagcattatggctcaaagtaggatcatcgttgcggaatctggtaacgatctcgccaagcagctgatatgcacgtgaccgtctgctgatgtcggtcgggatgacatattctggcatgttcttttctgcgatctcgtaaacgccatggttagagatcaaaccaccattagcccagccgtgaccttgaccaacgttgccccagccaccttcaccgccatgttccaaagcgttgatagcagctaagatctggtcatatccattaaggatttgcttgtggccaggaattgcccagtggttaaaagtacttagaataaactgcaacagcccttgtgcaggattgccgtttgccatgttaatgtcccagaccttttgtggaacagttggattaccgccagactcggtctggatctgttttaacagtttggaaacctttgtggcggtggcctcaacccccaaagttttgaaggctttgatgatataaggccgccaacgctcgacaccggcaccacctggattggcaagcgtctcaaactgtttcttgatccagttgcccatctgcttagcgatataaaccggcacgtccttaaccagctctgcagcaaacttaaccggcgtgctgacatggacaaatttttggaaaacagattccatgaattcgaccggctttgacatgattttgtcgaccatgcctaaaacatcatcagttgcatccccaactttgctgagtagcgagctgaaagcattgcccacaccgtctgcataatgtgggatcatcccgaacatgcgcgacagctgatagttccgttcgccatcaagcacgctggtaccctttggcaatggcagaatcaagttacgcttagccgggaacatcccaacttggccatctttggtcataaacatctcacggtagtgtgccgtcaagccgtcattaactttggcaaaaccgccaggatgagtgtcattggtaccgttggcatagcttggcatcgagatactgaaatctccgccaatcttagagccaccgactttatccaaaatccagttgatgccgcctttgacgtcatcgatcatggtcttaaatggcttaagtacaccatttaccagatcgacaaagtggcgatgcacactgccaactgcattgctaaccgcgtcttggatcttgccgaaaatgtcctgccaaatcttaagcatgtcgcctaagcgaccgcccgtcatgtcattcagcttgttgtacatatcggaaaaaatcttgcggttgaacttaaacatgtcctgtgcagtacgttcagtgtcctcgcctaagcgatcccaacgccccgaaaccagatcatgccaagtagtggtctgatcctgaataaccttatagccagcttggaacgtagacttatgcttgttaaacatctgctgagccgaccgtacagtctcactgcttagcttgtcccatccacgttttacgtcgttgattccatcaccggtctttttcttcagatctttccaaccatcagcaaagctctttttagttgagttccaccagttgccgatttctttgttggtttccttggttcgttttgaaataagcgtgccaaggtccttaaaggctttgccaaaatctttggcgaacttgccaatctgtttgtggtacttaatgaccagtgcaagcgcgatttcgattgcaatcatccaagggtttaacccaagcgtggccaccttgagcacacgagcaaaaagcccgattcctttaatcagagcatcaaggccggacattgctttggtaaagacaaatgctgctgcaacagctttagcaaagccaactaccatcgtcttatgttttgagcaatacacagcaaagttgacaactgccattgagagcttgccaaggtccttggctaggtctgcaaatgcctttttagtggactttttgctgaatgcttctgccaaggttgctgatgccttagaaattgctggtagaagtgcctggccaacctcaatctggattgcttgcgaggcgtacttaaatcggtcctgagcgctcttagcagatttcatattgcgcagagccaatttgccaatatagtcttcgttgtaagctgtcttaaccttaccttcgacttcatccaggtctttaagattgtcagacaagataaccgcagctgactgtgccgactggccgaatgcctggttaaagactttcagtcggtctgccttaggaaccttcttgttaatctgatcaaaaatttctggaatcgatttgagcttcccagacttagtcttgaagtcgtccatcgacaatccgtactctttaaatgcctttgttgcgctctgagagccactggacagacgtacgataatccgttgcaggctggtaccggcttgtgatgcttccaaacccttgtcggataactcgccaagcgtagatgcagtatctttcattgagataccagcgcctttggccgtaccaccggcatactgcatagcgataccaattttagaaaagtcggtagacgtaacgtcagctgctttggctaagatgtttgccgtataagacgtggcttgcatcatcttattggcattgtcggacttcatcccgaaagcttccagagttgaggtcgtgacttccatcgtgtcgtcaaagtcatccccagaagccttagccgcttgcaacagttttggcatagcgcctaaagccatctggctgtcatacccacgtttgatcagtgtttgatagccttctgcgatctgctgttgcgaaacgccgtacttaactgacaggttagagccatcggcatacatctgattgattgccttctggacatctttatgcttttcgccggcagtggtcatcaagttagtgttggtaacatacgtatgctgtatgtcttcagccttcttagcgccgtcaaccgtatatgccgtgaaagcaccgacagcaactcccgcagctataaccccgcttttaacagaatcccagaaactgtttacctgacctttaagccggtccagtcttggctgaatctgctcagtgtggtcacgcattctgacgattgcattatctacacgagcaatgccggtaggctcaagggatgcctcttcaactcgcagctgttttagctcatcttgggccttggcaattgacgttgcagtctggtctaaccgctgtttctgtttgagataagcgtcagacgcttccccagaacgattcttgatatcctcaagcattctggcctggatcttatactgctgttgcaagttttccaggccagaagccagttgatgatagcgtgcaaccgtttcagacgcggtgcgatgttcggccgccatacggtcaacgtaggcttgtgatgccgattgtgccaacttgtacttggactgcaagtctgataagccggatgcttgatactcataggctgctttagcacgctgagcttgagcttcgtagctggctaattgacggttggcttgattaatctgcttttcaagtttcagccactggttggcctgtttctcgttagactgatcaagaccattttgacgactgcgcagttcttcaatcttggcacgctgcagttccattgcctgagtaaggccatcaagctttaccttagccgcctgcgtatagtcgccgctgttttttaaggctatttcttgagccttccaggcattggtcgttgccgtgattgcgttccgaaaggcggacatgcttccaacagcagaaaccgtgtcaaccgaaattcgcgtggccagttcattctgtactttcaagctatccacctccaaacatcttagataattgcgcatgcgcgtcctctgggttcattggcctatcatcccttgaccgcgcattcaaagtttccaacagttccaaataattttggtcatccaaatcatctggtaaaacaccactattaagcatcaactgctgcttaaggtaattgatgtcttctatttcttgtttgagttcccagattcttttgcggatttctccgcttccgattttggggattcatctacagttttcagtgcttcttgcgcctctttttcgctgacgccagacgtacgactgcgcaagtaagacagataagctccgatttctttttcggtgacattgtcccaaatacggtcttcgtcaatatgcagcaattgtgcgataaatttaattgcaccatcgataaattcagcttcctgatcaatgacttctacaaatttcccttgtgcatcattgtcgtcagcgggagtttcactcgtagtcagggatgcttctagcgcttgtttcataaactggttaagtttgtacgtcactcgaacagttggcttaaccgcaattggctgtttaatgccaaacagggatgcatctactttaattttttccatttcttgacacctcgtattagccgccccattggtactgtgtatttactaggcgactttaaattttttagtcatgagcaacagcgctaccagaagcagtggtttggccatgcttcgtaatatcgtcaccggcatagccaccgaatacttccttaagcatagctgcagcgctgtatccagttgctccactgttccattgtttgtatggttgttgcgtacccttagagttgacaaaggcagtgtcatcaatcggcgtcaaagcttgataggtaaatgcagcgttagcgtcagtttcgtttttgttgttggtaccatgattacgatttggcatgatcatttcaccgttcgcgaaaccgtcaaaatacttgttacccttaaaatcgtcagagcagatcagcattgctacgtgtggcttatcacctaaagtggcaccacccgttgcgtccaattcatagccattacatttcatggcaatttcgtaaggcaaatccaggtaagtaatagctacttgtggagttggcgtaccatgagcgttacgcttaactttgttgttagcgtattgttgcgtacctgcttcttcaatgttagtgatattggcagtcgtagcaccttcgccatcgccgtccaacagcactacaccagactcagagagtccctttttagcgtcagcaataatttttccagtatcgccaatcatcgccaatgcgatccaattgataccggaagtggaaacacctgcggacatttaattcccctccttgataatttcatcctttgcaaaataaaagaccttcgtcacttgcttagtgtcggggtcttttatgtgatttttcgattgttcgacagtccaattatcgtcaacaaacagccgtgctagtgcctgttcgccatctagcgtgctgacatcgttgtcaagcttgtagaatatctgaatttccacaccgaccgtccatcccttgaaagtatggttggcatagtaggtaggctcgttcagccattcagtaatcaagcagatcgtcttgccttcataatcggactcttcttctgggattgaatcagtataaatctcatcaatccagtcaaatttgccattgatcagatctagcgcttgaaaaactggcagttccatcatttgacaccgccatttcttgcgtcaagaacctttttctctgctgcgaaaaccttatcagccgaatcacgacgcgcgttgtcagcaaagtgagtggccttcatcttaacagttccatcatttaggaatctggcgatataggctttttggccaaagccgacaacggaattgccgtcatcttcgccgtcaatgtcagtattttgaaaaccaacattgtcttgcaggtggccatactttggatttttcttattcgagcgtggggttgttttacgtaactcatctgctaaaacttttgctccagcagcagtcatcgctttccttgtagcatgatcaggaatggcaaacttttcggcattcttgccaaatacctctagcatcttaccgagatcatccattagtagcaccagctttcttagtatccttaagcgttagcaggtcataacgcgtagtcgtatggctctcatccctagatatggtcaagatgtcatagatcgtactgtcgcccttgaatctcaccttgagctgtttgtcaacgtgatactgagagcggacagctactaccattgtatctgccaacgccgtcccaaccaaagcatactgttgtgattgagaccgctgatagattgcgcagtgcagagtttgagtcagcacaaacttttgacgcgaaccgcctaatgtcctgctaggaacggttgataccgtccctaactcaattacatgattaagacggctgattggtagcttcatcttggctcgcctcccaaacgtcgtatcgtccacgcaactgtccaatgatgctgttaacggtcagatcaatctcgtatgtctggatatccgacatgctgaggcggtattggtagtaggtagctgcaagcgactttaccgccatatcaaataatggtaagacgttgctctgcgtgtagaacgcattcccatcaccaatcgcgcctttaacgtactgctcagctgtatcaatgtaggcctgcagcagtacgtcatcatccgttccgtcaaggtacagcaccttttttacatcgtctactgatacagccatttaaatcgcctacttgccaacgccagtgcctgcagaagcttggaagttagccggttggtcagcaattgtcgtaaatgagccgaccgcgtatgcatcgccatcgacttgttcaacgtcaaaacggtcaatgacacggatcttggtttggtcatgctcgtaagcaccggcaccaatgttagttgccaacaggctcatattttcacggtcaaacagcgtgatagcctgcttaaagtcgccgtagtacagcggatgagcgctggatacgtctgggagccagcggtcagcgactaccgtgactggcttgccaccaatacgatagatttctgggctggttgggtcgcgttgtaccaggtagttgcccattgcgttcttaaccttggcaagaacggcaaaaccagattggttggtcaagaacgatgacgtagcgttgattgctgggtcaagtgcggtcagttccaggttcttgatgtcgtcaaacttagcaatcgttggcttcttagatgccttattcataactgccagaatagcttggttacgagtaacgacaaccttgcgggcaatccaagtagacagccaagcgatgatattttcagccgtgtctttcagcagcgtattagttacggtcgtgataccagcgtaacgcttgattaggtacttaatcgtagtcagttctggatcattgttgtcaccaattgcagccgtttcatcatccagtgacgccagcggctcgatgtcggcgaacttttcgtaaacccgcgaaccagattcggtcgttacagattccacacgaatcaagtcctgcagagacgcatattggcgtaccaaagtattgatagtcgtacggatatcatctgggatcgtcaagccaccgttgccagtgccagacgtacccgtagtaaccatatccttgaattccttgacaaacttgtctttcatcgacaattggctgtcagtcaacggctttttgtcttcatcgtgcatcttaactacttctgcggcgcgagcctcgttaagttggtctttcagagcatcgcgacgcgccttagcatggtcgcgtcgtcccttcaaatctgcaaaagtggcttgatcgaaagagtcgtccatcagagcgacgttaagcttttcgttcagatcagaaaccttttggccggcttcaatccaagcgttgttcagttcattgattcccatgttgggcctcctttttgtctaataaaatagccagcttctcatcataaacagacggagctggcttttcttctggctttggctgttcagccttggccataagcgtcatgaatttgttgattgcagcgcgcgaagggatactgtggacagcattgaccacttgtggctgattttcgtcagcaaacatgattttgtcggcaaagcccttatcaacggcatctttagccgtcatccaagtttcgtttgccatcagtttttcgatttcatcccgctttaagccggttttggcttcgtaagcgttgataatcgtttggtcaacggtatccatcatcttggaatcatggtcgagatcgtcggcattgccttgcgttacggtccatgccttatggatcatcatctgcgcggttggcgacatgttgatctcatcaccagccattgcgataaccgatgcagcactagcggctaggcccagcacgttaaccgtaactttgcctggatagtcacgcagcatcgtatagatttcagacgctgcgtgtacgtccccacctggcgatgcaatgtccaccaccaaatcatcatcggcatctgctagcgtccgttcaaccgcctgaggataggcggaatctagatcaaaccagctgtaaaatttgccggtcatattgtcgacaacgtcacctttaatgttaatcttggtcatcgttctcacctcccttctctgcattatcagctcgtggaagcttttccggtaaatacccggattgttcaagcacgtaagcagcctgattgcctgccagagtccccgatttaaccatcgatgaaatcgtgccggcaaacgtatcaccaagcggatcaacagccggtcgcaggtccagtttgacgttgccagtcagcttgttgctgagctcgctgtcaattgctttagcaaaacggctcagcgacttggcatagtcattacccatcatggccaacgatgactgttggtcaccttgaccattgataaccgagtcagatacaccgtataccttggcaatctgtgcaccagtccaattggcttgattcagcagttgagcaacgtttccctggatttccaaaggctggtagtcttccaaatcgtcaagtacgatcggcccactccccgacgcctgcatctgctgcataaacttctgcgagcgttgagctttttccttagcgttgagcaacccgcctttctggatctttaaaatcccaggcgcagaaattgattgcgcaagtgctgagagagtcagccgattgcttgccttgctgatactcagctcattagccagagctgacagtggactaatgccagtcttaccgccatttttggacaaaagccgaatatggatcatgtcagactgtggtatggcctcaacaacgccaacgcttggctcatcaaacgtaaccgtatagatcagcccagagccgtcttcaagcaaatatggcgatacctgcgatggccttaaatactcccaataactatcaatgccattgttattgcgccagcggtaggcaaaacactcaccgccaagtagcagttgagcaaacatcgactgccagaaagcatgcgcgttgctggtgacggtaggattgtcaagcatcccttgcgtccgcgacttttcggcaacaaatcgaccatttgccaggtcagagcttagctgaaagatcagtgagtagacgtcagagttatgcagagcagttgacgcatccacataatcgcttgagccgtttggattgaggaaattgataatgctttgatcatccgcgatcgataaaacagagttagctttatttatcagtttaaaaattggcattcaatcacctcctttcagctcgcaatcatctcggtaatcagtccaaccataatcagcgcaataccgacagcaaaaatgccagcagtgatgctcaatctgaaaaagccccagacgataaaaaacgctgcggctaaaaaacataaaacatcaatatatttccagataaatttcagcataggccacctccattacagcaagccggagtcttcgttctcaaaccaggctttaacctgctcactggtcatcagttcgacctgctttgatttgtcgttagcaatcccaaagtcttcaaagtgatacatagcttgatagagagcatcaataattgcgtccacaacatcgattttcagcgttgctttggctttgtcgacctggatgccaatcttgtcctggataatttcggcgttaacaagtgctttttccatgatttcatcatcatcacgcgtgattgacgactcaacaaagcccttctgcaggaacttagtcgggtctttcagctcactggtacgctgccgaaccgggttcaacggccattcagtgttgatttccatctgtttgatcgcattggttgctccccatgcgtcatagccaaaaaacaggaccttgagatcattgtcagcgacaaaatcaagcaaccattgatagacttggtcgtcattgatcaagccttgcggatggctggtgattgtacagtagccttttcttgctaattcccgatactcaatcccgtcttgcttttccttggcctcgattgagccggctttttgccacgggataaagctgtgctgcttgacatgccatttctggttgccgtcagagtcggtgtacgggaatacaaaggcaattgccgtgttgtccgagaacatagaatagtcaaaaccgatgtagacttgttggccacgaaaactaaaatcatctttaactgctcgctcaatgtcggccagtttaagaaacgagttagtagcctcctggagccacatgttcaggttcttgttttgaaaacggtcgatatggccggccattgcctcattgtttcggctattggtcaagcccttgaacagcacttctttttggctgtccaagtaaagcagcgggttcgacttgtaccatgtttccggcttaaaggtttcatcaaggctgtcttgacaccagattagtcccagatagttgtcgccatcacgcttatagtcctgctccatgatcgtttgagccaacttctcatcggcatgatatggcactgtcgggtccggataggccgttgagatctcgatgtattgatgattgggaactttgacttgaccggaagtgatctttgctgagccttcgtcggtgtgaatattgccgatttcgtcaaataccgccgttttgaagtggtatgagtcgtacttccctgagttaaacgtgattggtcggataacgttgttaactttgcgcatcgtaatcttgttgtgcagtacggctaactcaacttccttggcaagctttccaaaaacaggctgctgctcgataattcttggaatcatgctgctgatatagccaaaaagcttaccggtctggtctgcattttcggcagtaacaaggtagtcttggttggataaccccattgactcaatcagatacgtatagcacatgtagatagccatgagataggttttgccttgaccacgtgccaccgaaagtatgcatcggtcaaaccgttttaaatttgactcatcccgccagccgaatagcatgcaaaaaatgaacttctgccagtccattagcggaacaggcacgccggtatcaacgttcggggcaatcgatgcgaatttaaggatcttatggcactctttagcgctgtagtgataatggaaatcagtatcccccacacgttgtaggtctcgcagatgtctaaaagcggctagtttgatcagatagccagtcagaatcttttcatcaagcacgtcaaaggcgtaccgtgtaccagaatcttgatactgtttgcggatatcatcaaagttgatgctgtgataagccccaagcacgtcatgtgtttgcgtcaaatcaatcttcaactataccaaccccgcttctttcatctgatcactgatcgacttctctttcttctggctcgcaatctgcataaggtcctgtctgcccttaggcgtcaggccaagttgaatgccaatcgagttaagctgcttgtttgcatcagtcatgattccgaccgccggattctttcgatatccggtgaaatccttgccgataatctcgccggctgcgttctgcaatgacgtaaacagcttggtttggatgccgttttcttgcacatcagcatacgcctgacgatagatttcgtactgagtgcagtactgttcgaccatgccggcatcaattcgttggacccgttcagtactctccagatatggcactatttttcgccagcatgcagcggcaatcggcccgaaataattaggcggatttggtggcaaatgaccgtgattttgcttaaaaaacacttgttttggcatttttggctctcctttctgcagatttggaacgttccggagcccccctggggtaaaaatttttaaaatcgtatttttgtaagagacggctgaactgtgtgcgctccttttggtagacgattggggggcgggggtaaattttaaaatcagattcgataaaaattcatcaaaaaaatttaaaacgcgcgagagagcaaatatgagcctctcacagcgtcatgagtttggctataacgtccacatcatggattggctcagcgccagctatcaactggttgtctttgccagtaccatagtgccgttgctcccaagctgtcttgagtctgtggcagtcccgacagatggttgccaggttgccattgtctgcctgcaacttgctgtcaaactcgatcggtatgacgtggtcaacggtcttggagtttggcttgccgcagtactggcagacatagtgatcgcgctcgagtacttgcttgcgcagtgactgccattgtcttgatttgtagaagtggtactgtgccgacttggtatcatcacgatatcgcgtgacattgttgtacttgcgctggtactcggtgttatgtgatcgtgcccacttctgccggctggctaggtactcagcctcatgctcatagtgctgtttgcagtagtgatcaggcagttggcacatggcatgacatcctggatatctgcatcgtctaactcttgggattgtgaccacctcctttttgtgcaaaataaaaggcgatagcccaatcactatcgtcttaatcatttaatcttttgtgtattaattcttctaattctttaaaaaattaaattttttgattataaatttagccagcaagtgttggcctgtcggctttatttaatatttagatgtaggcaaaagactgaggcgcactttttaattttttggaaacctcattcaattctagttcttttttatattttacaaaatgcgcaatctcaatggcaaaaccctcttgaacattatgaaagtactcgtcaaaagagtttttactaattcctgagtatttgttagtcaaattccagatagtctgaggattatcttcaataatatttctgatataaaattcgcctacaactttaccaattggttttgttgcatagataacaactgtatttacatttttatttttgaaaattttttttctatattcgaacttttttgtaccatttaatattctttccacatactcaggcttaattgataacaaaattttcattaatgccacctaattctaaaatcttcttaaattgctcattattaagatttatatatccccaataagcctcttgtgaagttggtaatccaacatcttctaacaaagctctccgtataatacgtttctttagtggaaagttatatagcatctttacaatatagggataacgtttcgaaacataaaaatcaaaaagttctttatctgtaaaaattgtacctctaccacaataatccttaaagtctataaaattagtaaagtcttggatagttttaacttcgataactgtacaaatcgaggttgcaactgaattataatatgcatttttcctatcttctgcagttctatatataactaaaaggtctcctttggaaaggtcattaactccactcattcttgtgaggtaaactttttcaatagtattagcaaatgacacatcttccctttgaaaattgctttctgtgttaagccttgaatcaggaaataactgggtatggtatttaggccaaacacttagaagactttctgacttgtcttttattgaaatacgtggaaaatctttatatatatttccagtatatacaagatccttatagtagactaattctttatccttaattccccactccttaaatccaaatttttcaaataggccttttaaaggcgcttgtttaggcaaaaaagttacatatgtaaaatcataattttcgtttatcatttttcttagaataatggtcataaatctctggcctaacactgtcctgtgagcttcaattttaaaagtgcctattttcaagcgtctatgtagagtaaacacaggattaatagtattatcacttgcagtttcatccttgagatatagaaatgcacacaaatcgccagtttctttgtaaagcacatatgcttgagcaccagaattacttttctttttaaaccaattattgaagccatcataatccgatcttaaagaatcaaaaaaactatcattcaaatttatctcactaaaaggaacttcttgaataggatcatttttgtacattgtcatacaactcccataatattatttcactactataatttattttatcaaaaaagagagctcagttgctctcttcagtgaaataatattaggcgtagtttatcgtcattgcggacaaatgatggcctgcagagtcgaactgcagcattccaactatgaaatgaccgtaccgtctgccttcctatgcctaagtcgaaagacaagagagtgaattgcgctactctcaacgcagatgcccggaatcgaaccgagatcagaagctctgccatcgagctatatccgctaccactatgcaattgattatgcaatctgctttaatttatgccatctctggcaacggaagcagcaggattcgaacctgcgaaagtcctttcaaaggctttaccaattaactggcgctttaaaccgctcagccatgcttccacgctgtcgagggctagcctcgatacgttgtcctggcaggtatattgtcgttgataagtaaatgtagaaattaaagccaggaaatggataggtaagggactcgcacccttttttgcgctgcgacatgatagttagaaacgcagtgcccacctgggaccttccagccggtgcgatgacatatcaccggctatgtgctgctgtgtgtcagcacaataccgcatggcggaatcgaaccgtcaagctaggtggaatagctaaccgtttgcggtaccaatttatggagtgatacttgggatccaaaatacaaatttaaggtttcccgttgatacgggaaagcatcgtgtgggagtcgaacccactaaacagccacatttcaagcggtaatttcaggcttaaccaattcatccaatcagaaagaaggtactgtactcatgtagatcatgaacattgattttatttaaggataccggctgccttgcccggtcgatgcataaccagacgccgaagcgcctgttttggaagaagttctaatcaattccagtaggaaagacaccctttgaaaaaaccgagtaattaggcttcgtgatacaatatcactctattattatcgcaccggttagagcctagcagttacctagtttgaccctagaaatcccctagttttgattgcagtaaaataaaaaacgatacactgtacttggaataatgtacggtgtatcgcaatttacatttttgctaatttagcttctagagcctcagttaaagtttgagaaaagttgataccagcatcttcagccttacgtgctacatctcctggaatagtagtatttttctttactttagcaggcttagacttagctttggcttcgtctaaatcaacagcaatcggaataacagttttatctatgtttttgctttgaacggtcttccaatcagatggtttaggtaatttatcgtgcagtaccagaacagcacccaaaacctcagagcccataagaatcgcttctgccattccagtaccactcgtgaatgcttctggaacatctgggaatgatactgtataaattcctttgccattttcactgtcatctagaatagcaggatagacaactgcattctttttgtactttcccataattacactccctaaacatacctttatttctcttaaataatacgcctttatacgtataaagtaaataaaagacgtcaagataattcttggcgccttttgctattagctagcgatgttcttctacctggtgtagaatatgtttgtaagtaccaacgggaattagcgtttttctgctagaatacgcaactgggattaaatttccctttggtccgcgaaacatgtgatggtctccgctgatacggatttcttcgtaatgcaactcacgaagcatcttcacaacatcgcccgctttatgttctaccataggcaggcctcctttctattagaatatctatattatacgcctaacatacgcacgaacaaagcagaacaacaaaaaaccggcataaactgtcggtttttttgctataaaaatatctgtaatggcggaaccaggccacgattaaccttgtacaaatcaattgcatattccatgcattgagcaaattgataacaggctcgcttatcaagattcgaccaggttgcgttgcctgaaatatgcagtgcatcccgtacgtttcgaactggctcatttttgatatagtgttgcaccagaatatcacggcacatacggtcacatccctctaatgcatggttaactgcttgaacggctcttaaacactcagcatgtttgataaaacgctgctcaactccattatcaataccgctaccaccaccagttgcgctgagagctggcgatttcagttctccccacgctccagacatccgtttcagttcttgataattatagccatcataacattctcgatcgctaaaaaaggacttaacggcctgtaccgttgctgcacggtcaatgggacggaattcactgtcatttatcgtctgctgctgaaccacaatgccactctcctctgctataattgatggtgttgattcattagagggtcgtgccatcatggttcggctcttttttactgccatgctgattgcctaaagaaagaacaggctcagcatgaagcagatgaacctgacagcggtgttgtggaccgtcataatcatggcaatcgtaattgatgcgatagctgcgtacttaaatccaaccaccatcgttcccaataccatttccttacgcatatctatcctcccaacacgtgtgctagcaacacaatcacgactgcccaaaacagcaggcaagccattaccgtcatccctaatccattccactttcttttcattgtggtcacctgtataacgttggctttcgcagcatatcaaaccttgccccgattctcggcagcttctttgatacgtagctctgcccgtcctggtatacctcatctagcatgaccgtttcgttaatgtgattagcttcaatgatcaggtacagttttgagtcaccaagtgtcactgctctgctgttacggaatgcccgctcaacctctttgctttccatctctttctccttccagtaattcttctactttgtaatcaattgaagttttgatgtcgtagtagtccttgacgatcgtcccgtcacgcttgatgcgctgatgcatcggctgtgttttggtggtcgtgcctaagatcttgactttaaagtagcttctgagtggtgtcaccgcctcaaccggaacgccgtacttgcgccagaacagcttaaatcttagctgtgcactcgcgtcggttgctcgataggcaattcccgttttaacgtcgtaaacgtgctctatggacccgtcaacaccatacacaacaaagtcaggccgatagtaaattccgccaacacggacttcgccggcattatagattggcaacaactcgtactggggatgcacctggtacttcttaccgcagctcttgatataagctgcgtagaaagacgcctcttttcttgagtcaaacgtgtaaccgtccagcttaaccttcttgccatagtagtttttcaatctttcagttcctttccacacaccgggcagtacttgatgcgattagactgaccgacgctgatcacactttcgccacatttgaccttcgccatcgcatcgagctgcgtgtggttgatgatcttaaccgtcacaccgatgccgtcaaaccggcaggacagcagtgctttatgtttttcgcaaaattcacacattttcatactccctgtagatgaccaacgccgtgcagcataactgattgtcttcctcgataaaatcagtcgacagtttgacgtccataacgatatagtcgggatgtttgtctagccaacgattgatctgcacgctgggatcaatatcgttgaccagatcggtaaacatttttgtcttgaccatcgcgtgcctccttaaacagaacgtttttgtctttcgtgtacacgtccatgtatgtttcgttgagattgccattataggtaaactcgaagtagtagtccttgtcgttgtatctgcccggtgctgcaagcatggccttgtgattctgcagagccttagcttgccacacgacaaacacgttttccggcttgcaggccgtttcctttccgaccagcttgttgagatagtcagatacgcgccatttgcacttgttgataaattcttgattagtcacggtcaaacacatcctctgcttcttcggccagatcaagcgcatcatctgcgatatcgtgcaactgcataatgtagtcaaaatcaaattcgtcattatcatagtaaccataggcatcgtctagcgtgtccatgtctcccaacagtttgttgagcttttctttgtattcttttttagtcatgatgttcactcccatatcgtgattcgaccatgcagacaaaatattcttgcctgcagataatcgtcttagtgttggataatttcttagccgttgttcctacaatgtttttgattttaaaaaaaaccgtcttcaatcttcagagtgtcgtttggagtaacccacttttgtgggcagggtttgatgcctggtatctgtgtgtagatgtcatagtacttagccatgatgttcctccaaatcaaaaatcagctccgctaactcgtaccaatacgtagataaagctccgtctacacggttcatcctccaaagcacctcatcatcaacagtccgttctttaagctgtttgtagattaaggattccagctcgtcgagatcgtgtttggcttcatctcgccttttcttcagttcttctaaattcataacgtttctccaaaatctttgcgcatctccaaatttctaatccgcatatcaagaacgttcttgtatccctgcataaacaaccgctggcggttcagcaagttaagctgcagatcactgaccgtctgctcctttttctgatcgtctaaaaataaaatcagcttatctaagcgaaactttagctcagctcgttcttgattgagccgttcgataatatcaacattcatgtcattcatcgcctttttgtacaagcgaccgccacaaattggacagtatggaaatggaatccgattgcgttctttactttccatgttgtgcaaatcaatgtctttatactttccagtttcaagattgattctctcagtgattgagaccaaatctttatcgtcgttagcactcataaaggtatagtgtcctccgctttttaatgggcagccatccctgtggcccggtttgctgatttcgcgcccaagccggttcaattcgtccagtaagtcaaagacaacgctatcggcgttgtttagcagcaataagagccttaacatggcgccggcgtcttctgggttaccgccattcagctcgtttgtgtaggcatcaaaaaatccaaatgcctgatcaacgattgattttttgacgtgtggatactctttgtagtgacgttcgttgttttccattgtgttagtcctccgtcttattcccttggttgatcatcgattttgttgctcctcgaccagtgcaaatattgccatttcagcttgcagcaatcttgccaagtgctcgctttgcaattcgccatcattttccaagtagtcataccgttcagcaatgttgtccataatccactgtgcactgatagttccgaaactgttcatcaattggaaataaggcgagaatccagaacaataaaggccgtcaacaaggtaaaccgtaatttcatggtcgttgttgtcgagaaagcgtgtcgtgactctcgtgccttttctaacattttcgttatcggtaattggtgaccgtgatttaaagattttggttggcgtttcacatgaaataaaactggcaattgttagcttttcatcactttcgtcaatctcgtacttcttggctttgtaccaacaaatgcaccgcataatgtcgctgtcatcaagcgtgtaaagatgttgaccttgagcgtacagttctaggaaatcgcccaggttctcagccttgctgaatgctcgttcgcattgctctctaagcacgttctcagcctccttttcaatcgtgtttaggctcgtccgtcaggtcgtttttctgtatctcatccagcagttctttatccatcatgctgtcatcgcgttctggctcttctgccacatagtagaagcctttctcatcaggaacgccatactcgccggcagctgctgaaacatgaattcgattgtggcaaacacgacagcagatatgtttgtatccatacggaatctctcgcgtgtatgattcgccgcaaaatggacacattacttttgccttcaccggttcacgccatcctggaacgtcagcgtagttgatgtggcgttcttgatttttatcaaccggcgtgattgtaaggccatagtttgctgactcatccccagtcagtaccttgctcgccaatgccagaaaggcagttcctgttgccatatcaaactgttttggcgtttccagttgcagtcgtgtcccgttgttttcaaatgaaagcttcatgttagtcgttctcctttttgttcttatcagctcccgcgtcgacttcagctttggtgtaagtccacgaatccacgtgatcatcaaccgctacaagcgtgatgtacttagggttgatcagcagcgttgagcaattattgaagctcgggtccactgacatgatcacgttgtccgtctgatacagcttgtgctccttaaggcaagcttgaatcttgatacattccttccgcacatccgcagtccagatggtccatgtctgctcacctgcgccaggaatcatggcgtaaatatcaatttttgtcatgtttgttctccttacttaaatcttgtaaatcgggatgttaggaatctctcggttcttggcatcccttttcttcttctgcaatgcttgccagtcgtgcatcgtatagatgttctgtcctagccagtcatcaaggatcgtcttcagatagccatatggagtattaggctccgcgatctttgtcaggtcgattgctttatggatgactttgtcagacatcccctgatgcttaacgtctagtagcagacgttcaatcttcccagtcatggcacccaagctgtctggccatgcaacaagaggaagtttttctgtttgtcgagaggggcttaatacatctctctctttattaatacttgtaatattatctttcgcttttccgtggggaggggtagtcatttttgcgggggtaccccctccgtttttccgtggggagggggtaccgctaacgatcggattactcagcggatatagtcgccgttctttaacctgcttggtattcgggtagcagataatctctctgtagagatacccacactcaacgagcgttgatatccatttagatatcgtcttctcgttgatgtcataaagctcggcaaagtaagcgttacgggcaatacaatatccatatttattgctcagagctgtgatttcgctgtacagctcacgagcattgggcttgccaagccgtttgtcgtacctgacatttgccggcaggatagagtagtatgacggggtctcaaccatcacgctcactcctttctccgttttctaatcaagcttcgtgcgtcaatcaacggctcctgcgccttctctagcaagccgattgcaatcgctatggcagaaacggcttcatcatcattattggctgcatacgcacgatctaatgcactcgcaatatctcctagttgttcaaaagcaatgtcaacgaacattttttcgttcggtgtcagcatggtataatcactccgtaatcaattttgattttggcgtaactagtggcggctagttgcgctttttttatccgttgaaacagtaatttgccatgcgaacatggcgatccaggtcaacgcaaaccagttgccccagattacgtgtccagacatctcagcgtaagtaaaacccacgccaagcagcgtccatactagtgctcgaatcgttcccatcgtttaacctcctcttccaaccggtcaattcgccggctaagcatcatgtggtcaataaccattgccagcagaatcagtccaccgacaactggtgcgaaaacgtccattcgatatcattcctttctgttacaattggttcattaattaacgaggtgaactaaattgaaagattttcttatttcaaactggacttcaataatcgctacattatctttctttttaagcgttggactagctattgatcgaattttgcaatctcgtcaaagacttaaattaaatcgaatacgaacttattttgttggtcataaatccctatatcttttaataaccattactaataaatcaaacgtccctatcgcaatcgttaatgctgaagtagggaatgtaaaagtgtatagagctcaacactatttcatgcgtagcaacactgatgagcgtaaaaacgttttgacttctctttttcctatacaactaaacgcacacgaaacagttgatctaatcatggaattcgtatctgaaacaaattggattaaagggcctaataatttaaaactaattacatctaaaaaaccgatatctgaagacctcaacctattaaacctagagatcccaaaagagcaagtcctgaaagaagtgccgacaagatataaatgattaacaatttgtctaaatttgaataccaagtgaaaatacgagtaagcaattcttttaacatattctgacctcctaatagatcaattaacctttcgcaattcttttagaagctgtgctaactcttctggtgttagctggctcttttttaatttcttcaaaagatagctgcgaacagcattgaatagttctaaatccatcatcgtacctcctttgctgtccagtcgatctcgtcatggtgctcatgcatccacggcctagcgtatggcagataaatcttagttatcttgccagtaccatgaacttccattacccatgcaccaggctgaccgttttcaacctgaatttctgggaattggtcaaagacatacaaccggacccaactctttgccttgccagcaaataagtccgcccgtatgtcttcaagcttcacccaatccggttctggcttagctctgcctagaatcttcgcgattattggcgcaagctgtttggctagttcaagcaatccttgcttggtcaacttgatttccatcgttatgctcccttcttttcagctgtatacttaattcatctcctaacgaaaggaggtgaaactaatatggatgatgaagttatttgtccttactgcggcagtaatgaagctggtaaactttctcccgcaggggatgcagataaatttctaattgttagtttttcaactaaacgtaatgccgtaactggttctggatgcattgttgaattatatggctgcgcatcttgccataaagtttggatggaagatgattcaattagtgcggaaaagtgatatttttagccattttgttaaaaatctttattgactttttcgctttatttttaggagcttttttaagctcctttttcttttgttccgtcatctctgcttcgttatgagtcatcgctatgctcccttcttttcgtctgcggtttcgattagtggaaggatgctatgccgtttgagcagttcatacaacccaagtcgtcctttctgcgtccatttggtatgcatgacggctttttgagtgccatctgttttagtcaccatgatcgtctctgaatgcgtccaaccagtccgttgatacttgctgtataacagccaagtatcgccttgcttgtaaatgacgcctagatcatgcagcttatgattcattgcctgaccactcatgccataatctttggcaatctgagtgattgtgaccaacgatttattgctcagcaccagatcgtagtagctggctttaggcgtcagctcattgacccgctgttcagcaattgaccggcgctcccgctcagtcttaagctccgttgccagcttgataatcgtgtctggatttagcagcacttcctcaatcttctcgtccgtcatgtatgctccgtgcttgcggattgatggtagaacatcggaagcaacccagtccgtgaacttctcagcattttttgcgtgcgatttgaatgctagtttgtacagaccggcttcactaattacagttactttctgttttcctccaggggtgtctaaaacggacacccctttaaattgttctggaacatgatcacgaatagctttcgctgtctgagaatatcccaggattttggctacatctttaccgacgaaatatggctgtccgctgatggtcaaagttcgcacttgttggccgttgaacttaaataattgtgattgattcattcttatcacccctcaatttaataatttcgcttagtatttgattactttttactaagatttttgcttaaaaagtgcatcaaaaataacacttgggtcaattgcatacaactgagccaaagcgtagatgtttctggagcttggcttgcttaagccctgctcccaagctgagattgttgtctgtgatacaccaatctcttttcctaattctgtctgtgataggcctttgcctactcgcagcatttttaatgtcattgtcaacttatcatcccctagaaaccgaatagactgagtaaggatagaatgaggatccctactaacagccataattcgactctttctcgtgtttcttttttcattgattcttacaacttgtcaaggtacactaaagttcggggagaattaactccccttgctttatgtttttagagccaagcaattagatgatcgatcagtaagacgataaaggtaatgatttctagccagaaccgaatcgtttcatgtcgctcagctttttgttgggctcttttttgttgcctcgacaaaccgctatgctcctttcttgttaaggtcttgatcaaccttacatatactattatattaagtttacttaataagtcaataactaatattaatttttttgctcatatgttttatttcttattaattagtcttattatttaatcaagataacttaataacgactaataaaggaggcaataaaaatgataggagaaagaatcaaggaacttcgtaaaagcaaaaaaatgtcacaatctgagctaggcaagttcattggagtatcgcagaccactgttacggcttgggaaaatggtcgtgccgagccttccagttcatatgttacaaaactagctactttcttcaacgtctccactgattacctactcggccgcgaccccagggaagacgatctcaagaccgcagacctcgctgatgatgacaccatctttactttcgagggcaagcttatccctgagcaggacttggaatacatgaaacggctgctgcgcggtgggagaaaataaaattatcgaggagtattgaaaaatgaaaatggctttggctaacttaacgctggtgttggtggctctggggctgattgcttttgttgtcagtatcgtcttagcaatcatgaaaaaaatcaaatggcgctatccgccgatcattctggtcgtaacgctcgttgtactcgtcgtggctgtcgaggctatcggcccgattgatgaaagcaagtctgcagacgtgcgtgtcggcaagcttgtctacagtaaaggcgacaaagaggatggcaccgtgtactacgatacaaacggtaacggccaggcaaccatcaaggttaagggcttggctgacggccaggtagtcgtccaaaacgatgatgatgagcatgactttaaagaccagatcgtcaaggttaaaaaaggtaagactacgaaaacaactatcaaacaaccagaaaaacaagatgatcacaattatgtcttagatgaaggtaacgggcataaagaacgtttctgcgtgcttggtggcaacgaaggccttagtgctgatgttgggtcaacaatcaacgatgacttagcagatcgtttaagcgaagaaaaggatgatggcagcagttgggctaggtacgtcaccaaagttacctataaaaataaacacattacagtccacttaaacagtaacgtttatgcattaaatcacaaggcactagacaatctcgctagaatgtcgcaaggcatggcattatccgtgcttgacgaggatgatgagatcagcgattccaaggcatctgaaggtatgtcgacccagtggaaagttggcgatgacatcgtaggctacacgggtctaggcaactatcacaactacaagtggaacatttagcacagaatcgaggcgataacatgaacgaaactagtagctaccttgagaaagtggcgagcgatcatgatatcagcgttatctggactgacaaattagctcctgaaactccgcctggctgttcgctccattaccgcagcattgtcatgaaccttaactggcatcgccctgctgaaatttcgtttcagcttgctcacgaaatttcacacatcttaaatggtgatgaaactgatatttgcttttaccacgctaccttcacaggcaaacactccgttgaatataaagcaaacactggcgcagttaaacttatggttcctttttattgccaaggcataccaaaagaaaccataaacgtatacgattttatggaattatacgaagtgccaagctaccttgacaatgtagtcagggaagaagtgcacaactattatatttcaaacagatactaataatacgtccaagcgtgatcgacgttaaaagctaccattgggaggaataactatgaaaaaaataggtaagtttctactaccaattcttgcatttgtttcaatatttatatttacagcctcgcctgcatctgcaaaaaaatttacccttgattacgatacctataacgcaaagtcaattaagacttataaaacaaacgcatctgacagcagttggtctggtgtaaatgtaaaagtcaacaaaattcaagtcgttaagctagcaaaaaaatataaatataattcagcaaatgatggcaaatttaaaattaacggtttcatcagattgcactatgtgattcagaccggaagtaaggacgtaaatatttatcctactcaaggtacttactcttttagcaatggagaacaacaccaagctgatagtcttgaaaactgggacggatcgatttcatctcatgttaagaagagcggctgggtatcaatacccgttcagaaagtttcaggcgtaaattccgttcgcgctaaatttgatgcaaactacgataccgataatgctgacgatgataaccaatatcatacttatgatatgaacattaacttctaaaataaaaaaacagcccggcacagcgccgagcttaatttttgcacataaatcgaacatatgtttaagaaaggacaatatttatgtgggttgaaaaaaataagtctggcaattatcgcttcattgaacgatataaagatcctctaacgggcaaaagcaaacgagttatcgttacctaccctactaagaataaattcactactaagaaagcccagatggaactagaagccaaaattcaagaacgcctaagacatattcaggacggcaacatcaaaaaaggtgtcacccttcatcaagtcataaacgaatgggaaccaatatataaggcacgtgttaaaggcacaacctggcaaacgtatattgtcgcaaaaaagcatattaagaaatacattggatataatgtccaggttagcaaaattacacccaagtttctcattcacgcctatgaaaccatgctttatcgtgacggatataataaccctactgttaaaatggtagcttttaagatgacaagcatccttcgatttgcttatagacgagactatatagctacgcaaccgcctaaagaactagacattaattggaaaaagtctaagcacaatgatttagataaaaagtttttagaaacgcaagagcttgaacgagtcctggactatgtttatcaaaagaatgaacagcaaggagctatttttgaatggcaatatttaacgggaatgcgaattggcgaagttctgggcttgaaggtaggcgatatctttaaggaaaatggtaagtactatgctcacgtcaacggcacattagtatacacagggcttaaaacttctcagtattacaaacagtcaaccccgaaaactgatgatagttttagagacgtttttctaccagaaaaagcggttgaactttatcatcggtggagcgacggtaaagattcaaaccgctttttattctttatagatgatcatttttttgcagttactagcttgaacaggcgattgcgtcaagcacgaaaaattcttgatattgacaagcctatcacgacacacattttccgacacacccacgttagcaagttagctgagttaggagtcccactctacatcattcaaaatcgagttgggcatgccgactcagaaactacccgaaacatttatctgcacgttactcaggcagcgaaatctaagtgggacgataccatcttctcactataatcgagatagaaagccaccaatctgccaccataagatgtttcacagctttcaaacccgttgatatagttggcataaagggactttgaactactaccgtttcttcttgccccagtactggaatagatccgttcttaaggcaccattgtaaagcttacggcgtttagtggctttttgaccatagtaggtttcaaactctaaatcggccgtcaagatgtacttgctccaagtcgtcattggccggtagatctcgcccatttgccgatacagctcacgcaccgactcttgatcgcttaaacgctcaccatatggcgggttggctacgatgaccccattgagcttgtcagtgtgccaatccttgactgccagctgcttaaacgtgatgtcatgcgtcaagccggctgcctgacagttccgctgagcaatatcgatcatattctggtcaatgtcgtagccatgaatatctaattcgatgtcatagtcagctttggcatcagcttcatcacgcacgtcatcactcaggttttctggcatcagattgatccagcgctcgcattgaaagtcgcgattaatgccaggagcaatattatgaccaatcaaggcggcctcaattggaatcgttcccgaaccacaaacgggatccacgaatggattgtcagggaaccagtgggcaagcatcaccaaagccgcggccatgttttcttttaatggcgcgccccctttacccttgcgatagccgcgcttaaacaggctggggccagtcgtatcaagtgtcagcagtacgtgatctttgttaatggcaacttccagcggataggtcgccccagtttcgctcagccgcgtccgtcgatgataaacggtgctcaaacggtcaacgattgcttttttgacgattgcctgtacgctgggaacgttatgcagctgtgagcgatgactcttgccctcaaccggaaaagccgcgtcaattggcagcaggtcttcccatggcaatgccttggtctgctcaaacaggctgtcaaaatcagtcgcgtcaaactcacctacgataatcttgacccgatcagccgtccgcagccagagattggccaccatgatatcacgcagatcgccttcaaaacgtacccggctattttcgacctgcgtttcatagcccagtgcccgcagctccttgcctaccaaggcttcaatcccggctgccgcagtagctatcaaatgaaatttttgcaatataaaaactcctcatgaaaattttgctgacatcattttaccataaactatcaatcaacggcttgctggatgaatgtttcatcaaagcgtattctagctttttgccttcgatcgtttcaatgcctttagcaagctcagtgaacccaaaacgcctattagagcataaccgcaccctagccagccaatctgtgccaatttgatgtaccgaataccaatcgaggccgtcaatgagccaatcgtcaccccaatattcgtacagattggattcaatgatgatgccagattcagtgccatggggaaatcccgttcagccgtattcaaaaacattacctgcagcatcgatcctggcattcccaacacaaaacaaagcaggccaagattaagtaaaccgctccaagaattctttacagtcaatgtaagcatcagcagcaaaaccaaaaccatgccgctgacccaaccaatcttttgcgtgccataacgctcaatcagctgacctgccgtcagatttcctaaaataaacatgatgccaatcaatcccagcaacagactcaactgattaacggagaagcccagctgcttaacgattaaaggacggatgtacgtataaaacgcgtattcggcagccattaatgcaatcatgactacgattccccagacaattcgcgcatccttaaacatactgagctggccatttaaatttccagccatctgttccgaatagcgcggcaatatcttagccagcaaaaaccaaaccagcatcgacaaaatcgagataacaccaaagcttactcgccacgaaaaagccgcactgatcatggtgccaaccggcacgccaataatcgtggcaatgctaaacccagcaaagacggccgccacggtcattccccgcttctccattggcgtaagcagactcacgaacgccaaaactaatgaaataattgtcccagcaaccgcagccgtaatcacacgcgagacaaacagccaaaacaagttgggcgccattgccgttaacgtattgccaatacagaaaattcccatcagccacattaagacatggtaccgtggccaacgattggtccaagccgttaaaaccggtgttgtccccgcataaacgatcccaaacagtgtaaccagcaggcccagcaaagataatgagccattaaaactttgagccagatcagaaataattccaacaatcataaattcattacagcctaataaaaaagctgttaacacaaagatactcgtctgtaactttagtttattcatcaataatttcccctctaaatcaaaaatgacctgccgactatggaaaaacatagtcagcaagccattatttttatttatctgaaatttgctttcaggtgacttgtttgttaaattacttaaattattttagaaacttcagcagccggtgtcaagcacggatgatgattgcagttcatccttgatcgtctgccacatcattgcgtgctgatggttgaagaacttaggcgtctcatccagagaaaaatagcgaatccgcaatgtttcggctggtttaaaagccgtttgccgactgccgacttgcttaaccaaaaagaaggcattgattggctgaacctgatcgccgtttggataggtgtagaactcctgatctgaaatcttcagcagtttgactggctcaatctcaattccagcatcctctttaaactcacgcttgactgtatcttgaaacgactcgccaaattccatataaccgccgggaaatccccaatcaccggtatcagcccgctcctgcagcaatacctgttgcttttcgttaactaaagctcccgaggcactggtcatgatcaatggctgatgaccgactttggcgcgcaagtctttaatataggccatcttgatccttcctctcatctttttggtcaattttaacacggattgctgatcgtcagtaattgtcttaccagcgaccgaccacttgcgaaaactttttgctttgatcatggcagtaatgagacgcacctatctgatttaacaaaaggatccattgccctttcagacaatggatccttagtttttcaaaagctaggcgtgccagtgctcctgcttgaactgctcccgtccgccagcctcctctttggcatagcgttccggatctttcttgtagaaatcctggtgatagtcttctgccagataaaatggctgggcgtcttcaatcttggttacgatcggatcatcgaaaattccgctgtcggccagtttttgccgtgacgccaatgcgatctgccgctgctgctcatccttaacgaaaatcacggggcggtagttatcgccacgatcttgaaactggcccatggcatcggttggatcagtctggtgccagtagatctcaaccagctgttcataagaaaccttggcgggatcaaacgtaatgcggactgcctccgtatgaccggtcgtccccgttttgacctgttcataggttgggttttcaacatgcccgcccgtatagccagattcaaccttttcaatgcccggataggtatcgaatggctcaaccatgcaccagaagcatcctcctgcaaaaattgccgtttcaaaactcatcttaactgcccctttcgtttaatcgtcactaactattacttcgtgccatagatatcccaagcagctttttgggcacccttgtaagtcttttggattgcctttttggtttcttcagtctggtaagcctttacgaccttcttgtagactggattatccttgtccttttcctgtacggcaatgatgtttacgtatggcttagcctttttgttgattggttccatgtaaagcgaatccttgcctggcttaagcttggcagccaccgcgtagttaccgttgattatagatgcatcgacagagcttaaggcccgggctgccgtggctggatcaacttctttaaacttcagattcttagggttgctggtaatgtcgtttaatgatggcttgatgccgctgcttttctttaccttgatcagccctgccgactgcagcatgttcagtccgcggcccaaagtagttggttcatttggaatcgcaatcgtggccccgtccggcagatctttaagtgagctatatttcttggagtacagtcccaatggcgagatcaccgtattaccaatgcttaccagatgcgcgttttgtgacttgttgtaagattcaaagtagtacttggtcaagcaggagtgcatgtcaatcttgccatccttcaaggccttgtctggctgaacgtaatcatcaaagaccacatattcaatattgatcccctgctttttgagccgcgccttgacgttattccaaaccggctgcgagtcagtcccgaccaaccctaatcgcaccgtggtcgtctttggcttggccgtccgtttatagattaggccaatcgctcctgctgcaacgattaataaggcaacgatggcaataatccagtttcgacgtcgctttcttctcataagatcctcctcagtgctgttgaaaattaaaaacgcccctaaaaaacggctcttcagccatttttcagggacgtctgacagtcatgatcagcgtgttaccacccatcttcaagaacgcattgcagcattctcctcagcgagttctcgattatttgaaaaccccgactttgataacggcgtcgccccgtgctgcgctcaccaagggctcacgcagcaaaccgctccaagaccatcttcaccaactttgaccgatcgctttccaccattaacgactctctaagcggccttcattggatactcatcttttctcagcactttttaatttatttttcataaagtatcttaactgaatcgacgacgactgtcaacaagaatctcaaaaaattttaatctgctcagcaaaaaccttcatcatcactcagaaagcagcagtaccaagcagtcaaatttatcagcgattgccgactcagcttggcatcactaactttaggccagttgacatccttagtttccaaaaacctccccgagattattttcacactgccgttaaaagctatcagtcaacccatatctttccctatcctcggctccccagttctgctttgactgcaactaaaaaacaccgctgcaaaactgcagcgatgcttttacacttattcagctgtcttcatcagccatcaccgaaatcacgttcagctcagtgaatctggtggtaaatggcgccattcgcagcccagccactcgtttttcaatggcctgctgcagactggctggaacatgcatgaattgccgctcccgcaccagcgcgtactgattttcgcgattaaccaataacagcgttgcacggtccgacgtgtagcgaatcagtcccaaaacctcattgccggcaaccatgaccccagtctgtccttctttaagcgcttcgcattcttggcggatatccgaccagtagtgtaccgttttttgcaattcggtgttttcacgtccccatggaaaatagcggcgattatcgggatccttgccaccttccacgccagcttcatccccgtaatagacgcaggggattcccggcaggttaaatagtagggcaaacgcaatctttaccattggcacgctttgattcaaaacggtcaggatgcgctcggtatcatgcgttcccaggttattcagacaatcaagcaggaaattgcgcggatagttttctaccagtgtcaataaatcctcgccaacttttaccagctcaccatgtccctgtaaaaaattgatgacccactgacgcagcggatagttcattgtaccgtacagattatcgccactgacataaggacgccgatgaccatagctaatcttattagaggcatcttcccagacttcgccaatcagaatgcgatcatcatagcggtccagattgcgacgaatggcccgcagaaaatcatccggcagctcatcggccacgtccagccgccagccatcaattcccagatcattccatttcgtcaagacactgccccgctcaccatagatgaactgctgatagctgggattgtccttattgaccgttggcagatcatcaactccccaccagcagtcatattgatccgggtaatgcttaaaattgaaccattcataataggagctgtttttgtcattagccgcaccggtctgctcgccgtagagatgaccagcgttgaaatagcggctgtttttgcctacatgattgaagacgccatccaaaatcaaatgcatgtcgttttcatgcagcattgtgatcaaagtcttaaaatcttcttcagtacccagcattggatcaattttcaagtaatcattggtatcgtagcgatgattgctggaggcttcaaatatcgggttcagataaagtgccgtcacgcccaagcgcttaagatagggaagtttggcaatgatgccacgcaggtttccgccgtaaaagtcccagcgtgcaatcttatggttttcatcatagatatacattggtcgatcagcagtggttgcatataaaaacgtatttggcttcttaccatcaatctcaccatgcggattgccgtttgcaaagcgatccggaaaaatctgataaaaaaccgcattgcgataccattccggccgtggcacctgtcgatcgtaacaggtcagctgaaacggctcaaccttgctgatgtccgtagtctctttccccgtaccgccatgcagatgccccaagtagagcgcggtatcgttttcgcgacgcacccggaaatagtagtgatacaagccggaagtcgtgatcttgatctcgccggtatacctgcctggctcattttcatcttgagtcagcggataaaaaaccgtattctcatccagcttggtaacaccgaccgcgacctgcgtaacgctctggcagtcaaccttaacgctgaattgaacgttgttgcccgcctgcagtgctccaaaaggccgtttaaactccagctgccaggcattgtaatggatctgccccaaagcagtccccccttacttgtttggcgtcagtttccagacatcgtcaacgtagcgatcaatcgtcaagtcagatgagaagtgaccggcattggcagtattgatcagactcatctgggcccagtgcttagggttgcggtaggcctgatcaaccttatcctgcgccttgagataggattcaaagtcgcgcagcacaaagaactgatcgccgttatactgaaccagcgaatcaaaaatctcgcggccttccatgctgatgttcggaatcgtgccatcaacaaaggcatccacaacacgatgaataaccgggtcgttttcatagtactcgctggcgtgatatgaattatcggcgtagtatcggtagacttccttggatgagagaccaaacgtaaagatgttgtcatcaccaacatagtcatgaatctcaatgttggcgccatccatcgtagccaccgtcagcgcaccattggccatgagcttcatgttgctggttcccgatgcttcttttgaggccagtgagatctgctcagaaacatcagcagccgggataatccgatcggctaatgatacgttgtagttttccaagaagacgaccttaagcttatcatggatgtcaggatcgttgttgaccaggttggcaacctcattgatgcacttgatcacagccttagcatattgatagcttggtgctgccttggcgccaaagatgaagacgcgttggtagatatcggcatttggattggcctttaaatcttgataaagcttgacgatccgcagcaggttcagcagttgacgcttgtaggcatgcagccgcttgatctgaacgtcaaagatagccttagatgaaatctcgattcccgtctgctgcttgataaacttggccagatcgcgcttgttggcctgcttggcggcaatcagctgatccaagaccttgttgttgcttcggtacttcagcagcttctccaattcaagcgggttcttgcgccagccagagccgatttcctgatccaaaatggctgccagccgtggattgtcgatggccatccagcgacgcagcgttaccccattagtcttattgttgaaacgttcgggataaagccgatagaaatcatgcagcacttcttttttcagcagctcggtatgcagcttggcaacaccgttgatgctgtgtgagccaataattgccaggtgtgccatgtgaacctggttgttggcaatgatacgcgtgcggttaatgaagttttgatcatatttaccttccaaagacagcacgaaacgtcgatcaatttcttgaatgatctgtagaatccgcggtacttcctgttgcatcatgttaatgtcccagcgttccatcgcctcagccataatcgtatggttggtgtagctcatgacgttgaccgtaacctgccaggcatcttcccagcccagaccatgctcatccatcaaaagccgcatcaattcggcgattgccatggatggatgcgtatcattgatgtgaacggcaatgtattgatcaagtttggtcaaaggctgatcgtatttttccagatagtgattgagaatgctttgcaggccagccgaaacgaagaagtattcttgacggatccgcatgcgccggccatcttccgttgaatcgtcaggatagagcacgctggtcagatcctcaacccgccgcagatcgtcaatcgtccgatacttgctttcctcgtcttcaggaatctcagcatcccaaagccgcagcgtgttgaccacgccattctcatagccgaccatcccagtatcgtatggcacggccttaatcaactgcgaaccttcgtataccggcttcagctgaccattttttggctgcaggtagacctgaccgccaaaccgaaccagcacggaatgcgtttcccggcgttcttcccagacattgccttcgttcagccagttgtttggcagttcaacttgatagccattaatgaacttctgcttaaacaagccgtacttgtagcgaatcccgttcccattgccggcatagccatcactggccaatgcatccataaacgatgaggccaagcgtcccaggccaccattgccaagcgccatgtcgttttcctgttccacgaccttttcaaaatcaacgcccagttccttcatgccatccttgacgatctccagccagcccatattgaacagattgctttgcagcatgcggcctggcagaaattcaatcgagaagtagtacagctgctttttgtgctgctgatcatagctgcgccaggtgtgatgccagttttggttgtaggccgacttgaccatgcctgccaagaccttgtacatatcaaaataggaggcctcatcaatatccagggccagatcgtcttttaaatgccgcttaaaatcctgcttaaactgtgattttgttaaactcaaatttctatctcctctcagtttttcgcaatcaaaaactaaaacagtgacttgtacatatccagataggcctgactctgtttatcccagctaaagtccttagccatcgcgttttgcatcagatgacgccagattttcggctgttgataggttgccatggcttctttaatggcctccatcatgtaaaagccgctaaactgctcaaagccaaagcctgtaccagtattggtgatcggattatatggctcgacgctgtcttttagtcccccgatttggtgaacgattggcaacgtgccatagcgcattgaaatcatctgcgaaagtccacatggctcaaaaccagatggcatcaagaacatatcagctcctgcgtagatgcgctgggccagaccaacatcaaactcaatcttggcgccaaacttatcatgatgaacgccgttaaaccaacggaagtcgtgttcaaaattggcatagcccgttcccagcagcacgacttgcacatcaaatttcatcagattttccatttcattgacgaccagctgaaaacccttttgataggtcaggcggctgacgatcccgatcaatggaacgtctggacgctgtggcagaccaaactctttttgcagggccgccttatccttggccttgccttttagatccttaattgagtaattggcagccagattatggtcggttgccgggttattgacatcatagtcgatcccgtttagaatgccgcacagcttaaagttttccatgcgcagcacctcatccagatggcagccgaattcaggcgtctgaatctcggccgcatagcttgggctgaccgtgttgacccgatcagcatacaggatcccggccttcataaagttaacggccgtgccatagcgaaccgtgccatcgtcatagcgttccggcgacatgccaaacagttcggtcatgacttcgcggccatattcaccctggaattccagattatggatcgtcaaaaccgtcttgatgtgatgatatggtccaacccagccatatttttccttgagcagaaacggcataaacgcggtatggtagtcgttgcagttcaaaacgtccggcacccaattgtagcggcccatcaattcacaggctgcctgctgaaaccaggcaaaccgctcaccatcgtcatagtagccgtaaagcttaggccgatcaaaatagtagcggttgtccaaaaacatgtagcgcacgccgtcttgataaagcgtctcaacgccacagtactcggttcgccaaccgactttgacctcaaatgagccccagctttccattttttcttgaaactttcctggcatccagcgccacagtggcaaaaccacccgcacctcatgaccttttttagcaagggctttaggcagcgcgccgaccacgtcacccagaccaccgctcttaaagaacggggcacattccgccgccgcaaacataattttcatgattaattcgcctcttcttccgtactgctcaagttagcctcaactcgggtatctttgggcactaccaaaatgttgtcaggggtcccgacgattctgacgcccggtttgacgaccacgtttttatcaagaattgcccagtgaacctcggcattatgtccgattcttgcatttggcatcacgatcgagttggttacgacagcctttggatcaacgactgagcgccgcgagatcaggctgtcggtaaccgtaccgtaaatatcgcagccggttgccagatgactgttcttaaccttggcgtgcctgtcatagtaggtggcaacctcattgcgcgtccgggtaatgatgcgctgattggtatagagcagctcgttcattttgttggaatcaagcatgtctttgttggactggtaatagcttggcaggtcatagatgttctgaagatagccaacgtattcatagccgcctgccaattccggcttaggcagctgcgcttttaaaaagtcgtccagctgagctggcgcatccagctgctgtcccttgcgcagggcgtcgatcagccaacgagtatcagcaatgtagacgttcatcgacaggttgaagattcctgtttgatcaggcagcttggcaaactcatcgcaggtaatcacgttgcccaggctgtcaaaactcaagatgctgtcgtaagcggcaatttcattggcatcggtgcgactgtagattaccgtcagtggtttatcggtctgcttgtgaatctttaaagctgcccgcagattgagattgcaaagcatccgcgtccccatgatgaccgtataggcggtgtgcgatttttccaaaaactcaatcgtgttgttgaaatatttttcgccagcggccttcttgttttcgctgtcttggaaatagttgacgtattgataggagccgatcgcatccagtccccattcacgaccgccacccaggtgatcaaagacggaccgcaccttgtcttcgtcttcaatcagctgaacgttacggatcccggcattgacgacactggacagctcaaagtcgatcaaacggtacttgcagtcaaaaaacagcgttcccagtggtcgttcgttggttaatggctttaaggcatcatcattgagctcatcgacaatgattgcacacatttgattattcttcatttgaggttccccctaacgtttcgccattgccgactaccgcaatgtcatcatctccgccatcgatcgttacgccatcgccaatcacggcattctcgccaataatcgctcgccgaatcgtaacgtcgcggccgatgctggcacctggcatgatcatactgtcgatcacctgactgccttctttgacccgaacattggctgacagaatactgtgctgaatcttaccagccacgtagcagccatcaacgatcatcgactgtgagacttccgccgtatcagtcagcatctgtggtggcgccagtggactgcgggaattgatccgccagctgcgatcctgcatgttaaggccgttgtttggttccagaaattccatgttagcctgccaaagcgacatgatcgtcccaacatcccgccagtagcccgagaagcggtaggcgtagaccggctcaccgctgtccagataatatggaatcacgttcttgccaaaatcgagcatattgtcgtttttggtaaagttgttgaccaagacctcacgcaaccgggcccagttaaagatgtagatccccatggaggcgtggttgctctttggctcagccggcttttccacaaactcggtaatccgatcatgctcatctgtgttcatgatgccaaaccgcgaagcatcttcccacggcacgtcgattacggctaccgtcaaagaggcgccgttgtcaatatgctgctgcagcatgtcgctgtaatccatcttatagatgtggtcaccggacaagaccagtagatactttggattgatactgtcgatatagtcgatgttttgatagatggcatgcgccgttcctgcaaaccacttgctgccatctggactggagtatggctgcaggatcgtcacgccagagtccaaacgatccaatccccagctggccccattaccaatgtgccgatccaaaaccaggggctgatactgcgtgattacgccaatattgcgaatgcctgaattgacacagttgctcatcgtaaagtcaataattcgatagcggccgccaaatggtacggcaggcttggcttgattctgcgtcagcttgcccagccgagttcccttaccgccggccaatacaatccctaacatttcatcattcataatcatggatggtgggctccatccaacacccctttctatttgctccccgcttgctgctgttgtttattggttggcttaacttgctttcttggtcgagacttgcgacgcgcgattttgacatccttgccaggtttcagaatcaaggcccccaatgccggtaccgtggtttcaatcgtatactcatattccttaaatgaatccgacttggtatgacaggcaggattgtttcgagtccaggtgccgccaaactccttcatttcagtattgagaatctcatgataagtacccgcgtaaggaacgccgatcttaaagccgcgtcgttcaaccggcgtgtagttcagaatcacgatcaaaaaatcacgcttgcgcttaccatgccgaatatagctcaagaccgtctgatccttattatcggcatcaatgatctctaagccgctgtctttagtatccagttcccaaagcgatgggttgtcatgatacaggccgtttaaaaccgcggtaaagtgctgcatcgactggttcaatgggtcttttaggtcaacccattccagtggcgcatcatatttccattcgagatactggccaaactcgccgcccataaacagcagcttcttgcctggatgcgtcatctgccagacatacagattccgcagctgggcaaactgcttatagcgatcgccccacatcttgttcatcagactgcgcttgccatgaaccacctcatcatgcgacagcggcaggataaagttttccgccaagcgatacataaacgagaaggtcagtttgtggaagtcaaagctgcgatagattggatcctcgctgtaaaaatccagcgtatcgttcatccaacccatgttccacttatagtcaaagcccagcgcgccatcctcgattcgaccagaaacctgcacgccagccgagctttcctccgcgatccataacgactcgggatgctcaagcttgatggctttggttgccttatgcaaaaaatcatagccttccaggttgcgcgtgtcgccatacttattcggcttccagggaccgaaatcgtagtcaaggtagatgatgctggaaattgcatcagcccgaatcccatcaacatgataggcgttcagccaaaacagcgcgctggagatcaaaaatgactgtacctgtggcttgcccagatcaaagttcaaggccccccagccgatgtttttagcccgatcggcatcctcatattcaaacgtcgccgtaccatcgtaataagccagcgcgtcatcattgatattaaaatgaccaggcacccaatcaacgattacgccaatgttggcttgatgacagctctcgacaaattcttgaaactgttcgggagtgccatagctggagcaaagcgcataaaagccaataatttgatagccccaggatgccggcagcggatgttccatcaacggcataaactcaacgtgactgtaatgcatcttttttaaataaggaaccagttcgcgcgttagatcactaaaatcatagggagtaccgtcttcatgaaagcgccatgagccggcatgcacctcataaatattaagcggacgattaaaatgatgctcgcgtttttgccgtccccgccataagccgtctttccattttcggttgggaaaatcgatgatgcgggccgccacgccaggtcgctgttcaaaacagaccgcgaatggatcaatcttcatgatttcgcggccagtactctgcttgatattaaacttataaagctggccggcctgcgcctggtcggtaaaaatgctccagacgccatattgatccttttgcatcggcagtgaatgctcatcccactgattgaagtcaccgaccagccaaacctgctgagcatgcggtgcccagacccgaaaagcgaatccctcaccttccgcacgcttttcgcgatgaacgcctagaacatcttgggcgcgataattagagccatcgacaaaggcctgcagcgaggctgacaaatctttttcactcagcatttgatcacccctttacaaaatcgaacgtaaatttcatgcataaaaatagctaattattagctaaaagcaatttttattaattattagaaattaattaacaaaatcagccaactatcttttccaaaagaaatttcgtttactgcttttaactatctaaagtataaaacgactcagtactttcaacaacacgaacttagttaaacatgtaatatattattagtaatttaatacagatttggcgaattgtttcaaaaaagtattttttctcagtttttttggcaacatatgccccttgaattgtaattttgacaacatcgcttacgatttaatcagcattaaatgaatattctttaatttatttggttcgttccatttataaaaatgcatcgttccataattttattttggatatgatcaattaataggtctggcaattcaaacagacaagcagttgctgcgtctttaatttaaggtctagccaagccacgattagattgatcatcataaatcagcaagcatgaaatcaaacatcaaaccatcctgtaattcagtcgcagtctttttagaaagcgtttacatttaatgacaataaaaaacccgagcataaactcgggcacctgtaatgcagatctctgtaggccatgttttgtcgtaatgctgtcaccaggtcatgacaacatcgaggcaatcatctatctcagagtaaaaactctcccctggaatcacttcaattcgctatccaaagctcccctaccgtagtttgggtttaccgcttgaggggtttaccgcgttccaccagtactgtttccaatcctgcttcgtcactgtggcacttttcagggatactggggcatagcttgcgccttagccggttttcccgccgtcaccgagttcactcggtgccccgccttattttttcagcgagcacaaacactacagacatcgcagtctgtgcgagcatggaccttcctgacatgatgcatgatcatgcccgatcgcccaagacctgcattagttttttcaattttatttgcggactagagcaaatgagaatcgtcacggtcgctgctgttcagctgtgagccgaaaacccgccgttccagattcgaaagtcgtttcaaaatgtccatattggttgcatttgaaacaggctgcgagcttgctgaacgtggaatggaagaaccaacctccacctgccgattaagctcatcaaccttggaccgcaagcgagcattctcatcttgcagccgcgtaatttctttattaaaagtgtcatagtccttgataacatcatcgaggaaagaatctacatcagaaacgtcgtaacctttaccgatgcttttttctttgaactgtttttgcaaaatatcttgcggtgtaaacttaatgccatccaacttaaacacctcattgcttgtttaatccgtaatacattaactaattctaccagactcaaaaattattgcaagagtcaattttgaattttattcctcatctgtttctcgcagacgctcactgtattcttcagccgcttcctgcagctcatcaaagtcaatcattctcattgaataatcggcattctgctcacggtagcgattgatagctcgccagtcccagaccgttttgccctcatgctcgggatcatagattaaaagcgcgccatcagtataatggagcataaagttctggtaggcgcgcagctgttctggcgattcatatttcttctcactgacccgaccggcaaaatcaacctgggccttgattgctgccaaacgggcctggttgttttcattccagcgtgcggcaaaatcggcatacggctccatcaaggcaatctttagctgtggatagtcgactttgattgtcaacgcgctttcgatgctccagcgctcaactcccatctgtggtcccgtaatcagccaaaaatcctctgacgtgctgtctaattgatagcgcagttgcttttgcagcacgtctttaattaccgcaaccttgggattcttttcatcaaagacgcccagctcatatgctcgatagcccgtcgtccacagtcttttcatctaatcatgttcctttccaaatttggtttgcaattaattttattgtatggatttaaccggtttttttcgtactctggtataataacacctagttaagggaggaaaaactgatgagcattcattatccaagtggtcaaaagccactcgctgttcacgaacgaccgcagtctcgatccgttgcgctgcgttcatcctatgctcagcgcggaatgtcattggaagctgagatcaatgccagcaatcagtattacctggcaaatcatattgccgtaattcataaaaaaccaactccagttcagttggtaaaggttgattatcctaaaagaagtgccgccgttattcgcgaagcctactttaaacagccttcaaccactgattacaatggcatctataaaggatggtacattgattttgacgccaaggaaacccgcaataaagcctcttttccattaaagaactttcatgagcatcagattcgtcatatgcgtgagtgtgttgatcagggtggaatttgttttgccttaatcagatttgtcgaactcgatcaaatgtatgtctttccagccaccagcctgtttgaatattggcaacggcagctgcatggcggacgcaaatcaattcccttgaccgctattattcaagacggctatccggttcagtatggcttaaatccgcgcttgcactacctgacagcggttgaccagctgattgccgccaaaaagcactaattttaaaggagtaagcaatgaacaaccaatcaaggccgagccgttccagtcaacggcctggtaagaaaaagactggtcgcggcagcattgtcaagcgcgtgctgttgtggatcttgggactgtttgttttaatggtcgttgccggagcatgcgtatttttctattatgcatccagcgcgcccaagatcagtcgcaatgaattagccagtcagactactaccacgatttatgacgctgataataacgtcatctcacgcttgggcgcacaaaagcgtgaatacgcaagcagcagcgagattccaagtaccttgaaaaatgcggtcgttgcgattgaagaccggcgtttctacaagcatcatggggttgatcccgtccgaatcatgggcgctgccgtggctgacattacccatcgctcaagcggcatgcaagggggcagtaccctgacgcagcagctggtcaagctttccgtcttctcaacttctgatgccgaccgcacgcttaaacgcaaggctcaagaagcatggctggctattaacgttgaaaggcatttttccaagtcgcagatcctcggcttttatatcaataaggtctacatgggtaacggggtctatgggatgaagacggccgcccaatactactacggcaaggatctaaacgagcttagtctggctcagttggcaatgctggctgggattccccaatcgccaacctactacaacccgacaactggcaatgccacatatgcaacccaacgacgcaaccaggtacttgatgccatggtacgcagcaagtacatctcacaaagtcaggccaatgctgctaaaaaagtcagcatcaaagaaggacttgatcctaaccatggcaacacttccgataattccgtccaagttaaggaaaaagtggtggactcctacgtcaaggaagttctgtcgcagctggtggctaaaggatacaacccttacacagacggcttaaaggtgcacaccaatcttgacttgagcgcccaaaagcacctgtacaatgctgccaacaattcggtagctttccaaagcgataagatgcagaccggggtcgccgtcgttgatcctaataatggtcaaattgttgccatgcttggtggccgcaagactggcaacgttgtctatggccttaaccgtgccgttcagactgaccgctcatctggttcgaccgttaagcctttgatggactatggcccagcgattcaatacctccagtggccaacctataagtccgttgaagataccaagttcgtctaccctggtactaacaaggttctgcatgactttgacaaccaatacaagggtacgatgacgatgcgcgaagctctggttcaatccagaaacgttccagccatccgaacgctgcagaccgttggcatttcacgggctaccaagttcttaaagggcctgggtatttcccaatccaaggcatacacgctgcaaaacgggattggcatctacgtatcgccgctgcagattgcggctgcctacgcggcttttgcgaatggcggtacctactacaagccttactacatcagttcgatcacgacgcaggatggcaagacgcttacctactcgccaagcggcaagcgggccatgagcaaggcaacggcctacatgatcactgatatgctcaagggcgtctttaccggtcaaggaagcgccactaaggccaacctttctggcgtctaccaagccggcaagactggttcgacggattatccaacctccagccatcccgatggtgaaatggattcctggatggccggctacactaagaactattcaattgccatctggactggctatgatcatccaatgcaggccggcagcggaattaccaaagcctaccagacaacagcacaattgctgtacaaggacctgatacagtatcttgacagcaagaatcacgctacgaactggtctatgccaagcacggttgaagccgttacggtaaacggtactcgtcagttggttattaaagattctaaatgggctctaggcgtaaccagcagctcggcactatcatccagctccagcagctcagctagttccagttctcattccaaatctgaatcctcagcatctgattcgagttcggaatccagcacttccagctctagttccagcgctgccagttcttctagcgaaagctcatcaagtgcatccagcgcagccagctcggctccagcagcttccagctcaacgcaacagccggctcagcagccacagccagccgttggtcaataattcaatatctcaaaaaagaagacgatcgatcccgtttaagagcggaaccgatcgttttttctgtatgtatttatttcaagtcgataagacattgctgcttatcctaccaagcacttaagacagcgattgggctcaacaataaccgttaatgttggtatcggtctattggacgtcaaagtgctgggccgcggtcattattcaaaaattcctgcataatagtatcttcaaaaaactcattacctacttttttcaaaaaagcgatgcatagtaggtaaatatcaatatatatcgatttagggagacctaacattacctactattggccgaaaattcaataatagtaggtaattcacaaagtcgatctggcccaatcagctttaaaatgatcgtcatattcaaaccgcaggcactttcattgggcgacacgctgctgatgaaagtgaatcaatccgtcaagccagtccgaaaatcacaatctaataatcaaggaccgtcagataactcgccagcatcgttttttttatctaaaaccgacaaaaataggcatcctgcttaaaaagccagatacctatttcgacaactcataacattttaatcaatagtttcaagatgacccttccgacgaccattttgcagaatatagatagccagaatcacgagcacaatgcctaagatttcgatccagttcatccattccttaaagaaaatcacactcaggattgccgtcacgattggctgcagcgcgtccataatgctgaccacgtctgaaggggcaaacttggtcgcgtgcatcaacatcccaaacggaataatcgtcccaaataagaccactgttgaaacggatgcaaccagtgttccggtaatgtgcggcgagttgacccaaaatggctggtatagattaaacaagaccccagcaatcgcggtcccccaacccaacacaaccagcggcgaattttcttcagcagccttttgcggtaaaacaacgtagaaagctgccgtaataccagaacccagcccccataagaatgaattcagcggaatcgccaaatgaccaaaattccccttagtcaagcagagaaaaaccccagccatggcaatcacaaatgataagagatcgcttttcagcggacggctatgctggaagaaccagccgccaaaaacaataaacaatggtgacagatactgcagaatggtcgccatggacgcattcccggtctgaaccgcgtaatagaaagtatagagattagccatcaagccaaaaaccgcataactgaacagtgagattactgatggccatgacttaaaaacgttaaagatcttaccgcggtataaaatcgcgctgattatcaataagattgcccccgcagccgaggtacgcattgaaagcatccaatgtgcagggatagccagattctgtgagatcagctgcagaaccgtgccggaaacaccccagctgattgaggccgttcctgcccacagcatccctttaacgatatttttttgtttattcatcttaaaatcctacccataaattatttcaaatcacaatagaaaatattctaacatttttggataaattcttctgacaaaatgctttttttcagcaaaaaaaccgttcatgaaagtttcacgaacgatttgcttaattatattaagtttagaaccagctcttgacccaattaataaatctagtcagccagttttgcgcctgtttgaccgtttccttgccggcttcactgttggcccaattcttcgccttattcatcaagttgccggttgaattcttaacgttattgatcgtattggttacattattgatataggtcttgctggaagaaattggtgagttttggaagttgaccaacgcgccagcaatcttttcctgctgcgtcgtagtcgtttgatcagcaatgccgcgtttttccagggccttgttcagcatttcctgaatatctgccttggttgccagctcgccactgctctgtttttgttgagcaatctgcttggatgtatcgccaactgccgccatcagcttacctgggtaggatgagtcgtccttattggcatcaatggcatcttgagtagcatccagaaccgagttggctgccgccgtgttttgactgttcagctgatgaccatcttcttcaaaggccttgtagaccccagttaaagcagattcacctgatacggcgcgattggcagtgaccacgatcgtaatgtcggttacccctgccatctgagcaaccattgcgtactgctgagccgtaacctcagtgatgttgctttgcccgttgtactttttgatgttgaccttgaccccgctgcctggatcggttggcgcaattgccaccgaactgatcatggcggcatcggtagtcgtgccattgccgatgtatttggcgtagtcgctggccgtggccgttaatttcttaaaagacgaatccacgcccattaccgagtttagctgatcatagacgctttgaggcgcaccggcaccataaaccacgtaagagctgcttaaggtatgcgtagccgtagaagacgatgagcttgactgctcggttgcagtgtcagcagatacgaccgctggagccgctactgctgccgcaccagcaagcgttactgccagcatcaatccagccagcattttgattggtttgttcatctttagcaaaccgcctttctaattatttgccctttaattataccttgaattcgttttaaaagcgctgtcttgaccaaaacttaaagattagatcaagcactcattagaatttgagcagacgattgattcccgtggccaggcagcagcgatatcaccaagcagtcagctgagtcttaatcgtcaggcagcttaaggattggaatattggggattggccggttgcccagctgtccgccatgctgtgccatgcgactctgatagcgctgcttatcctgttcgacttcttggggcgtcttaagattgttcttgcgccagttcatcaggattgaatccatatagcggaaccgcagtgagccgttgacgactgcttcttttaaggccagccgaatcatttcaatctcataatgatccttgtccagccagtcattgacataggtaatctccattggcgtcaacgggcggccaaactcgctttcaatctcggcaaacattttttcacgagccgtggtctgcttgacgtttttttgctgcgattgaatctgtccctcacgaccaaccaaacgactgatcagcggcgaaaagtcatagtaggccgtttcttttccctcagcatcgcgcttcattcgctgcaccagcaattgatgctcagtcatctgatgaatctggtcataaacggttcgctcatcagtctgcagattttccgcaatccaggtgatgctggggttttcaattccccgatcgatgtaggactttaattccagatagaccagcagctcaccactggtcatcccgatttctcggtaatgatgaagcaaaagattactgattgaagtttcgccggcctgcagataggaaaacaaaaaatcctgcttcgccataagcatccccctttttcattcatgcaacaatcattttaaaataatgaactgcacttatacaagtctcaaagccattcaatcatcaattcattcaaacgtcttctccatggcaatgccgcgcgttgcttaaagcaggttcgctcattaagccttaaccaatccagatcaagcaaaaggaccgatgactgactgccatcggtcctttaatttatactttaagccgcattattgcgtctaatcccgattatgggtagatccggtttaacagacgtgggaatgggataacttcgcgcaggtgatcctgcaggcagatccaggtaaggaaacgttccaatcccagaccgaaaccgctgtgtggcaccgtaccgtacttgcgcaggtcaaagtaccattgatagtcatcgatgttcagtccagcctctttacccgatgctaccagcgtatcgtagtcggtttcacgctctgagccgccaatgatttcaccatagccttctggagccagcagatcggcacagacataaacgtcatcgcgcgttgggtggcccttcatgtagaatggcttgattgacttaggatagttcaatacaaatactggtttgctgaagtggttggccaggtaggtttcttctggggaaccaaagtcatcgccccacttaacatccatgccggcatcctgcagaagcctaattgcttcatcatagctgatgcgtgggtatggcgtctgcgtaaatggttccagcgtctttggatcacgaccaacgacttccagctcccggctgcagtccttgattacggccttgatcaggtaggcaacgtattcttcctgcagctgcagactttcttcttgatgcataaaggccatttctggttcaatcatccagaattcaatcaggtgacgacgcgtcttggacttttcagcacggaaaaccgggccaaagctgtagaccctgtcaaatgccagtgcgccggcttcttcataaagctgaccggactgagaaaggtaagcatcacgatcaaagtacttagtcttaaacaagtcggtcgttccttctggcgcattggccgtcaggatcggcgcgtcaatcttggtaaagccatgttcgccaaagaactcgtagttggcccgaatgacgcggtcacgaatccgcatcagcgcgtgtggcttgctggaacgcagccacagatgacggtgatcaagcaaaaagtcgattccgtgttccttgttgccgattgggtagtcaacgctttcaccaatcagttcaatgtcttcaatctgaatttcatagccaaacttggaacgagcatcttcatgaatctcgcccgttacccaaaaactgctttcttgacgcagttcatgccgtgccatttcaaacacttctggcgtcacgtcatttttccgcagaatgccttggaaaaatgctgttccgtcacgcagctgcaagaaagcgatcttaccactggaacgcttgtcagtcagccaaacgccaatccgcacgcgttcgttgacgtgctttggcgcatcaataatgttgatggtttccacaaaaaattcctccaaacaatgtaactataagttgttgatctgttgcacgtagctgcccgtcttgaagttgatcaggtcataacagagattgcctttgctattaaggtaggtaacttcccagactaccttatcattaaagatccccggcacggccttgagtacccttttcggatgctcactgctcttaacctgggcaagcgcctgctgttcagttaatcccgtactttgcttgacaacccgcactgagccgtttttctgcggcacaatgaccagaatccgctggcccttattgtttttgcctgcaaccgtgtaataagtattttctcggttgtagatgtaaaaaccagtgcgtgtctttaaattggcataacgcttggcaattgtggttgtctgacgttccgcttctgctttgggatgattgccgacagcatagatgctccagccaaccaaaaaaattaggatgatcagaatcagcagatcacgaatcatccgcttcgatgttccacgactgcgttctctttgtacctcacggcgactttgcatagcggccttccttcctaattcaattcagtatctcttgcattataacaaaatctattggcgctgcgtggatcgttcatggttttttaagaatttttttgtctcctcaatcacattagccgtcgttgttgctgctgtcggcatcatttccggcaaggcgttcagaatcgttttcccgtagcgccgatcgctcagccgcggatccaagaccacggccacgccataatcatcccgtgttcttaaaaggcgcccgattccttgccgcatccgcatcgtcgctttaggcagctctaaatgataaaacggattgatgccctttgatttaagcaggctgctttgcgcgcggttaagaatctcttgcggcgagtcaaacggcagccgcgtaatgatcaaaagctgcagctggctgttgggcagatcgattccttcccaaaagctggctgcgcccagtaaaaccgaattttcgcccgtcgcaaactgtttcagcagcttttcgcgattgcctgtgattccctgagccaaaatatcgcgctgattaaacagattggtactgcgcagctgactgtagacctgttcaactgtcaccagcgaattgaacagcaccattgtctgacactgggtctcgttggccagccggtagatggtctggcagagataacggatgtagtcgccattatcggcgtcggctggcatcggcgcgtccttggcaatcaaaagccggctgttttgctggtagttgaacggcgacttgaaatgcttgaccttgacgttatctcgattcagatccagctgctggtaaagatagttggaacgcttggaggtaaacagcgtcgccccgacaaacagtgccggctgaaagaatggatagacctgttcgctgaggtaatgactggcgtttaagagtcccccgctcaatttcatcgtgctgcgctcgtgcgactgctgaaccgtcagccagaaaaccgcggcctcatcatgctgatccaaggcggacacgaactcgtgaagcacctcatcagccccgttcaatgctgccaattgggtcgcaaactggctcatcaggtagcgatcactggccagccagctgtcactgcgcgaggcaaatagatgatcaagcgcggaaaaatgcagctggacgctggctaatgactgttcgagattcatcatgactggtcctgacgcatccaggagtgcataaagccgatcattagcaacgacctgttcgatgatctgatcatcctcgcccgctgcgttcagcataaagctgcggtaaagcgcaccttgaaaatctgagaatgcctgatccagctgctgcagatcaccctgcagcagctcgacgttgtagatccccagcggcagatgcgcaaagacgtcaatcagattgcgctcgctgccttccttaaccaggccctccaaaacgtgagctgccgtcgtcaaacgttgaaaatcgacggtctgccgcgctttttttaaaatactgtcgcttaggtgctgcgcctcgtcaaccaccagatacggccgcagcgcatcgtggccaaactcagccgcgtgggcagccagataggcatgattggtaatcacgatcgtcgcatgctgaagctgacggttgcgccgcatcaaaaaatcatctttgataaacgggttgtcgcgactcagcgttctgagcccatgatgacggatctcggtaaaataaggcgactgctgagcattcagattcaattcatccatatcgccgctggtcgtctgcaaaagccataccaagatgcgcgccttaagcagctgcacaagcttagaatcctccacgatactcagtgaatgcgcaaattttgcaagatccagataatgatcgttgccctttacaaccacgctggcaacttcaaacggcagcattgcattaagctgcggcatcgttttttgctcaatctgctgcagctgcaggttggtcgccgttgaaaccacgatttgtcgatctggataagcctgatagaccattggcaaaagatagcccaaagtcttgccgaccccggttcctgcctcaatgatcattggcttttcagcatcatgagcatagtgattatagatgctgttcatcatcttagactgcgtggcgcggaactccagttgatcgccaaacagtttctccttagcctttttggtggttgggtaggcattcttgtcatgggccattggggttgccaaaggacgcgacttatgcagtacaagtccattgctgacatagagatcagcgcttagattctgaggatgatggcggcgtttttccagctcctggctgaacacgtctgccgtctgtttaggcagctgcagcttcatcttaaccaggcttgccagggtcagcgtaggcagctgatgaaccttttttaaaagatcaatcagcagcacagccgttgcctcagcatcactggcggcactgtgcggctgatcatgctcgattgccagataagagctcagatcgcgcaatcgaaagctcttagccgtgggcagcagaatctgggccagcgtcaccgtatcaatcgctggaattgccaaggcttgatgccctgcccgctccaactctgcattcaaaaacggaaaatcaaaattaacgttatgcgcgacaaaaatcgtatcgctaagcaggctttccagcgtatccgctacgtcatcaaaccaaggcgcgtcatgaacgtctgagttggtgattcccgtcagctgctcaatactatgaggaatcttggtgcgcggattgattttggtttcaaactgattgataatctggcctgcctgaaccaaaacgcagccaatctgaatgatccgatcgccatgcttaacgctggtaccggtagtttccaagtcaacgatcgcataaatcggctcgcgcttttttgactgttttttcacttgtcttcaccgtacttcgttatatttctcaccaccatgatactattcatttgtcatcttgaccattgttgcatctggatgtttggcatcaaaaagcgccaaaaaatataaaaatctttcagacatccccagattaggttaagataattagagaaacatttttgaagaaagtaggtttcagattgaaacaacaaggtattgggcaaagtcacgccaagattattctgattggcgagcacagcgttgtctatggtcagccggcaattgccctaccgctgccaaacgtcaagcttaaggcaacgctcacggctgacacggcatctgccagtcacgttgtcaaatgcagctgggcccaaggaaatttaaccagtctgcccgaatccatggcaggcattcaaaaactcatcaacaccctgatggaacgtttcaacggtcaagatgacggttggacactagaaatcgacagtatgctgccatccgagcgcggcatgggatcttcagccgccaccgcgattgccgttgtacgggccttttttgatttatatgaaacgccattggaccgtgcaacgctattgaagctggccgatgttgaagaacagatcacgcatcgcagtcccagcggcctggatgcggccacgaccagctctgatcagccaatttacttcatcaagggacagcctggccagccaatcgagctcaacctgcacgccacaatggtgattgccgacactggcgtcaaaggagccactaaagaagccatcatggccgtcagagagctgctggccactgacccgcaaactacccagcagcgtttggcacacctgggtaagctgactgagcgcgcacggacgattttaggccgcgatgatcccaatgagcttggacgcgtcttaaatctggctcaagacgaactgactgagcttaacgtcagcgatacggcacttaaccgcttgatccaagtcgcacggcaaaatggagccctgggtgccaaactgactggtggcggacgcggcggctgtatgtttgcgcttactaaaaccgctctgggtgctcgcaagctggccgaaattttaagacagcatggtgcggttgaaacctggattcagccattggcaaagggggatgaataatgacaagtgcagtcgcgcgggcgcataccaacatagcattggtcaaatactggggaaaacgcgacagtgagctgatgctgccgcaaactgacagtctttccttaacgctgaatgagttctatgccgacaccaaagttgagttttccacccagctgaccgccgatgagctgattattgatggtcaaccggtgagcggcaagggctttaaaaaagttcaaaaagtcttgtcgatcgtgcgtcagatgagtcagaccaatcagtttgcccgggtcgaatcaatcaaccacgttcccatggcagccggtctggccagctcagcttcagcctttgctgcgttggcaatggccgccagcacggctgcagggttgaagctgtcgcgccgtgatctttcaagactggcgcgccgtggttcaggctcggccacccgctcaatctatggtggcctggttgaatggcatcgcggtgttgatgacctcacctcatatgctgagccaatcatggaaaaagttgattttccgcttgaaatgatggccatcctgctcaatacggagcaaaaaaaggtttccagcacgctgggcatgcagcacgtcgttgagacctcgccttactatccagcctggcgcgaggtcgttcaagccgacatgcagaaaatcaagctggccattgaaaaacgcgatatcaatgaaattggccacattgctcagacaaatgccctgcgcatgcatgccctgaatctggccgccgatcctggctttacatactttaatgccgccacgctccaagccatgcacgcaatcgataacttgcgcgccagtggtacaaactgttattatacgatggatgcgggtccgaacgtaaaagtcatttacgatcgggctgaccgtagtaaaattcaagctgccctgaccccactgttcggcgccgacaatctggtcgtgtcccagcccggaccaggaacagtcttattggatcaaaaataaaccaatattgagaggaatatggaaaattgattactgcaaaagctcctggcaagctttatattgccggtgaatatgccgtagttgaaaatggctacccggcaattctggttgcgctaaaccagttcgttacctgttcaatcaaagtcagtcctgccgacacgggacgcatcatcagtgagcagtaccacgaaaactccctgctctggcggcggcaaggcgataaaatggtcgttgatcagcgcgacaacccattcgcctacattctttctgccatcagcgtgaccgaagaatatgcccgcagcctggatcgtcagctgcagatctacgacatctatattgacagtcagcttgactcagccaatggcaaaaaatatggtctgggttcttccgccgcggttaccgttgccacggtcaaggcgctgtgtcttttttatgatctgccggttgacaaggacaagctctttaagctggctgccatcgcccatttcgccgtccaaggcaacggttcattgggggatgtggcagcttcggtatatggcggttggatcgcgtaccactcgtttgatcggcaatggctggctgaacagcgccaatacctggatctgccgactctgctggacctgccctggcctgatctaaaaatcgaatcactgaccgccccagccaacctgcagcttttgatcggctggaccggcagcccggcttcaacttcgcggctggtcgacaagatctctttgtttaaggcccgtcagcaggataagtatcatcatttcctggaagaaagcaaggcctgcattcagcgtatgattgaaggctttcaccaggctgatctggacgtgatcaagcgtgagattcgcaaaaaccgcgagctgctgaaaaatctgggtgccaattccggagtccagatcgaaacgccgattctgcatgaactgtgtcgcattgctgaagatttcggcggcgcggccaagacttccggtgctggcggcggcgactgcggcatcgtagcaattgatggtcatgctgatctggatggtcttttagcggcttggcagactaagaaaatcgaacagctgccgttagcggttcattttgtcaactcgattcgccgctacaagctcaagatcaaataaatctgttcgcgcgccgctatttcgtgacgcgcgaattttatgtaccctattcaaggaggtattatggaatcgctgcaagctcaccgtaaaaatgaacatgtttcgctggccgaaaagctctattcgcaatcccatgccaatcatccgttcgatcaggtccgtttgattcacaacagcctgccggaaatggcactcagccaggcggatccatgcgttaagctgggcgaattgaccttcaaatcgcctttttatatcgaggcgatgactggcggcagcatgcagacggccaaaatcaacgctcagctggcagcacttgctcatcagcatgggctggcaatggcaaccggatctttaagcgttgccttaaaagatccccaggcccaggcatcttttgccatcgttcgcgaaaagatgccgactgaaccagtcattgccaatcttggtgccagcgtcgatccaaagcaggcccaaaaggcaattgagattctaaaagccgatgccattgagattcatctcaatgctgcccaggaactggtaatgccagaaggagatcgtgagtttttctggcaggaacgcatcaaaaaactggtcagtcagctaagcatccccgtcatcgttaaggaagtcggcttcggcatggataaaaaaaccattgccagactgcagaaactgggcgttagatacatcaacgtcagcggccgcggcggtaccaacttcgcggccatcgaaaatcggcgcaatcataatttcgacctgtcaatgctcaatgactggggacagacgacgccagaatcactgttggaggcccgcgccgttaaaaatcccgatgtcagtattattgcttcgggcggcattacttccccactcgacgtcattaaggctggtgctttgggagcaagtgcagtcggcgtggctggtcattttctgcacacgctgcttgatgagggcaacgatgccttagatcgcgagctggacacttggcaagaagcgatcctgcgcctgctgacgcttttgggctgtcatgattttgccgagctgaagcaggccgaagtagtcttaagtcctgaactgatcagctatgcaacccaacgtggcttataagccattattcaaaatactattttggacaattagaataacattttacatttaataaactattttacttggatatttttttgaaaacgttcacttgcgcgacaggtgaacgttttttaagtaatgacaatttggttggtcaatcttatactaaagttagtgagggatttctaattttttgcactgggaaattttaatttttgactgtaaggaggaggatgcatatggctgctaaaccaccaatggtcgaatttaagaacgtctccaagatttatccgggaggcaaggtagctgttgaaaatatcaatctgcgcattgagcgtggagaattcgtttgttttatcgggacctctggcggtggcaagacgacgaccctgcgaatgatcaacggtatgctgattccaactggcggcgatatcactgtcgatggtaaaaacatccatgatattgatccaatcgaattgcgccgcagcattggctatgtgattcaaaacatcgggctgatgccgcatatgacgattcgcgataacatcacgctggttcccaagcttttgaaatggcctaaagaaaaacgtgatgcccgtgccaaggaactgatcaaaatggtcgaactgcccgaagaatttctggatcgctacccttctgagctttccggcggtcagcagcagcggatcggggttattcgggccttggctgccgatcagcagatcatcttgatggatgagccgtttggtgccctggacccgttgacgcgtgaagcactacagcggctggttaagcgattgcagcagcagatgggccggaccatcatcatggttacccacgacatggatgaagcaattcggctggccgatcgaatcgtgattatggatcaaggacatatcattcaaaatgcctcgcctgacgatgtactgactcaccctgccaatgagttcgttgccaatctgattggtccagaacgtctccgccaggccaaggtcaaccacttgacagcagccgagatcatgcggccaaatccaatcaagattcacgctcagcaaaatctcggcgatgccttgaaccaaatgcaccaataccacgtcgacagtctgatggtcgtcgacgatgaagatcatctgaccgggattcttgacttaaagacgctgcgcaaccagcagcagccgcagttgattattgatgacatgaagcatgcggtaccggttaagatcaaggaagacgaacgcctgcagatgattacggaaccgcttttggaacggaattgggagtacgttcccgtagttgatgagcaaaatcacttaaaaggcatcattacccgatcagcactggttgacgtaatctatgatgccgtttggggaaccactgaaaatccccatccagccaaagaccaagctaaggatctaaaagaggcaggtgagcaataatgatggcattcttgcaagcacatgggaccgaactgatcgtcaaaacatgggagcagatctatatttctgctgtttcgcttgctttgggaatcattgttgcggtacctcttggaattgctttaacgcgttgtaaaaaaattgccagattcgtaattgggctggccagcatgctgcagaccatcccttcattggcactgctggccttgatgattccaatcttaggaattggcaagacgccggcaatcgtagcactgtttatctattccctgctgccgattctacgcaatacctatgccggcatggaagacgttgatccaatcttgattgacagcgccaagggaatgggcatgaccaattgggaatcaatcaagatggttgaactgccattagccctgcccgtaatcatggccgggattcgtctggcggccgtctatgttattgcctggtcaacgctggcttcctacattggggctggcggcttgggtgatttcatcttcaatggtttggacctttacgaaccggatttgatcatcggcggtacgatcccagttaccatcctggccttggttgctgactggctgctgggcattgtggaacgcaaactcacacctactacgagtcggggaggtgcggctaatgatcaggcatagaaatttaaagatcggggcgctgctttttagcatttttgtcctcgttttaggcgtcagcggctgcagctcttctactgagaccacctatcatcagcctaagacgctgcggattgctacccaaagctcaactgaatctcagatcatgggctacatgcttaaggatctgatcgaacatgataccaactataaggtcaagatggtcaataacctggggagctcatcggtttcacacaaggcgctgcaaaacaatgatgctgatattatggcgaccagctacacgggaactgatttgactgggactttgggcatgcccgctcaaaaagaccccaaaaaagctactaaaaccgttgatcgccttttaaagcagcgttacgatgagattcgctatccttcgtacggttttgccgatacctatgccttcatggtaacccaggccaatgccaaaaagtataatctaaccacggtcggtgacttgaagccggttgccagtcaattaacggctggggtcgacagttcatggatgaaccgcaaaggcgatggctacaacgactttgccaaggtatatggatttaagttcaagcgcgtctacccaatgcagatcgggttggtctatgatgcggccgaacaaggcaaaatgcaggttattttaggctactcaactgacggacgaatccgcagctataacctgaagatcttaaaggacaatctgcactttttcccgccatataactgctcactagtcgtcagaggcgcaatcattcgtcatgatccgcatcttaaaaaagtcctgcaccgcttggatggcaaaatcagtctatcaaccatgcaggagcttaactatcaggctgatgacgaactgttggagcccgctacggttgcgcaccgtttcttagttaagcaccactactttgaaggaggcgacaattaatgaagggtttgagtctatggcagcagttctggtactacctcggtcataatggcacctatgttctgcagcagtttaaccatcattttgccatctctgtctatggcgtcttactggcggcattagttggaatcccacttggaatcctgatttctcgtcaccatcacttaaatgggccgattatcagtatcgccaacattattcaaacgattccttccttggccatggtttcaatgctgatgctggtcttaggactgggggaccagaccgttatcgttgccaactttctgtattcgctgctgccgatcattaaaaacacggcagccggcctggacagcgtcagtcctgtttcactggatgccggtcgtgggttgggcatgacgaagtggcagcttttggtcatggttgaaatgccgctttccgtatccgttatcatggccgggattcggaatgccctggtcgttgccatcggaattacggcaattggctcttttgttggtgccggtggtctgggtgatattatcattcgtgggaccaacgcaaccaacggcggggccatcatccttgccggtgccctgccaactgctttaatggcgatcattactgactgggtactgggctgggttcagcataaactggcaccgcacaccgcgaaaaaagcgcaataaagccaaaactgcttcatttatggcaactgtcaaataaaaatagcgtcacctcaagtttttccggcttgaggtgacgctattggttcttaaagacctttttgattatgtattcttcaaatattttgccaatagttaattgatgcccagcagatatgcaaaaaatcttgtataaagcatatgacaaaaacctcattacctacttttcatcaaaaatcaatgcatagtaggtaattcacaaagtcggtctgatccaatcaacccctaccagtttctaaacctacgattcgaaaaaaattcgtctcaggtaggtaatgtttggcgaattgaatattcacttacctacttccggtccaaaaacgaagaatagtaggtaaatccagtcctataagctgttcaagattcgattttcttcacaaacaagcctgcttgaaagcatcaacgcccgatcatttactttatcatcaaatgacggctaagccccagctaaatcccagactgcacttgccaacaacgcgtcaattacccgtgcagtttccgttttcgatgtaatgcgaccggcttgctttgattatttcctgggaaaaccaaaacccgttaccaaaaagatcacgcatgcccgttcaagcaccgtgatctcatttttattgatgaagcatcttttctgccaaagcaaagttgcccagcgttgccgaaccattgccaggaacgcttggattcgtgatgtattcttccagatcgccgacttccagatagccattgtagagctgtctgaactgatcgcgaaccttttccataaagtgtggtcgtgaaacgctgccgccaaaaatcacgcgggcgggccgcagaattgacgttgcctgcattactgcctgagcagcataataagccataatgtcccagacatgatcatcgtcgcttacgtcttcacctcgcttaccaaggcgtgctttaaaggtcggaccgcacagcagaccttccagacagtcgccatgataaggacagatccccgtaaagttcagatcgtcaggatgccgctttaccaagacatgccccatttccggtgccccaacgccgccaataaagtgaccatcttgaattgctccggccccaacgccagtcccaatcgtatagtagaccaggtcggctttaggcagctgatcctttagattgacgtattctccataaaccgaaccattaacgtcggttgtaaagtagattggcaggttttgtcccagcccacgcttcagcattccgataaaatcacagtttgaccacttgatctttggcgtatcagtaatgtagccatatttagccgaatgcttgtcgatatcgatcggtccaaagctggcaacgctcatcgcctgcatttccggatattttttgaagaatgcaatacagttaccaatcgtggttgctgggtcaatcgtggggaagatcgccttatcgattacctcataattttcattgccaactgcacagacaaatttggtcccgccggcttcaatactaccaagtatcataaaattaatccctcgctcgttaaaattgtcctattattgttattcgtttatcaataataacgctttcttaattaatcaacaagtttttccggtttttttcaatatttcattgactttaactaaatgatcatttagtatgattaacatgagagaaaaagaccaatctaaaaaagctaaaattatccaagccgtttttgaaatcgtggatcgtgacggtctcgcggggctgtcatttggtaaaatcgccaaatgggccggcatcagttccggcaccccttatgtgtactaccgcgataaaacggacatgctctcacagatttatgttgctgctaaacagcagctggaatccgggctggacgaacagctggcccaaaccgactcaactaaagaacaactaatcacctgcctagagtattttgctcggcagtatataaaatatcctctgcaggccaactatatcatggccattcatgccgctcccgaattgattacgccaactgccaggcaggaaggcgcctcgtttaccaacagtctgagcggcctgtactgccgtctgtgcaaagaaagtcaagcagcagtcgttggcgaccagtttctggttggtgccctgctgctgggaccaatcatgtggcttttgcgtcaggcaaagctcaacaatacgcaagtcgacgatgcacagatcaaaagagtcgtccgcatttcggttaatggcttgtttgaagaagaaaatcacgaaactagtttatgaaagggaattgccaatgattaaattttactttcacacaaataatcctgccaaacggcgcgcggaaaaatggctgaccaagcatggccttgacttccaatcccgcaacctgaataaagatcctttaacgcgcgatgaagttctccaattactggaactctcgcccgatggcactgaaacactggtatccgaacgttccaaggcaaccaaagaactttacgctaaacaccccgcgccgacgatgaatcagctgattaatgccattcaagaaacaccacagattcttaaaagtccgctaatcgtcagtggccacaaaatgctgactggtttcaatgctgataagatgggggttttggttcctcatcagcagcggcgcctggaactgtcgcaactcttgggcaagcttaacggccgtggctcaagtcaagccatgcagctggcctacaattagcctccaaccttgtctcaaccgatgagatgaggttttttaatcttaaaaagcggtgccgtcctcacctcgggacagcaccgcttttatttacgactctcgttaggctgattgcatgatcgttcaagtaaataaagcgatctagaatcgaagcccttttggataaaaatttttaagcgtttgaccaaccagcttgccccagccgcagacatgcccctgacaaaccagcagctgccagccaggctcgccactcagctgcagcgtatcgccatgcacgtattggcgccactgatcaagcgtaatcgacaagacatggtcggtatccgtgggctgactggctaaggcccaggccagcgcgggttcaaagcgattctttttaaacgttcccaaatgcagtcccggccgcagaatcgtcatctgcgcgatctcatcgattcccttgggcagatcataaagctggtcgccataagtcagcagatgattagcttggtagctgggcatcgtttgggcagcaaacttttcaaataaggttcgctgctctttggtaatcgaattatggttagcgcgcggcttgccctttttcttgcttttctttttagctgataccggcatcactgaaccgccctgcagacggaatttagcaataaaatggccttcgccttggatatgatgcgggaacagacgcacggcacgacttaattcaggattgccgtctgcccattctggtcggccatcgtccataccggcatacttcttgatcggctccatggtcagatcatagttgtccaacagccaggccgcgttttgctcatcttcttccggggcaaacgtgcaggtggaataaaccagcgtgccccccggtttgagcattttcatagctgagcttagaatcttgcgctgacgattggcacattcacttggataatccggcgtccaatactcaattccggccggctctttgcggaacattccctcaccagaacaaggcgcatccactaagattcgatcaaaaaactgcggaaactgtttttcaaggtcagctgggctctcattcatcacgactgcatgccgagtcccccagcgttcaagattttcagctaggatattggcccgtttgcgaaagatctcattggcaaccagcagaccctcatcatgcattttggcgattaaatgcgtacttttaccacctggggccgcgcatagatccagcacacgctcacccggctgcggatccacgacctcgccaacgtacatggcgctgggttcctggctgtatacccaaccggtaacgtgatccagcgacttgccatcaaccttgccaaaccagccattttcaacatattcaatcttacctgacgctgttttcaacgtggcatccggttggccgttttttaaaggattggtacgaaagccgctgcagcttggctgatcaaacgcggccaaaaacgcatcggtctcattacctaacagctgacggtatttttcaataaaagcagttggtagtttcacaaaaaaagctcctcgtcataaaatatccttattattatagcattattctatcgccaaagccgttagatggagcttacgggttagaacgtcaacctttgagtcatacagcgcctggataaactcatcatcctcagcgtcataataaagatactggcctttttcgtttgccaataattcaatcagaatacgaatggcccgaccattgccctcgcgaaatggatgcaggtagttcagctcgtccaaaagcttggcgtatgcggctgtctgtggttgtgactgccgttttaaagcggtaatctcagcattgaccgagcgaatgccattgtcaaaaacgttcggcggcaaaaacaacgtctgctgcttggttagattatagttgcgcagctcaccggcccagtcgtatagatcgccaaacaaggcccggttgatccggcatagatcgtcaacactggctatcttaaaaccgcgctgcagcattctcagccctaccaatgaaccttgaacaaactcatgctcatcaagatccgctttatcatgaatgcccagcttatttttcaaggtgccgtttggatttaaaaaagtatgagctaaggcctgctcatccgtgatcgccggcttagcaaccggaacccgccaatgccgcagccgatccaattgtgcgtctaattcaggctgcgggtgatcatatgcatcagccaatgcccgtatctgttcatcggttggctcccagccttccacggcactgttggcaaccgtcactgccagtagctgaaatttgcgcggattgcgaaactcaacgccgccaatatgatgcgttttgcgattaatcaaagctgtcatgttgccatcttcccttctgaatctaattaacccaattgtagcgcgcccgttggccatcaaacaatgctttcaaacattaaaagctaattgtcttactgctgttgaataatttgcctttcatagccgatcatcgatataatttaagcagatactttttgcgaaaggaattttttaatgaagcagcatcttattgccatcgatctggatggaaccacgctcaacaaccagtcgaaactgacgccgacaacgatcaaaactctgcagacgctcagccggcagggtcatctggtctcaatcgttactggccgaccatatttgatttctggtcacctctacgatcagattggactcaaaacgccaatgatcaacttcaacggcgccctgggtcatattccgcatcgcaagtgggccggcgaatacgcggtcaacgttactcgcgagatgacgctcgatctgttggcgcataaacaggaattgggaatcaaaatggtgattgccgaggataaatatcacgtctgggctgaccatcccagcagcgatctgcccgaatttctgcctgctaaactggctcccgaacagattcttaacgaacataatctaaacaacgatccaatcgccttaacgattcagtttgatcccgccaaaaaagatgcgattttaaatgccgtggatcaaaaatatggcgatttcgttgaaccacgcgtttggggcggcccctattcgattatggagctgattcggcgcgggacgcacaaagaagctgggctgcgtcgcttagtcaaagaatatcagctcagtcctgatcagatcattgcattcggcgatgagcacaatgatgccgaaatgctcagctatgccggtcgcggggttgccatgaaaaatgccgttgacgacattaaacagattgctgatgacgtaacgccgcttgacaacgatcatgatggcttggctaaatatctgcaggattatttccatctcgatgcggctaaactgcagctggcagaataaacaatcattccaatgcgtacacgtaaaaacagcgttgctttaagctatcaaagcttgcggcaacgctgttttattttgaatgccaatcttatttcccgggaaatcgaatcagacggttttaataaaatactagtctttcttgatccaattaatgggaatccgcttgatatcaagatcgcgcggcgtcagtttttccttggtatgacccagcgtaatcgcaaaacaaggcgtcatccccgctggaattaccgttttcggcagcgatgccaggcaggccatgttatagttagcggccaagccttcattttcagcagccagctccatgttatgcacgatgatcccagcatcgataaattccagctggccgggatctggtgatgagacaacgatcaaggtcggtgcttgatagatattttgaatctgctttagtaccttgggatcttgaatcaccgtcagccgatgattgcggtatttccccaagccgactggactggtttccgcggccagtagaatcggctgcagctcttcactggtcagcggctgatcatcatattcgcgaaaggcccgccgtgactgtaataagtccatcaattccatttggatcatcccccttgctaagctcttgattgtctacgtttagtttagcaccaattttactggctgattgatatcaagaccgaaacatttggacaattatattcgttaatgctacattggcagaatctgtttgcctggcttaattaagcagttggtccatcacgtcagtacttccgtttcaatttgatcattgctttatttcagccgacagccaaaataatccaataaaaatggcccgcgaaatgaattcgcagaccatgttgagagagagaattttgattcaaaacgaacttttaattagtcgagttgagccttaattgcttctaacgtaacgtccttggttgcgtcaaagcgaatgtcggcatcatcaagtccggcaccaataccgattgagagctcgccagcatcgttaatggcttgaacaccggcttgagcatcttccagacctgccacgttggcaacaggcaggttcatcatttcagcagctgcgatgtagatgtcaggagctggtttaccatgctttaccgaagctgggttgacaatcccatcaaagtagtcgcttagcttcaagtacttcaataccttaggcgcgttcttggaagctgatgccagtaccatttgatagcccttggcacgaatatcatccaagaaagcctgcatgcctggcagaacatcagctggcgtcaaggtttcaaccaaacgcaggtagttgtcgttcttttcagcagccagggcttccttttcagcttgcgtgtagtcgttttcgtgaccacccgcctttaagatcagctccagcgaatccatccggccaacgcccttcagactttcctgcagttctggcgtccaagtcgttcctaccttgtcggctaattgatgccaggcttgcgtgtggaaacgggccgtgtcggcaataacgccgtccaggtcaaaggcaaaacccttcagatcttcaaacttcatgtaaaattcctcctacttcagttccagatccttaccagccaagtcaatggtcagtggttcaccggataccagtgatacgtgcgtgccttccttgtcaaccagcaccttgatgacgcggccacggaagacctgcgtgaattggtatgaatcccacttcttaggcaggaatggtgcgtagtgcagcttgccttcacgaatccgcatgccagcaaagccttgcacgatatccagccagctaccagtcatcgaagtaatgtgcagaccatcggaagtgtcgttgttgtagttgtccaggtcaagacgagcagaacggtcatacagttcaacggccttgtcttcgtaacccaggtcagcagcgatgatggagtagatcgatggcgacaggcttgattcgtgaaccgtgtattgttcgtagaagtcaaagttgtgcttcttttcttctggcgtaaagtcgtcgatgaagtcccagataccttggataacgtcaccttgcttaacgtatggcgaacgcaggatcttgtcccatgaccagtgttggttgattggcagctggtcgcttggaatgtcggcaaccggcttcagatccttgtccaagaagccatcgttttcagggaagatgtcacgttccttgtcgtatggcaggtacatgttgtcaacgattgcctgccacttgcgcttttcatcttcagtaacgttgagcttggcagctacgtcagcgtcaacttccttcagcacttgcagcgtgtacttcagcgtccattggcaaagcaggttcgtgtaccagtcgttgttgacgttgttgtcgtattcgtcaggaccggttacggcatgcagcatgtacttgttttgacgttgtgagtagtgaacccggtcggcccagaaacgagaaatttcagtcagaaccttggcaccttcatgcagcacgtagctcttgtcgcccgtgtagttggtgtagttgtagattgcgtaggcaatgtcaccattacggtggatttcttcaaacgtgatttcccattcgttgtggcattcaatcccgttgaacgtaaccattgggaacagagcacccttcaagccttgttcttgagcgttgacataagcgccatccaattggtcgtaacggtacatcagcaggttgcgggaaatttcaggatcggcaacacccaggtagactggcagacagtatgcttcagtatcccagtaggtagcaccaccgtatttttcaccagtaaaccctttaggactgatgttcaggcgtgaatcattgccgtagtaagttgagaagagttggaacaggttgaagcgaatcccttgttgagcttcgtcatcgccattgatttcaacatcggccttgttccagcgttctgcccagccagcaacgtggggagccagcagatcatcaaagctttgaccatccagttgaccagccaattcgtccagacgtgcaaccagtgcttcttgcgtgtcaaaatcacgtgaggttgctaccacggaacgcttttccagttcaacttctgcatcagcagccagcgtgccggcaaagtcgttttcagccgtcttggcagtcgtgccgtcgccaacgtgttccagcgtcgtcttggtagtcgtctttatcccaaccgtaaattgaggcgtgccgaatgggtttggcttcgtcttggaaaccagcagtgcatgttcgccggctgccttttgttccagtacatcccagaactgttcatcatagttggagtcttcgttgtagacgtcaccattgataacactggcaacttccagcttggcttcagcatcgcccaggttcttgacgtgcagacgctgaccaaccagttccttttgggctacgctgacaaaacgttcaaacgtaaagtgcagcttggcaccgccaacttcggccgtaaattcacgagtaaagatccccttcttcaagtcaaggtccagtttgaagtcagttggttcctgcttagccagatccagctgttcgccattaaccttgatcgtcagctgcaggaagttggtaccgttgatcatcttgccaaagtactttggatagccgatcttccaccagccgacccgtgtcttgtctgggaaccaaacgccaccgtagtagacaccttccatcttgtcgccagagtagccttcttcaaagaaaccacgcatcccgaggttttcgttggccagactggtcattgattcttgcaggcgtttgtcttcaggagcccacttggtagttacgatattccaaggagcgacgtcaaaagttcgtttcataagatattatcctttctcaatctcaattaatttctaagttgcaaaatcagtcaaaactaagcagcgaacgtttccttgatggcgttaacggagaatgcaccgattgccattacgatcccacccagcaacagcatgtgtggttgggagttgcccagcattgggtaaaggaagaagctgcaaagtgaggcaacaatctgtggcagacagatcgagcagttgaacagaccaaggtaggtacccatgtgcttaccagacaatgcgttggtaacaatcgtcagtgggtaagtgttgatacctgcccagccaatgccaaccagtgcgtaagacagaatcaaagcgtattggttggagaagaagcagaccgttgcgaaaccaaccgcacccagcagcagcgagcccatgtagccagccttgtggtacttgttaggcagcttagccaatacgtaggaccatacaacagcggcgattgactgaacggcagccatcacaccgtaccagttaccagcagcctggtaagcggcagaacttgcgttggtcgtgtgccatacgttttgagcaattgcaccagcggagtaagtccacaggtattggaaagcaaaccagcagaagaattgtaccaaagaaaccgtccagaaggccttgggagcgtgcttgagcagttcaacccagttaccgccttccttgttgtcggattccttgatgccatggtacttagcgtaggtttcagggtcatattccttaacgtgggtcatcgtcaaagcactggtacaaatcagcagaatagcaccaatgtagaaggcccagcgaaccgaaggaggaacgacacccttaggagccgtgttctgcagaccaaaccaagtcagcagaaatgggaagacggctgccagaacggaaccgatgttgttcagcagactctgaataccataagcataactcttttgatcatcgttgaccatgtcaccaaccatcatcttgaatggctgcatggcaacgttagaagacaggtccaagaaggcaacggtaattgcaccgaacatcaatgctgcaaatgatccatacccaaagccaagactacctgagtttggcaagagcagcataacgatcacggcaacgatcgtaccaagcatcagatatggcagccggcgaccgccaagttttggtgcccaagtccggtcagagtagtaaccaacgatcggctgcacgaccatacccatcaatggtggcaaaatgaagaaccacccaagactgttagggtcggcaccaatcgtttggaagatccgactcatttgagaactttgtaaagtaaaggccgtctgtacgccaagaaaaccgaagttaatcatccaaatcgttttcttggacaaatatggcaagccagaggtctgtttctttcgtcctacttcactcatgacttaaaactcctatcctaaaaaatccactcaataaataattgccaagtcgtgtaagcgcttcatgacttttttaacaattaataatatatcaaatgaattcgttttccgcaaccgtttgcacacaatttaatgcaaccgattgcgcaaaaatcttaaagaaaagccggcccatcaaggaatgcaccgacttaaaaattttttattttttttgacgattaattcctacgctttgaaatcaatcatgttttttagtatttcggcagtctaactggcagctagtcaaccttaaaggcaacaaaggcatgctgcagattaggattgaacagcaactcaaccgcctttttgcccagctcatgcggctgcagatcaactttttcgacggttggcagcagcatccccagtaatttgctgttgttaaagcagatcacggaaagccgatccagcagatgcatttcctgcagctcatgattcagtttcaaaaacagcaggtcatcggcacaaaccagtccatcgaccttgggatgctgactaaagaattcactggccgattgcgtgtcataataccagtccagctccggcagatgccactccgccagacagttttcgtagcccaggcgccgatcctcctcatactgccaatgatatggcgagctgacataggccagattagtgacgtcatgattgatcagcagctgtttggtagccgcatagcctgccgcgacgttatcgttgtcaacatagcgatcgttttgatgccgctcgggatgaccgattaccacaaaattatagccatgctcgcgcagataggccgctactggatcatgttccagcgtgtagaacaatagaaagttatgaatttttgactgcagcgccatggatttaaccgcgcgcagcagtttttcctgcgtgggcgccaatgcaacgaccattgagtagtcgcgtgattccaacgctgaagcaattccccgcatcaagtcgatatgaaatgggttggctggcgcttcatcggtggttactggaaaaaccagtccaaccatattggcctcgccccgggttagattgcgggcggcatagtttggatgatagccgatctcaacggcaatcttcttgattttttcgcgcgttgcctcgctgattcgcgggttatcatttaaagctcttgaagccgtagaaaccgagactcccgcgcgtgccgcgatatctttaattgttgccatgaactgacaaagcatcatgccgattcaagtagttcaagattgttgaactggcaaaacaggcatgactctcctttcattattatatagttggtttaaatcaatagatgacccattgataaaaaacagactgcaactaagcatatgcttgaatttcaaaagtttgccatatgccaaaaatattgatttgattttgaagtgaataacttaattttagtcgtatcatggcaaaagggtcaatagtcgtttaggtaaaaggattaactattttaaaaccgcgcttcctagttgaaaatcaaccggacaacgaacccgcttaacgtccagtctgttgcttcggtttggcgagcatttcattttttagccatcaatttggttggctcatccccacaccgtacttgcgattaaaacagtttttttactcacgcggtacgatgcggccatctgggtagacgtaatagtcatgaccatcatagctgccagccgtattatgcgcgttgcgatatgccgaatcctggccccgaatccaataaaccggctgaccattcgtatcggtagccatcgtgccgtttccttccgacatgtaggaccattgaatatcgccattgccatatttggcgtcaaccgcggcaatcgcttcttgaaccgaattgatggcagcggattgaccagccgggctccccgcgatctgactggcgttttgatttgtacctgtcacttggtcagctgcttgactggcactgctcgatgtctctgatgatgagctctgcgccgtttgactgctcgaaacgctcgtactggaagcagaatttttggaactggccgtttgccgggtcgcttttttggccgtctttttcttatggtgtgttgcttttgaagatgtttcctgctttgctgacgaatggttttcctggctctgatgaccgcaccccgctagtatcagactgctcaagccaataataccgagcatctctaaagattttttcataattgcctcccgtaaccttaatttggtttgtcaagtttcaatatcagcatgatctgattataccgccgtcatcatgccgattgattaatggtaaaatagtcgtagtacttcaaatgaaatgaggatgtcatcttggccagcaattttgcctttttaaaatcttatcatggcatgcataaactgcatcatctttctcatatggctgaaaaagcctatcgtaatgggcagtttgctaccgaagccctgttgatcagcgagatcagcggtcgtttgattcgcaagctggtaaaacaagaattgcccaatctgaatcaccccttcaacagcgaggatggcttgatcatgctgcagacgacgcaactgctcaatgatgagctgatcatgctgctgactcaattgcgcgcggccggccgccatcccaaacgaatcgacgcggcttttgcctatcagatcatggttaagctgcactatctgcttatctggtacgtcaatcattatctggatggtcatgaggaacccggccattttaagttgcaccgacattaacatccgaaaacaggcagtgctgtttcaagccccactaaagcttgagacagcactgttttttaagatcaaattttctcgtgctgcttgagcatcttaagagtcagcccaatcgtcagcagcaggcgtatcaacaataaaccagccaaaatcagatcacgccgccgtttttggcgcgccgtcttgatcgtgtggccgcattttgcacagattttttcgtgagccttaagcggagttttgcagtgtggacatttcattgacaacacgtcctttctagtttagctgtctttattttacgccgattcaaccttactgagcgttcttttcaataaatttccaagctgggtaaaacgctattaaaacagactttttaggctcttttttattttttattcaggaaatttccgaaaaaggcttgcacttagtaaaccgttatactattatatttatgggtcgtaaggaaagtgttttcaatcctgcttttctttcataacttgttttatcgtgaaaccgttcgtgcaggcagtcgacgatagccatcctctaactacgccaagtttgctgatgactgtcaccgtcaatccatcgatctgccgccaacgtttgaccgacccttccttcgaccgttgtagtacgccaactccagcggtcagatgttcatttaacctcaaggcgatccttcgtctttcctcaaaatcgtgaagctgccggtactggtatgccaatccccagtgccggactctcaatccctttaaatccactttaaggcttcacgtctgatcatccttgtttggcaggctcatctcttatgactgactcttgttcactctaatcattaaaaatttaatccacattacatccatgagcctgcagacaactaaaaaaccgtcatcgaatgcaaaattcggtgacggttttttattactttgatttgactttactcagtgcatcagcaactgcttcactcagcgcgcggctggtcgtcgttgctcccgagatggcgtcaacggctggcgtattggcactgatcatgtttttggcaagctgatcaaaagctgcctgaccaatttcttcgttttcatgattctccaaaatctcaacttgacgcagcttttgattttgataggttacacggacaacgattcggccacccatgccatcatccgaaacgcccagatactgatccggccctaccatataatgctgagccgacagatccagcagatcattaatatgcaccgtaaccgcatcatgcagccgcgcaacgttgacggcatccttttttggcttggctgcattttcccccgcaatcttgccaaaaatcagacattcagccaggttgccgccactctgataataattagcggcaattccacccaattcaccggcgctgtataaatgcgggatcggctggtcattaacgtttaagacgcgcgctttttcatcatgctgcggtccgccctgcgtattcaacacgttgctggccaatttaattgcatagtacggccccgccccgaacttacgcatggtatccgtatcacgaccggtctgatagtcacggccaatctctttaaaatgattgaagtcagtaaccgtctgcgtcaggctgattgccggcacgtgcagctgtttagccagttctggcaatgaatccgcgctgagcagcttttgcataaactttgggtagggcaggcgccggtcatctttttcctgctgagcaaaaacctggtactgcgcctggtcaaataccagataaggatgtttttgatagtgcggcagaacccaatggccatgtgaatatagatggccatgacgcgcgggctgattttccgcaaaaaagcgcgtcccatcatcgccaatcacaaaaatactgccatgattcaactgcgaccagctttgaattacccggccccgatgctgcgtcccctcttcagcaaatgtcagtccggccagcgtgtcatagctttcgtagtttcccatgtgccaaagcttagcctgaacttcttgggccattttaatgccatcgccacggttaaacagtgttcccattggcattagcgccggtttttgcagatagttttgaatcatttcccgattgttttcaaaaccgcccgttgccaaaaccagaccattcttaacggcaatccgataatccttaccgcgccgacgcagctgaacgccctttaccacgccggttcgttcatcctggtacaaatgccgcgcccgcgtgttgagccagacatcgatccggtccgcacgctcaaccacgttttgccgcagtatcttccatagcgccgcatccttatcacgtcggtgaaccagggcaatgtcgactgactcgctgtcggccagttctggatactcagccagcgagtgcttgggaacgactggatcgcctaggcggatgtcgtctttccagctaactgccttaacgcccaggtacttttcaaaatagtccggcatatttaccagtccgcgcagatatgtctgcatcagcttagccggtaccatataatcgtcattgagctgctgatagtacttggtcagctggccgattcctttgcccattgcaacgtgctgtgaggcatagcgtgtattgccgccttctcttcccaggggtgccgtatcaaccaataagacgtatgctcccgcgtcagccgcaaaccgagctgccgtagcaccagcaccgccaaagcccacgacaaccacgtcatattgggcattccattgaacatcattggcttgcattaattttcattcctttgttctatttaattactcttttagtctaactgaagccagcagccaatgccaactataaaaagccgcccgtaagcgacttaattgatggaatatttgctggtcaacattgattcaattgcaaaaccgatcgttgaatctgatccattatttacttcagtatcaatcgtctatactaaaattctcagtcgttttgtcgtagcagaaccgtcttgacacataaatcagccgccgctaaacggattaggttgtccagtcatggcagagcccgaaaaacgcatttccaacaacagcaacgtgacatggcctatcaaccagcttaatgccctgcccttgccaattgtccagtggtgattttaagctgttatgataaaaccgaacgtgacggccttcataaatctgaatcgcccctttctgcagataagcgaccggtatgaattcgacctgcgactgtgcattacggcattccgaccatttaatcggctccggcagctcaaagtcgtcaaagcgtgcgcagttcaatacttgttccaagaccacgcgcccacgaaaaataacgttatcgcgctccgttccgcttaacagctcgcctggcagaccatcagaaaaacacacctgttgctgatagtggctttccagcattttaagctctggcggcaaaactgcacagtagccctttgaacaatggtaaaccgtcaactcatacgtaagcattgttatccccactttaacaatcactgccagactcacccctccatctgacacgattaataaattattttttatttaatttaatcaataattaaacgcatttggtggttcatgcatgttttttattattgcaaacattttcatattttgcaaaatctgttccagacagttctcattaacgaaacacggttgcatccaggctcattttcaactgtagctgtgcgcagagatgctgctggatccgaccccattgatgatcgccagtataggtcaaccaccatcggctaaagtcgatggcttgtgggcaaacaccccagtattgagtatccgaaccacaatttgcatagatacggacgatttactcgaacagccgcagttgcttgagcagtgatcatctaattaccaatgccttttacattcccaggttgccataggaatgagcctagctttttgactaggctttttgttgtttctggagtcctttttctagaatatttagcgctgcattgtaatcacggatatgatgaacatggcactgtggacatatccattcacgatctgccagtgtcagcttttcggtcccgttacttcccattacaaagccacagtcatgacaggtttgggtcgtgtttttagggctgaccgtgataaattgacggtcatataggtcggctttgtatgacaacatacccaagaaagaccgccagccaacatcactgatgctcattgccaaggcatgattttttagcagattcttactcctcaattcttcggctacaacgagattttagcgactaacaagcgctgcttctggtagtttttgctttcccgcaaagaacgctgctcttttttagcccggcgctggcggcgtgaaagagtgcgctgtgctttagctaattttcccttgattgttcgatagtagcgtgggttagcgatggttcgaccatcactggcagtcagaaagttttctgtgtttaggtcaataccaatttgccgattggtgcggctaagcttaggaacaaacggtgtatcggaacctaattgcagcgacaaaaagaatcgatcggcagcatctttggaaatggttaccgtaccaatgcgtgtttcgccttgacgatccaatagtcgctgctgagcgcctttgatccgcaaacgtcctagtttaggcaccacaatatgtttgcggtcttcaaagcagacggtaccgttgtctagccgggccgtcttttgctttggatattgacagttggtctggtatcgccaggcatagcttttacgatgaaattttggcacaccggcttcatgaaccttgcgaaaagcgttccaagccttgtgatagttttgaattgcattagccttagcaagactgtcaatacgcttatcttctaaaaactggaaatgatttgacatctgcttagcgttttgacgaagctttagctgttggatccgatcttgaaccgtatcaattgacagtttgattcggtttaattgccagagttctttaccgatcgcaaccatctcattatagacgaaacgactggcatcgctgttaaccttgattatttgtttctggtaatcactcggatagatgcgaatcttcaatccataatgatattctaactgggccattgacttcattttttcacctcctttaattggattatatcatcagctaatgactataacgattgcggtgttcttaatgactaaagaaaagattcaagacgcagtttatactcgtcgatatatctataattttcattatcacttaatctgggtaaccaagtatcgtcaccagactttttcaactaagaaactggtagacgaaatgaaagacatattgcgaatggttgcaaaagataacgaaattgtaatcgaaaagatggaagtaatgccagattatgttcatgtactgatcagttttccacctagcaaggcgccaaccagcgctatcaaagcactaaagaggcgtagtgcattcatctttctcaaacgacatccagaaattcgacaatcacaatattggggtggtcattatggtctcccagctactatatgagtacgcttggcaatatgagtaaagatgtagtggaaaactatatcaacaatcaaaaatacaatgcactccaaaagaaaaagcgtctaaatggacgttgagtgagcctatccatcccatgactaaagtcacgggattttcggctaggcatagttaaatgctctgctagaaatttaatgccgccaaagaatgttgttagtgcgatggaagctggcagagcttagaattttacgattgcttcaagctgcctgcgttattttcgatttttccggaccatgatgcccattaacagcttaccttgtgaagcaaaaccggcactaacaaccagtggctttgaaattacctaccattcgctgtttttgcgccagaagtaggtacctgtatattcaatcagcctaactttacctacttgcagcagcttttttctaaatagtaggtaaagttgcatatttaaggagtgattgggccagaccgactttgtgaattacctacaatttggggattttcggccaatagtaggtaatgttagggacgcttaactcgatatacattattttttacctactatacaatgcttttttgaaaaaagtaggtaatgatatttttatcatatgttattattcagtttttcatgaataattagacattattgcgtttgtctgggccgtttaccgactaaatctgcaccatcatcggctacggatcctttttatcatttattattgcgtattactcgctgctgaggtatttctgacaatcgatgagtccagtcattcattgcattgatcatgatcgatcggcttggatcagcttttctgactgattgataccaagattcaccatcgaaatcaaacatttgatccaattctatggcagctattttccaactaggtacgtatattatttaaaatcattgataacacttaacttggagtagaaaaaagcgtaccaatcttttgccatgcaacacagcgagctctgaccagacgcacatcagaagactgtttcgtcagccaataaagtttaatgctatgaccagtgttctgactcaatagcggctaaggcaaatgtttcggcagcttataaaatttaatgcgataaccagatccacatcgaggtaccgcttctaaaatccataaatttcaatcgtacatcacagcatcattttttataatcaataaagctcaaaaaaaatccctactcaaatctgagcaaggaatttttatcaagtcgggaaaacaggattcgaacctgcgaccccctggtcccaaaccaggtgctctaccaagctgagctatttcccgaaattaaatcagtaattaatattaccaacagttgtaaatactaccgcgttttatttaaatcgtcaagcagattttataatcatcgttagctcaataattgtatcaatacaatttagactaatatctggctacgtcttgtcagtaagtggcagccgccgtatagtaagatcatcaaattaaaaaatgattagagaggattgttgatatgatcaagcccgccctgttgattgaggatttttcggcattaggtcaaatctcattgattggtgccctaagtgtcttgcaggcaatgggaattacgaccgcatccctgcccgcaaccattttatccagtcaaacggagggattcggccagcctgccgttttagacaccgagcaatggattcaggcttcgcttagacattggcaggcacaagacattgaacctagcggcgttttaattggctaccttggtcaatgcaccctcgccgaacagctaggcagctggcttgaacagcaaaacctgactgactgcttaaaaattgtcgatccggtgatgggtgatcaaggccgactatatcctggatttgatcacgattatgtcgaggcggtcaaaaaactatgccgtcacgctgatctgattacgcctaactggactgagctttgtttcctggctggtctgccatattcgctaccaactgctgagacattaattcaagggatagatcagctaaaggcagcgggaatcaacgccacgatcattgtcaccggtgttcatttgaatggacagattggctgctgctggcgtcaagatcaacaaaccaaatttgattggcgccaacagcaaaaccggcctgagaatcttctgaatggttccgattcacaccagagtctgcaaagcaacagcgattgttatcataatcaaccactgaatttttgcggcaatgacgttcagtccggtcatttctatggtaccggtgatatcttctcagcactgctttacggtcggctactgcaaggttggtcgctggagacagcagttgagaacgcgacggatgccatggagctcgcaatccagcagaccgctcccctccctgacaacgagcggcgatttggtctgcgtctcgatcatttgattcactatgtaagcaagcataagaggagtgattttaatgaaaaaatctgcaacggttagacatttggtattcacggcgcttttgacggcgctgactttgatctttggtcgtttcttcctaattccgctaccttggacacatggcaacatcaatctctgcgatgttggcatttttatcggtgccatgctgctgggaccatgggcgggcggctttatcgggggctttggcgccatgtttctggacttgatttctggctttgcccaatatgcaccattttcgttcatctcgcacggtttggaaggtatcgttgccggattggtctttaaatacgttcgtggcaaatggggccgcgttgctggtgtggccgcagggacgatcgtgatggtaatcggctacttcttctcagatgcaattctttatacctgggcaactggagcagccggtatcttcccaaacctgattcaaggaattgtcggctcggtaatcgcgcttttgattgcctcgccagttgaaaaagccgttcacccagccctctccagtaaatagcaataacccattaattataagcatgacgctgcatccagacgataactgtttggagttggcgtcatttttatttttaggctttaaaatgttttttgatcaactggctaaattaaggaaatgaatccccttatgttatggcggcgttttcattttccaagctttgggttaaaataaaattatcgtatttattgaaaggaatatttttatgaagggtgcaatttttaacgtcaacaatctaatcgtcgacacaaatcagcagcagtttgacgcttggcgcgaactggcaatgtatgaatatgggctgggattacctggcaaactggccccgcagctcaaaaacctcagtgccgccgcagctttgccaattgttttgaaccagctgcaccaaacggccgatgaagctgaacaggccgccttgctggctgaacaagaacaaatgtatcaaaaagcgctggactcgctggatgaatcttcagtaatgcctgggatcgaacgtcttttgatcaacctggacgatcactacgtcaacatgggcgtcgtcgataatggtggtcatgccgaactcattttaaaacagctgcagattgccgactacttcaccgccatcatccctaatgagggtgatccttactccgcctttgcccaacagctatcggcagcgccaaacgaatgcattgctctggctaccactccagccgatatcgctgctatcaatcaggctcacctgatctcaattggtattggcgatgcaaaacttttgagtgcggccgactatcaggtagctcaaactggtgatctgcggtaccctatgctgcgcaaggtctgggaagatcaccacgaaaataaataaaacggctgcttagttcaattagtcagcaatcaattaaagaacatttattctaaccttaaataagccgatttatccacaactaagcgcaagagatttttggctagcataaaacagcgtcatgcctgggctttttcccctcgcgatgacgctgtttttattaatattattgatcatttaaaactgccgcaatcttcgcaatatcagcgggcgtagtcgtacagcagccaccaatcgcgctggccccggcgagcagccactctttcgtcagtttgccaaaatcatcttcggcaggtgctgctgaccaggttttagtcgttgcatcatagcttgctcccgaatttggatagacgattattggcagtgccgtagcttcttttagtttcttaatcgctggcgttaccaggcgcggcggaatacagttgaccccaacgccaattacctgatcatactgcgcaacggctttggcagcatcggccagtttagtcccctcactgatggtctcggcattttgcaaagtaaaggaaacatatactttttggtcaggatactcattttttagcagatccaaaaccgctttaacctcactcaattttggttgcgtctccaatgccagacagcctgaaaaaacactgcccaaggccatccacactaccctttggcgtcttataatctttttcattggttccatgatcgtaatggccgccttgattccataccaaaaagctggcgttactcaaagtccattcgtctatgtctttaagatgatgggcattccatttgccggtgacattatgaattttgttgtcttatcggctattatttctgcggctaattccggtctttatgcctcgactcgaatgctgtggtcgcttagtaatgaaggaatgctgccgaaattctttactaaaaccaaccggcgcagcatccccacggtagccttggcattcagcatgctgggcggtatcttggctctgctttccagcgtgatcgccgctgataccgtctacttggtgcttgtttcaatttctggattggccgttgtttttgtctggatggcaatcgccctggcgcagctaaatttcagaaaggcattcctagcacagggacatcaaatcgatgagcttttgtaccgcacgcccggctatccgtttgttcccttatttgctttaatctcaagcggtttatcgtgtcttttgatctggtttgatcctcagcagcgaattgcgttgtattggacgctgccgtttgttttaatttgttatctcggctattggtggtggcaaaagcgccatccggagactgccgatacgaataagtagttttgtttagcatccacttgatcaatcagggggatgcttttattagttatgataaaataaaggcagtattcaaaatcgaaaggaggcaggcccttgctgcgctatctaatcagcattctgattggcggcattctgcttttgatctttaaggactggcttgggatcagccgaaaacatccgcctcgtcaaaaagctactcaccagccggatgccacatctgagcatgaaccagaaacaattcctccatcgacgtcaaatgttcatcaaccaacaataatcgctcaatcagcgccaaatgagcatggtcaatcgataccagacgagcataaaccggcagtggctgctcaaccgttgccagatgatcatgaatctgctgaatcactgccagatgatcataaaacagtaaagaaagatcaatctcggccagtactggtatctgagccaaattctcgcgatgctgtttcacatgaaaatgactctgcccactttactgaacaaggtttcgtggccacaaacggcgacagcactactgaacagcaagacatttcatcgcagactgaagctatcagtttgaatccagcacaaaatgatcttcagcacgatcttggcaccccagaatcaaagcaggatgccgctcaactcgagcttggcaactcaaaatcaaaacgcgatgccgctcaatacgatcgcaaaagccaaccgaatcttggcaacactgaaatgctggccaatccagcgtcaaagcttcaagatcaaaccagcgtgccgcctaaagatgattcaaaggcctcccctgatgctgatttctcattcaggccgcgagctaaatcaaaacgatcgccttttaaatcatggtttagcttcaagcgtccagttaattggtcaacggctgcgcaaccgttgaactggtcaaatctgcttacgaccaggccgatcagcaatgccgcctacttagagcagctgcagcagtgggatcggcatctcagtatggtcgcggatcatgatgagattgcgacccaggcccggcaaaacttttctgacgcccagaagaacgcctttttccaagatcccttccctggcctgcgctttttagcttatgagatggtcaaaacctattcttggtacagccatggtacggatcgctccccacatgaactggccatgctctctaaagaccttaaaggaatcattcagctgcatgagcgcgccacgcagcttttgcagggagatatcggggagcgccgcgtctatcaactgctgcaggagctttatcctcatgaagaactgttggactcgctcaacctgccttttgactattacaaaaagcaaaataccgctgccgttaaccagatcgacattatattgatcactcgcaacggggtcttgattccagaggttaaaaactatcaaggcctggcgctgcagctgaccaaggatggcgatttcatcattgcctaccccaacggctactgtgaacagattaaaaatgccgctgagcagctcagcaaccacgagcatgcggtctcacgcctgttatttgaggatgccaacgcacgccagattttaatgaacgcgcaacccgtcattcattccatgttcgtggcggccaaccccgatcaagcaaccatgcccgcccctggaatgcgaaatcgactctactcactgtcgcagcttgatcagtttgccaagtttaaggccaagcgtccattaaccggtctcgaacagcgctatctcaaagaactgctggccagtcgcgaaaccagcgaacgcgaatacgagcagccctttatcatcaatctggccaaactggaacgtcagctgcttgcgatggcagctttgaatgatcagtatcttaatgacaacagtccactgactcgttatgttgacagtgacatgctgaccagtctgcatcgcggtaatttcattgatgatcattgccggctgcgctaggtcaagtttgaaacccggagcgctgacttcgcgaacttatttctagaaaggataatcttcttgcatcaaatcaatacagatggtcaatggctgcatcttttttatcaaggtgaagaacgtgatgacggctgtgctaacgaattgagtctgcagcctgctaatgacgagtaccgcttaaacctgcttttgagcaaccatggctttaataacgagccgcatgacgcaactttttcacttgatcaagctgacgttaaggccttgcagaaatatttaagcgcttggctgaatgaccaacaaaagtctccgtcatcacacgaagcagactcatgcgaccaagcttaggagcgtaaaatgccctgtcgcccaatccaggcggcaaggcattttagtttttaatgggtttgctaattttaaacccttcaaaccagccaacgccatggttagcatcattttccgcagaaatcacaaatcagcatccatcctgcagcctactgatagatacagtccgttgatcccataatccatcacagcacttctaccagcctcacgaacctccctggactttgaaaaaacaatctatcgggcaatcaccccacccccaacgctactatactctaatgcttgaaccaattgataaaaaatcgcccaccctgcttttgacagctagagcgtgcgattaagcattcaaagataaattcagttattttccagtattgattaccggctgcgtgccacgttcactaataattgctaccattatattgttaatgacctgcaaacgctgctcatcagttagatttaaatccgtttccttagccagccgctccatggcatcttctgtgatcgaaacggcgccttcaacgataatcttacgtgctgacagaatcgccgcggattgttgtctttgcagcatcgcactggcaatttccgtggcatatgccaagtgcgtcagccgcgtttccaaaatctgcacgccagccacgttaagccgttcctgcagttcttgtgtcaagcggtcagaaacttcagtcggattcccacgcagcgtcagcttatcctgctcatcaaatgtgtcgtacggatattcgctggcaacgtgacgcacagcagactcgctttgaatctcaacgaattcctcatagtcatcaacattaaacagagcctgcgccgtatcaacgactttaaagactactacggccgcgatttcaactggattcccttttgagtcattaaccttcaaaatctgagagttaaagttgcgtactcgcaaggaaatgctctgcttgtccgttaacggcaccgtcataaacaggccggcatcgcgaatcgtgccaatatagttgccgaaaaaagtcagcaccttagcttcatttggctgtacgatcgtcaatgctgaagcgcacagtgcagccagcaaaatcaaaacgaccccgactgccagctcaccatgctgctgatcagcgtaaccgcgatagcacagccaaactcctaaaaccgcgaccgcaatggcagcaatcaatcccagatagccattaacgtggaatgcttttttctcttgcatcgtcatcccttctttcagatcgattctagaacaattataacctagaaacgatttccaacaaaatgccagccacgaccaatgctagacaattacctggctggtatgacgattcaatcagatgaactttaccaaatcaatttgagaaagtttaccaaaaatcgagccagttagccactgactcgattatggtataatatttttgtccaagaacattggcggtgcttcgcttttcgaagggagcgatgccaatgaatgagttgaaaaacgcatgacgcttcccatcattatgaaagggatccataagtgtcaaaccgacatcaagatggcgccgacttaaaaggtcttgccgctattctgcacaaactgcatggcttaccaattggcgttcagtatgcagctttggccacggtcgtaatcattgtgattgcttccctcatagccggctgctacatggtcagtcatttctgaccaaaaagaaaaaacatctttatgagttgcagctctaagatggtgtgaaactttaatcaatttgaagtgtaagcaccgtcgattttcaaggacattcgggctaacgtgttccagcacgttagcctttttgtttacgccataattatagctgatttcaatcggcattgcaatttgaaaacgccttgccagaccaggcaaggcgttttgccaattattattttgccgctaagcataatcaatgtgccgccgttcaagcaaatcactgccccaaagcgtagcattcctcctaggacggcagttgacccatacccaatgctttattctcgcgtggaacttaggtcatgcggggatgtcatcggacgcagcttaatcgttcccaaggctttattctccgtggctgaagaactgagcggctttgattgctcgctgccagccgtggtaaagctgttcggcatcttcacgcttcataaccggcataaactcatcgcccagtttggaaagttccttgagctcctcttgatcgttccaaaagccgactgccaaaccagccaggaaagccgcgcccagtgccgtagtttcttccatttgtgcacgttcaatcggcgtttgtagaatatcggcctggaactgcatcaaaaagtcgttgcgacaagccccgccgttgaccgtcagcgcctttaacggcaagtcggtgtctttgaccatcgtatcaacgacatcccgcgtctggtaggcgatcgattccaacgtagcccgcgtaatgctttggcgattggatccccgcgttaagccaaacatcgcgccacgcacttcttgatcccagtatggcgcgcccagcccggtaaatgacggtaccacataaacgccgccagttgaaccggcttcaacggccattttttctgactcgctggccttggtaaagaactgcagcccatcgcgcagccattgaattgccgatcccgctacaaagatcgatccttccaaagcatagttcaattgtccgttcagctcataggcaatcgtcgtcagcagaccatttttcgacagcgtggcctcggtaccagtattcatcacaataaaggcgccagtaccgtaagtattcttgacggatcccttttcataggcagcctgaccaaacaaagccgcctgctgatcaccagccatccccgcaatcggaatctcgaccccaaagaagtggtaatcgcccgtatagccgtatacttctgaattggagcgcacggccggcagcatttggcttggaatgtccagcagctgtaaaatatcttgatcccattgacgcgtgtgaatgttaaacagcatcgtccgactggcattggtaacgtccgtggcatgcacgcggccgcccgtcagattccacagcagccaagtatcaatcgtcccaaacagcagatcgccattggctgctttttcccgcgcacccggcacgtgatccaaaatccacttgattttagtcgctgaaaagtaagagtcgactaccagaccggttttttcgtgaatcagatctttatagccatccttgatcagccgttcggcaatgtcgctggtctgcttagactgccaaacgattgcatggtagattggcttgccagtgtggcgatcccagatgaccgtcgtttcccgctgattggtaatcccaatcgcggcaatacggtacggcttgatctgtgatttgatcatgacatcagaaattactgattgaacgctatcccagatttccatggcatcatgttcaacccaacctggattagggaagtattgcggaaactcctgctgagccattgcaatttcatgtccttggtgatcaaagatgattgcccgcgagctggtcgttccttgatcaattgccattatatattgttcgtcactcatgaatttcaatcctttccgttatgagcattgcgcggcttgcctggttgttcgccagttagtaagctgccccagcataccagtcattcccaagcgttcgccaaaccattaaactgcccagcctgtctggatatgctggttggaaaactccccaactcaatttcagcaccgcttcatgacgcaaaaaaaccgctggcgacccaaggccattcagcggctaatcgtttacttatcgctgaccatcttgccagccacactgtagcgatccttgcgcatttcgtttaaaacgatgtggatgcgttcttcaggaacattggcatccttagaaatggctgccgtaacgtccttaaccagggcctttaattgttcttcagtgcgaccttccaacagatcaatgtgtaccaatggcatgaaaaatctctcctttaatccaataacttggggcaatcataccacaattaacactgatttggcaacgctttacatagtcttaaaaactacttaattaattttcaaaactattctttaataacgcaactgctagccgtcaacaatttgtcagctggcgttcaatcagatgtcgttgattgttctgcttaaaaggccctgctaccgtttttctcaacattctaaaaagatccgcagaacgcaaaaaaccgctcaactaacctcaatcagttgaacggttcttctatttaatgcttcttgatcaacagccatgccgccccagctgccagcatgacgccagccattttgtgaaggtccgtcttaacgcctttaaccaggggctttttgctttccagaactacttgaaaatgttcgccgtcatataatgtctttttcatgatcgacacttcctttttcaattggcttttgatttatgctttgtctttattttactccgcatagcaagccatgacgagcaacaattgcgccaaatcttcttattgataggccaaacgatgcaatgttcgatctccaaatatccagaaactattgctgatcttttcaaagtgatgtcgtgcaatcactgacctactatggaacgccgattgatgccgcgggaactgaatttacctggcaagcagctgctggtaatgaatttgccaacgttgactctcccgtggttgccaatatgacaccgaatcaggacacggtaactgccgcaacggttgatgaaaacagcacggattctgaaatcaacgttgtctatcacaatgacctgacgaccgaaatccttgaaaagatcgtacagcggacgattcactttattgacgaacaaggtaattcggttgccgacgatgtaactcaagccgtaaccttaaccggcaccaagtcgactgatctggttaccggccacagtacgacggtttggaatcaggcacaatttgccagcgttgcctcgcctgccgtcgccaacatgacgcctgatacggctacggtcgctgcgatgacagttgatgaaaacactgctgattctgaagttacggttacctaccatgctgatccggttactccagacacgccgtcaacaccggacacaccgacgactccggaccggccttctacttcgataacgccagccgctccatcacagccaactgccgttcaaccggctgttcctgtcaacaccagcaacaagactgctgtcgatacgactactggacaaaagatgttgccacaaaccggtaaccaaaaatctgccggtatcctggctgtctttggacttggtctgtctagtctaacactttcattcacgggtctctttaagaaacgccacaactaaagcatcccgttgatgaaaatcttataataccaaaattaacagccccattacggatcaaccggaatggagctgtttttatgtgattatcatgatcagcaagttttcaaaggaaatcgataccggaacacagattgtatttagctaatcgtgcatcaaaaaacacactaatatttaaccaatcatgcataacggattattaaaaatgagttattattagtacacacgcacaattggaggagtaattatgaataaaaagattctcagtggcacaatcgtcttacttagctgcggtttgttagcaggatgcggcagttctaaatcaaccagctcatcggcatcaagcagcgaatccacaacccaaaccagtacacaaaagcgttccagcaccagtaaaaaaagctcatcagctaaatcaaccagttcaagcgaggccagtcaatcaacgagcagtatatcagatagttccaccaagacttccagtactgccacgccagccaaagtagatgacaaaactgccggtattttactgctgcttttggttgaacccaactggatgaaacaatacattggcagcgacttcttctgttacagtccagccggtgaaaatcctggtggcagcgataccgcaggctacagttacattaccgcaaacggcgatcctagcagctttgtctactataaagttgatggcgagaacgttacctataagatgtgggttccaagtgcctcaggcgatgtggcgggcggccattttgaaactaagaccgtttctttgacgactttagaaaatgactattatgtcacgcaaagtcagaaaaacgaggttgatggctatgttcatcaattgaaccgcgaatctgactatttagccaatcactaattttcacatcaagcggaggcgtaatcgatcaatgcattaacgtttactaatattactgatgcaaaacaattcctggctaagctaccacaatcgcccaagccacagttgcaagttcagcgagtgtttggctggcaaaacgtttctgattaattaaacttatcagacagtctcattaccgtaatggggctatttttcattatcaatgccattctgcctgactcgctgtataccatggtcttctgacattccccctcaccaatgccattgtatggtatgttttttagccgctgacgccattctttttacccattgacatcaaaaaagctgcctccagatttctctgaaagcagctgtaagttaatttagcctattccatctcagtcaaaccagcctgacgccgaccacggttgaaccatggtgaaaccgtaaaggccagaatgtcattaactacgtagatcaagctgttgatggccattgccagcgtggcatccccttgagcaaaggtaacaccccaaagaatcagttggaagattcccgaagccagccaccaatagtactggttgttgtagcgcataaagcacataatgcctgccgtcaaactaatggcaaagctgatggcatcgatccatggccgcggatcattagtcaaattgccgatcagatagccgctgattacataaaccaagagcgtaccgataatggctacgatccattgcttggctccaaaccggcgcaggtgatttttggtgtcatcgttccagctgcggacggcaaagattaccggcagatcaagcgtcaagacataagcaatctgttcaaagatcgacaggtagtttttggcggccagaccagcgtagataaagcaggccgccgaaatcagtcccagccagccgttgattgccttggttgcgttaatggccaatacgcacagcgtccccaagattgtaccaacaaacgtgatcagcgtaacggatgtaatcggactgctgatcaagagcgccagttgaaagcccagtgcaaaaaagaacagcagatagttttgcattggccaccccttcaattggttgaacagccagacaaagtaattttcattgcgttccatgaatcaattctctcctttttctcagtagcttttaccacaaccagatgattgcggctgcttgtccgtggggcgacccccacctcggttgacgagaagtgctcaatttctcgccagctgtcctgcctcacgggcccatgagacaaaacgacgtaaccagttcggttttgagcaactcgtatatcttaccagaagattttgtccttgtcagagtaaaagtttttatttatctaagacaaaatctgtctaattatctatttagtcgtaacgattgcgcttactaaaaataattaaaaaagtttttgacgatctgtttgactgaatttgattgaactgctgataaaattatgtttcatgacagattcccaagtgtatgtaaacgttttataataaacaagttaatacttatgggagagtatttatattaggagagtgtatttttcatgaattatctttttatgttgtttatgattttgataattatcgctacatatctgctcataaaaaaggatcaagaaaatgaatcgatcaagccgcctctttctgatcagtcaatccaaacaatttttaaaaataaatctactgtaggaaaaattattgaacgatcgactaactcaagtaataagattatgggacgctctgaaaaggcctatgaggaaaccatcaaacagtcaactaattcagataatcatcatccaaagccaatctcaactacatcaacgcctcaatcagatgccgaccaaactaatcattttatacataaaaggtcatcaactactgacgactcttcatttgatactaagccttggcaatcagcaagctacttcaagcaaccttccgatcaattttcatccagttctaaaaaggcgcaaaaacctaccaacgaacaacaatctattaatgaattaacgatcattactaaaaatggcaaaaaattctgtcagtatccaattgaagacgactggtatctaacacggatcaaaaaatttcgttgcaaagccaagcagcataatacaatcatgttttacggcctggcaaatatttattctcgaacaaaaaaacgcaatcttaatatccgttttcctgtctattattgtcaaacctgtgatcaactcatgattaaagaatcggtctaccgaaaaatcagtcatgatggtaagttgctttgtcattatgttcttgaagatttttggaaaccaaagctaccagatgaacataccagcaatcacttcgtaccaacatttggcaatgaggaatctgttttacataagcttggctacaacgtcaattcgcagattgggttgacacctattcaacgtcacgcgattctacgacagattattgttaatgggcaattatcaaaatccgaagtcgtgcatcatcttaggtatttaatccgccgtaaccgctctaatcgtaaattcaaacgcgcaattcaaaaatggcaggctgatcttgaatacgtctatcgaatgaacctcagctacagccgcattccaatccagcagatgcgcgacctactgagcaaagctgattaatagttgatatgtaaaaagaacccgccaaatctgacgagttcttttttattagccttgtttgatatttccactcatggcatccccataaatcggcgtcggcagcccaaagccaccggcaactgtcactagttcaccggtaacgtatcttgacttatcgctggccagaaaggcgaccatattggcaatgtcgacgggtttaacgatctcatgcaatggtacgtgtttcaagaatccgtccaaaaagctctttgacatattctgcagtgcgccatccgtaccaacgaatcctggcagtactgcattggctcggattttattgcgcgcatattcgacggccgtctgcttggtaagcgagttgatagctgccttggagacgccgtatgccagtcgactgatgtcaggcgtcgttccagcaaccgatgaaatgttgacgatgctaccgcccgtttcctgtttcagcattgctttgacggcatacttagacgtgtaatagacacttgcgatatttttatcaacgatatcaaaaaaagccttactgtcgccatccaccagcgtcgtatctttgctaacgtccgttgtaccaaaattattgaccaaaatatccaaatgccctacctcatcaacaacttgctgaatcatcggtgcataggtcgtaaaatcaaatgcatcataaaagacgcaccgataattttcgttttgatcatgcagctgttcggtcaactgacggttcttttcgctgtcgcgtaccgccatgtagacaatcactccttctgcaacaagcttttcagcaattgccagaccaataccgcgactggctgccgttacgattgcagtcttattttctagatcctttgccatcgcaaattcctcctcatcttttcaaacaggcgatcaaaaacagcttctcagaatccttatcgattaaaggaatcctgatattgagcaaagtataacacctataacaaataaattacttaatttttgtaaaaatagataaaaaatactttaaattaagttattttaatgaatgcttcttaaaaaacggtttcacctgtgctatatttttcgtaatcaacattcagtatttaaactactgaataaatcatgctaaaaagctgctgtttgacgattagataacgttcgtctttaaatttgggagtgtcacgaaccatctgcaatttagacagttgcttaaaaaggggatcttattttgaaagaaattgacgcaagcgaaattctccagcgtccctttgcctccaattttctaaagaagattggacgtggaattgctgtgggattagtaaccggtctaattgtggcaagttttcgcaaaattattgattttacattgcagaaactcaacgtcatctacccatacatgcaaacccatttttgggcattaggtggctacgtaattggtacgattattttatggctgatcatgtcacgcctattaaaaaatcatttatttgacatcgttggttccggcgtgccacaagtcgaagacattctccatgatgaacactggatgtcttggtggtcggtactctggcgcaaatacataatcggcctaatggcaatctgtccagggctgttcctaggtcgcgagggtccttgtattcagatgggggcagcgattggtcaaggactgtctgaaaagtgctttaaatcatccaaggacgaaaccaagatcatgattgcctgtgggattgccgccggactttccgctgctttttcagctccattggccggtgccctatttttgattgaagagatcacttatacatttgagtctcaaacctggctgacggcactaacggcggccattgcatccgacatcgtgaccttgctgtttttcggaacgcggccgtgtatgtggcttcccgtagtatatcggctgcctcctgctacttacttgccattgattttattcggcattttgctgggtattttggcttggttctaccaatactgtctgattaacattcactgttggtatggcaagattcactggctgccaagaaatcgtcgttcaatcattccgctcctcttggtgattccgattggtctatgggatgccaaaatgctgggtggcagtcatgtctttgttgaggtcatcgcacagctgcctcatcatgtacatggctttaagaccatcatgtttttactgttggcctattttgtaattcgctttgctttttccatgatttcttatggagcagccgtcccagggggtattttcatgcccattctggtgttgggcgcaatcttgggcagcttagctggaatagtgatgataaaactcggaattatccctgctacggcctatatcaatatcgtggtaatcgggatggctgcttattttggcgcgattgagatggcaccatttacggcaatctgtctattaactgaaatggttggtacaattcagcaaattctgcccatgctgctggttacgttcattgcttatgcagtcaatgatctgctgggcggtcggccaatctatggtgcgctgcgtgaacaaatggctccccaagctgcactggagagaaatgtccaaaatcattgaagttaatttttaaatctttttagtcaatttcaccattgatagctaaccaattatcttaatatgattaataagtgcaagtcacaaaaaattttttgaaaaagttttttgtggctctttttgttaattttcaagctcacttttaaacaaaatcgacagccgtttcatgaatcggacaatccatgcgatccaaaagctttacgaacgttcgtctggctttttaagaggagctttgtgcacttgttcagtcatctattatcgaacgttcgttgcaattcttgcatattattcgtgattcattcgataaataacatttccataatctaaaagtacggtttacaaattgaaaacatcggcttatgataaggccacgttcgaacggagaattgattttacttttggcaaagagaggaagaggctaaaattatggttcattttgacacgatcgaaactgcactgcaacaactgcaaaacggcggctatgtaattctttccgacaatgaggatcgcgaaaacgaaggcgatctggtagctttagctgaccacatcactcccgaaacggtctacgaaatgctgcacgaagccaatggtctgatgtgcgtaccaatcaccatccaacgggcacatgaactgggctttaccaagatggttgaacacagtactgatccaaaccaaacgccatttatgacgactgcagacggtacttttgaagcaaccggtgtcacgactggcgtttccgcatttgaccgtgctgctacgatcaagcgcattgccaacccagctgccaagcctaatgactttaaccatccaggacacattcagccactatatgctttggatggtggtttgcgcaaacgcatcggccatacggaagcttcagttgatctggcctacctggcgggtgccgaaccagcagccgtcatcattgaggtgctcaaagccgatggtcacatggctcgccgtgatgatctggctaagatggccaagcgcgttgacgttccttacattaccatcgctcaaatcattgaatatatggatgcacacggtatcgaaaaagccagtgatttgcaagatgccacggttcacgcctaaacagtcgcaataactaaaacctgctgctcgacaaatatcacaaacctagctgcttaaatttagataactacaaaacctccccgctgattcaacgaggaggtttgttacttaaggaggagatgtttatactttgacagtaaatctgactgaaataatcttagcccactgtcgattatcagtctttacactgtctttttcaggaaaaatgtcatttacaaaggtttatttaggcatcccagacttcttcggcaatgctcttaaccaaagcaattttggcccattgttgttcttcggtcaaaatgttaccttcttcagttgaagagaaaccacattgcgtacttaggcatagtttgtccagatcatgatattgagcagcttcatgaatgcggtccaagattacttgacgatcttccaattcaccggacttggatgtcaataaaccaagaaccacatatttatcagctggtaccttagccaatggttcaaagccgcctgcacgatccgaatcatattccaagtagaatgccgagacattttctttagctagcacataatcagcaaccggcccataaccacccttggtagcccaggttgagtggtagttgccgcgacagatgtgggtcgttaccgtcagatcttctggcagatcaaccagtgccccgttattaacacgcaaatactcattttctaattcgtctcgattgaagccttgttcggtcatcgttgcccaaaaatcatcatcaacaaccataccccaggtacaatcgtcaatctttaagtcccgacagccggcctcataaagtgccagaatcaagtcatggtaggcctggtcaatgtcagtaatcaattcgtctttggttgcatagaccttttcaagtgcctgaacatttccttcaccccggtaaagctcagcgtaaaactgggccggtgcgggaatactttggcgtggaatcagacccgtgccatccgtcaggctcttgaggtacttgaaggcttccagatcagggtgcgtgccgttaaaacgaatcttgccttcaacctgcgcggaatcggctcgcgtttcttcatcatggaacagatagccatgctcttgctgcgtatgcttaatgccttcaaatccccagaacgtgtccagatgccagtatgagcgccggaactcgccatcggtaaccgcgtgcagcccagccttagattctttttcaaccagttccttaattgccttatcttcaacggctttcaattcatctttggtaatctctttgttggcaaatttttcacgagctgcctttaattcagctggacgtaagaagctgccgacaatgtcataacggaatggtaaagtcgtgcggttggtaaaagttaaagtttgtgattgcgtcatatgtgataacttcctttcgaaattcgtttttgacaggacttctcaggaactaaaaaagcccctgggaaaagcacatcctgcactttctcccagggacgttgactgcttattcaacgtgttaccaccctgattcagctagacctcacaatctagcccttactgagtactctaaaattagaagacccggacgatgataacgggcgtcaccccgcaacaggcttaccattggctcgcctaccgacttgctccaagaccatcttcatcgcgtttcacgatcccggctctcacctaacccggttctctttaagggctgcccgcgattactcatctcttctaagcaatttataattttgttgtaatcataatacgtggcataacgataaatgtcaaccattattctggaatttattagattttatcaagcaaaaattaagaaactttaatttaaaagcaacgttttttatttaggaagcatgcatcatgataaagtcgaatactcgcgttggcaaaatggcatgagcaaataccaatggcttggccccgaacccaatcagatagcgtggcttagggcatcgcgtattaactgccttgacggtttccttaacgactacctgaggcttgctcaccatattaccattgtattgcttgtgcatcccctcagcgaccttgagtgcagtcttttcataagcgtcacccttaaggcagcgggatgatcagccgcaatgtttccccagtcagtcttgatgccacctggttcgatcaaaattacatcgataccaaactgctttgcctccattcgcagggcatcgctaaaagcctcaacggcatatttagttgtgtgataccagccacccatcgatgatacattgatgattttacctgagtgttgtgcgcgcatgtaaagcaagacgttttttatcagagctgccaagccaaacaagttaacgtcaaattgacgcttggcctctgccagaccaacgtcttcaatcgcgccataactgccacagcctgcattgttaaccaggacatcaatcggccttccttggcaataatttcggcaatggctgccttattcgatgcttcatcagtaatgtccagcttcagtggcgttaccccatattcctttaaggcggccattttttcaacccgacgcgcggcaccataaactttattgccttgctgtgctagagtctttgctgtcttaaaatccattccgctgttggtacccgttaccaagatcactttgctgctaataattaatcttccatttatttaactcgtatttgatgaccttagtatatctggagttgatggatttccgaacatcataaagcaccattgtaatatcaaatgatgccattttagagtttgctagtttaagagccctttattcttaattattagatatatttacctttttagatatttatagattgatatataacctctatttaatgggagcaacggcaccgtaatctttaaaccgaggatcttttaatcgactcgcatcagcatcccatttttgtgaatatggtggattagcaaccacggcatcaaagaagtgtggacgatcaatgccatctttatccaatccgtctggccaatccattgccaatgtatccgcattgcgcagcgtcatattgccataatcaacgccatgcatcataaggttcatccgtgctaagttgtaagtagtcgtatttaattcttgaccgtagaaacgtacgcgccctttctgcttaccatttggaatttcatcacgcacggtcagcaacaatgaaccggatcccatcgttgggtcatagattgtaaatgaatcctgatccatattgatgttggccgctattaattttgccaaaacctttgaaacctcatgtggcgtgtaaaattcaccggcctttttaccggcattgctagcaaattgtttaatcagatattcataaacatcccctaaaatgtcgtgtccattttcatcatagtagtcaaattcattaaccatttttgccgtcgcaatcaatgctttggtccgtgttgtcagattattgcccaaacgactgttgtttaggttaacgtcggcaaaaactccacgaaaatcccgttcggcaaacgaattcaactgagcgttttcttcaaaatggtcaaacatattttggaaatcttcagcatttgccttgctctcttgaatcttttcaatcaaggttgcccaagtatcttctggagcaatcgcatatcccagtgcacctgagatatcttccaggtagtcttttaaatcctcacccgtagcttcttctcgatactcatcattaatactcttgccatcaatgtggtccaaaatatcattgtcaactaaatacttttcctgcttttccgataaataacggtagaacataaaaccaagaatatagttccgatattcgctcgcgtccatcgttccccgtaattcgtttgccatactccacagttggctggatacatcctgtgccttcgacatttttattctcctaactctaatacttacgtttcatcaaatcagcaaaatcattaaaagcctgccgcagatggtttcgatactgtacctttcgtaggttcttcacatctttgtcatgtgccgcagttttatacgaattctgtgcttctttgatgatgttcgttaattcaccttgcgtgtccaaatcatcatgttccaatgtatgctgctgaatcagacgagcaatattcttacgattattcccgtcagctagatccatcaagccccatttttgcatgaatcgttcaatctcatttgactcactgcccttagcaaatgaccgcatcaatttaccggcatctttaccttgcaacgggtagacaccaccttgcacagctcgatcaaacaatgccttaataaatgccaacaactgagccgcatatttttcatcctcaatcgcattggtgtagctttgcagctgctcatgcgtcttcttggcccctgcctcatcaccgctgtgtagttggttggctagttgtgccaagagttcttcaatgtaatcataatttacgcgcacgtcattaacatgctgcatcttaagtgatgggatcggcatatcgtcatcatcgtcattgccacgcccactaatcaatctgttcaacttattagcaatgcgcccagtcagtgctgtttcgttttgcttggtcatgctgactttggcaagcagcttttcaggatgcttttcatcatatttatcgtcttgtttgatcttaaccatcagatgattgtactcatgcatttgatgccacagttcaacttgtgcactctcactctttggtacatcatcaaaattaccagtcagctctttaatcttttttatgttatccttcagttcgtcaactagctcctcataagatggttctacgattccagccggtttatcaagtaattcaccttgaaccgcggctgattgacgattggcataaacagtcaatgctttattcatcaaatcttctgaatgttgtggccaacggtagttaacgatccgcccaaatggcttttgatccatatcctgcacacgattagttcgtgaatatgcctgaatcaagttagcccctttcaatgtccgatcaacgtaaagtgtattcaacattggagcattaaaaccggtcaacaactgatcaaccacgattaccaaatcaagattaaccgcatcatcgcctaaatttcttgctaaacgattggttacgtcttcggtatactcttttaccgtatcagcgccaaaattggtgccaaactctgcattataggcttcaatggcacgactaaggcctcgattattttcaagctgattatcaccattggtcgtatcctgactaaacgtaattgctacttttaagtgttgatcagccggtcgcagcttattttgtcgctgaaattcatcaaagtacatcatagccattggcgttgacgctttaccgccaccaacatgggtcgtcaacatagcactatacagtccatgattggatcgatttggccaatacttatagatgtcttcaaccaccaagcgaacgtgttctttattattgtcatatacacttggttgaatcagatcgtccatatcggccggtgtcagatttttaattcgttctttgatctgttcatcagtccaagatggattaagctttttaaagaattttggtagatattcattttcaagcgtttccttaggcagcgtggtttgaaaatcaaccttgaatcccaacacgttacgatcagcaatggcttctctaatcgtgtagatatgcagtggatcgccaaagatgtctctagtcgtaatcaccttagccgcatcttttcgtttaggcttattgacggtctcttcatcaaacaccggtgttccagtatatccaacccacgccgaatgcggaaaggcctttttaatatctttgatcatgtcgccactagtcgagcgatgagcctcatcaacgataaagactatatgctgctgatcagtatacttatgccgtcgcactaaggttgccatcttttgagttgacgtgacgattacgctacgatcctttttctttttcagtttacgacttaagtcaaatacattggccgtatccattaccacgccaccaccggttctttcaggatcgttatcgggatcataagcttggtattctgccacggtttgattagtcaaagcaactcgatcaactaaaaataccactttatctacattaggttgacgtgatgccaaccatgccgctttaaagcttgagatcgttttaccagatccggttgtatgccaaacatagcctagacgctgatcaccagcttcaaagtcgtgtgacctgatcttatccattactcgccgcgttgcataaacttgataagaccgcattaccttaatcatctgatggtgtggcgtaccatctaaaatcatgtaattagttgccaattgatgcgccattggaatcgacagaactttggaggcaaacaaacgccaatcgtgaataggtcgattagtcttttcgtcttgccactcaaatgcaaaatcagtattaaaatgatcagcatcattaggcagtgccatgtagcgaatttcattaggcgtcatgcctacgataatctgcagagttgaatagataccactatactgctgctcatccaagtattgccgcatctgattaaatgccttatcagtgctgattgagtcgcgtttttcttcgatttgaataattggcaagccattgatcaaaagcgtaacgtcaaaacgacgcgactttttcccactaataactggatcacgttgaatctgattaacaatctgatatacggtattaccgccaccaatctgaacttggtcaaataccgtcaaaatgatctgctttccatcctcgtcacgtgaaactgctacttggcttttaccgccaacgccatataaaaacattcccgctttgtatgggttattgagtccttcaatctgctgcttcacctaattaaattcggtgtcagataagggtttgccatctagtttatcttggttattttgttcaagaatctttttgaaattagcccaaagctggctggttgtcttaatatctgctgcatatttccattgctttgtattaccaacatgctgtagatattcaatcaattcatcttcaaaagctaattctgctgagttattgctcttcataaattaccttcccaaatagttgtgatacataataaattataacctttggtggcgcttttaatgagcatcttacagaggttttcctaaagaaatatagttatacagtggcaatttcaaattgtataaaaatggcagtttaaaaatgtataataacggtaatctcaaattatacaattatggcagtccactccactgtcaatcaaatactgtattactctacagtgatactatgaatgctctcttatgattatctaacaaacgcaatcactgtggcttccataactttgaaaatctgctttggcgcattgaatgcattctttattaaaaaatccccacttcatttttgaagcaaggaatagatcttcaccaatacaatttgacaaaatactttattttacaaaaaaccgccagacgacgtaatgtcatctggcggttaatcagttgggctagctgggttcgaaccagcgcatgacggtaccaaaaaccgttgccttaccacttggctatagcccaataaacaaaaatggaggatacagggctcgaacctgtgaccctctgcttgtaag

SEQ ID NO: 699 - DNA, 73818 bp, Unknown
  Metagenome-assembled genome
tttgttcgcggtatatcaacttcgacaaaatcttgcttcataaaaaagtcctcctccttgaatatgtcttcaagtataggagaacttggaatttaatcatatgcggttggttatagtgtgcttacaaaacagctacgctttaagtttttgatcttataattgatgccttccagtggaccattggagtagtcatatttggtactattagcgacaaaatgggctgattgatgaagcgtatggaggttgatccatagcggttttggagttttatagttagagatgatattgagtgcttatcttggcttgatcttatgctggcaaaaaattaaaatcaactgtaacttaaaatactgattctgaataaaggagcattttatgaactttgctggagtctatcatcggccagaaagcgaaatggcctatctttatactaaagatatcatgcatattcgtttgaaaacggctaaagatgatattgctggtgtcagtctattgcacggtgatccatacagcctgcgcagccgaccggacctaccaaaattttatacgcagccgacgccaatgaaaaagatttataccgatgagctgtttgactattggcaattggccgtaactgagcctaagaaacgtttagcctatgcctttgaactgattgatcagtctaacaattgttttatctatactgaccagggatttatcaagtcagatgatttaaaaatgctggaggacgccaatacctactttcgaatgccttattttcaaaatattgatgcctttcacgcaccaaaatgggttgagcagacggtttggtatcagatttttccagagcgctttgccaatggtgattcaaccaacgaccctcaagataccaaaccttggaatcccaacgagcatccaagacgacaagacttttatggtggtgatctgcaaggcgttatcaatcatctggattatcttaaacagctaggcgttaatggcttgtactttaatccaatctttaaggcaccttctaatcataagtatgacacgcaagattattatcaaattgatccacattttggtgatgctaagctgtttaagaaactggttgagcaggcacatcaaagagggatgcgcgttatgctggatgccgtttttaatcatattggtgatcaatcgcctatgtggcaagacgttttgaaaaatggccaggattcaaagtatgccgactggtttcatatcaatcgtttcccagttacctatacaccgacggacaactttgaatttgccaaggatgcaacctacgacacgtttgactacacgccacatatgccaaaacttaatacggccaatcctaaggtacaggactggcttttagatattgcgggctattgggtgcgtgaatttgatattgatgcctggaggctggacgttgccaatgagattgaccatcacttttggcgtcgtttccataatgagatgctgacactcaaagatgatttttatattctgggggagatctggcattctgcacagccatggctcaatggcgatgagtttaccggtgtgatgaactatgactatactggagcgattattaatcatttcatcaaacacgagctgagcagccaaggactggttgatcgtttaagtcatcaattaatgctttatcgcgatcagactaatgccatgatgtttaatgtgcttgattcgcatgatacggctcgtattatgaccttagccaacgaagatgatcagctggtcagacagacactggcatttacgtttctacagccggggagtccatcaatttattacggtaccgaatatgggatgacggggggcaatgatccggattgtcgcaagccgatgaactggtaccccgatgcaaaagcgatagcaatgcatgattttgttcgtgatttgattaaatggcgaaaagaacactggcagctgatagcacagggcacgattgaactgactgccttaaatgacaatcaaggtgtagttatcaagcgcagacgcaacaatcagcaattggtagcagtttttaataccagtagcgagccattgcaagttacgcttgcgccattttttgctcagggcttttcaaacggcatacttttgccaaaagggtttgctgtggcggcactgtcagaataatcatgtcaaagaaagtcgtaacggtaattataaaagacctgtccagttatttacaggacaggtcttttgaataggaattttaagtgtttttgtgagtgttttaaagagtaggagtttgatttaattaacgcttaacggtcttgatggacaatacgcagagtccaccaatgatagaaaagacaaatgagatcaagaagatgcttgagaagccaaataccgaaattgcagcagcggcaatgactggagcaatagcctgtgtcagcgtgttacccaggttgtagacacctaagaaaaaggcaacgcgatctgggtcaggaattacttccaagttcagcaggttgtccaaggcgttccacagccccatcccgataccagcacataaggcgtagattgcaatccccacagttgagtgcatgaaataaagggatgctgcgccaagtgccaagaagatggtcgaaaaaccaaccggtaacttcaatactttaagcttatcagaaaccggaccagcaaagagacccatcaagatcccgaaaatcagcataatcgtgttgatcaattgaatagaagattgggtttgtgatccccgcttcaaaaagtcagtcataatgtagagaatgtagccagtaattgcaaagttgccgaccccttggaacatcttaccgataaaggccaggtagtagtcgcgaccaaccgaccagccaggaaaaacgtttttgatctctttgaaggagaatttctccttggcttctggtttttgatcatcaacagcatcaagactggatggctcatgaacgatcaatactgcaatcaaggtaccgataaattcaacgatcccaaagatgatgaatcccagtcggaactggctaaggaacatggcaccaaccacgttaaaaccgttattcccaagtgccatccccagtccaccataagcagaggaagcggtccctttctggttttcaggagccagatccagccaggcaaccattggcgcaacgatgaaattcaaggctgcttgaccaatcatccatgcgatcagcagcatcgtaacgttctgggcaaatgaggcaccaatcattgacagcatgaaggccaacgcaccacccataatccatggtgtccgcttaccaaaacgtgacttggtacggtcggatagggccccagcaatcatattcgaaatagcggcaacaatcatccccatcgttgagaaaagggcgaccagctgaacctttttggctggatccaattgctgcaacatggctggcagaaatagactattcatgacaatgtatggtcccagccagctggcaggaccgataatcagaccgggaaccagtcgtttgattgaaacggttgcttttttactcataattacttctccccatttttaacctgatagtagtcgaaagcagctgctgaatcatgttggtaggcatcgacactgccgataaagttgaacaggccggtaaaaccgccaatttcgccgggctcgccattgacgccttcatcagatagatagctgacgtcaaagtctttgccaactttgatccattcatcgttttcgttaaagcggcagtaaatctgagccgtccccaggtgatagttaatcttgatttcagcactattgccaggaacctcgacttgatcatagacataatcaatcttttcgcctagtttggcttgaatgatgcccaataccagcttttgttccttatcatccagatgcagacttgcgtatagccagttattggaatcatagtacagtccagccccagcagtctgtgaataatgaacaggatcaaatgtcactttggtttgcagtgagtagtcaagtgaagtagcgcgcgtggccatgattgaaggactaacttgcgagaaaagagaatttgcacccttgatcatgagctgattgtctacgataccgacccaggaagcattttgttcatggtagggagtcataaacttaagattgtaggcgtcgcctttaaaatcgtcaaagacgtcatcaagctcttgattacgagaattggttatgccagcaggtgctggagttgacatctttgccagattggagccatccgccatctcaagccagccatcttcattccaaatgactttttgcagtgaggtttcgcgtcccagtggatttaaggttgtaccaggcagcgggcgtgacattagatgagcaatgtagaattcatggttaggtgtttcaaccaacgaaccatgcccagctttttgcatgatcgagtttggattatacatctcgaagtgaccagcatctggatcacccaatgagaacagatggcgtggcgatgaggtaatgattggctcgccggttgggtttggctcatatggtccaaaaacgtgctttgcgcgaccgatctcgataccatgcccatagccggtaccgccagaagccgccagcagataaaaccagccgtcatgtttgtagatctggggagcctcaacgcagccacgcgtggtgaagccagtcgagacgcgatgccaattccctttgatgccaccattttcaagatcagcctcggcaattaccagatggccgggtgcctgatagcccaaacgtgtttcccattccagaatggaaagatagtgatgaccatcttcatcgtggtaaagggatggatcaaaaccaattgaggtcaaatagattggttctgaccaaggaccagtaatatctttggcatacatggcgtaggattcagaattaaactcacgaccggccatattctgcatatgacagtatgccagccaaaacaggccgtttttttcatcgtaggacaggtgcggagcccagatgccggctggcgtattggttccgcgcaggttaacctcaccatgctgcagaacgtgggttaaaagatcccagttgaacaaatctttggaatgaaaaatctgaatgcctggattccagtggaatgtggaggttgcaatgtaataatcttcacctacacgaataattgatggatccggagccattccagggatgattggattttgaatttcagtcattttgaatatcctcccaaatgcatatatatcggtttatgattgcgtttacatttattttgtgaaattataatataatatcttgaagccgtttccaatagaaaaactggatgttgtaaaaatgttattttcaaaaagtaaaaattgtaactttctgataggagaattattatgagcagcagtcatcatgaatacgttgtcagcaatctgccattaggagtacgtttttatcaatcggacgttacgacttccggttacgtaccttttcattggcataacagcattgaggtgctattagtactgaatggtgagttgacagtaaccatgaaccgaaaaaccaccagtattaccaataatgagtttattatcatttcatcaggggtcattcatgatgtcagaaatacgcccaatcaagccttggttttgcagataccgcttcagattcttgatccatacgttgccaagccagaagagatcctatttgatatgagtcgtccaatcagtactaaactgaaaaaacagatcattgctcagctattaaagattaatcaggcagtttatgaaaagccggatggttacctgtttgatgccgagattgccctaaccgaatttttaaagctgatcgttctgaatcttggagaagagggaaaaaacgttttttcaaatgttggcagcaatcttaagaacttgttggtctatattgacagtcattatcgagaagaaatctcaattcagcaaatggccagacagtcaggctataatgcttcttacctgtcgcgactgtttaagaaaaatatgggaatcacactgactgaatatatttatgagattcgcttgagccgtttttatgatgacctgctcgaaaccgataagccaatcaatgaattgatggatcgacatggcttgaccaaccgacggaccagtcgtgaacagttcaaaaaaatgtatggaatcttgccacatgaggttcgcaaaaacagatccaggtaagttgttgagtgatcgtaaaaaagccaccgctgttggcaatgactattgcgttccgaatacagctttgactttaaggcctttttgactgcggtaccagccgcgatgatcggttttgatctgggcaatgatctggccgtgcggattttgtacgtagatgggtagatgtgtctgggcagctttttgcagcgtgctgatctgattggtcaactgatccagctgactttttagctgctgatcggtaagattctgtgccgatgtttttaaaagaatacggcgttcagatacatcgatttttatgtattgatcatggtctagattttggttgagcgatctttttaggtgtgtggtacgactttgtaaaatggtcggatccggatcgggatgatcatcaaaaatggccataattacagccacaatgatggcaacggcaaacatcagtctgatcatagcacgatagttttggccaatttggcgattgttgttccaccgcatcttctcacctcgcgtcgttgattgattatattttacgcttggcggggcaataatgtaacgacagaatcagcatttttgtggttttttataagcgttaaattagaaaatgatgataaaattttaaaaacctattgactttgaggattgtggtgcttattatataaacataaattaaatactaattagaaaataattaaaaacattgattaggaagagtagttccagccgcaggaaatcagaaagctgacggtagttgtgagtcagccaagcccttgaatgaaaatcgcctatgagttgggcgtcaaaaacttagtaagacgcacctggcagcacccattatcgtgccgatgaatccaaatttcttgggctcatttgaggttaagtttccagcttaacgaaaaaaggtggtaccacgcccgtgtgacgtcctttaaatacttggcagcagccggtatttaaggggcgttttttaattcgtattcaaatcagacaataaaagaggtgagtgtcatgaaagacagcgacattagcgatattaatattcaaatgcacggtacaaaacgaacaagacatgaacactcacgccggaaccattataatctgccagcgtgaggcaattaaaaatggaggaatctaattatgactgaacaacaagcaaccctgaccgacgcacaagaaaaatttgctcaagcactgtatgatgcctacaagtctggcagcccattactggaatcagaatgggaaggtgtcgttaccgatgacgatacggcctaccgcgtccaagatcgcgttacggctttgaagaaccaaaaattgggcggctacaaggtctcattaaccagtgaagaaacgcaaaagatgtttgactctgactcaccactgtatggccaacaggtagcagaccacttcttaaagtcgccagcaacggttaagctcagtgatcgcatggcggcactggctgaagtagaactaggttttcgggccaaggaggatctgtcaccggacgactcgctggaagatctgatgaagaagacaacggtttgcggcacgcttgaggttcctgactcacgctttaaagactggtttccaagtctttccaagtataacgttatgtcagattgtgcggttggcggcctggttgtctatggtgaagaacgcgacacggataaggtctttgccacgccagaagatgcagctaaggttcatgccgagctatattttaatggcgagaagaaagatgaaggggattcctcagaagttcttggcaatccgctgaagtcgctgcaatggctggttgccaagctggctgaacaaggtaagcagtttaagaagggtcagctggtatcttccggaacgtttgtgctgccgccaaaactggctgccggcaagtgggaagctaagtttgatcatggttttggtacggttgaactgaacgttaccgattaggattatgttttccctacctgatttgatttttatagaaattgacaaaaaattagtttaagaattgtttaaaagcacaataagaattgtttaaatctattaatcgacaaaaacgtaaaaaagctgttataacgggattgggccctcgtgatagcagttttttttatttatgtaatacttgttttaaaaatagtttgcactaaaatgatgatcgaataatgataatttacatttgtaaaggagtgaaggctcatgtgtactgcagcaacctatactgctggtgaccactattttggtcggaatttggatttggaactgtcttatggtgaaaaggttacgatcacgccacgtaattttccgctgactttccgcaagatgccaacgcttgaacatcactatgccctgatcggtatggcaacgacggtcgacaactatccgctttattttgacgctactaatgaaaaaggcttgagcatggctggcttgaactacccaggcaacgccgactacaagccatacgcagaaggtaaggacaacgtatcgccatttgaattcgtatcatggattctgggccaatgcgcaacgctggctgaagctaaggttttgctggataagatcaacctggttaagatcgactttagcgaacagctgccactttcaccgctgcactggctgatggctgaaacggcctctgaaaagactttaacgattgaatgcgatcgtgatggtctgcatgtctatgacaatccagttggcgtcttgaccaacaatccgcaattcgacaagcagctgttcaacttgaacaactaccagttcttgagccctcagcaaccagaaaacaagttcagccaagaccttgagctcgacaactacagccgtggcctgggaacgcggggcctgcctggcgggatggattcaatgtcgcgttttgtcaaggttgcctttaccaagcttaacgcgcctaagggagaaaccgaaaatgaaaacgtcggcaacttcttccacattctgcactcggttgaacagcaaaagaacctggatggcgtcgagaataatcaatttgaatttacgatctattcatcatgtgtcaatgccgaccgcggtatctactactacactacctacgacaacaatcagatcaatgccgttgacatgcacaaggttgacttggatggccgggaattgattgattatgatctggcaaacgaacaaaacatcaactggcaaaactaagtcttaaaaaaaccgcctggaaatatttccaagcggtttttttctgatcagcgtaattgattgcccaaagcttttaaaccgtcatcattaatggctgcgtccattctgtcgatccagaccagatgaccatcaaaaagccgattgctgaggccttgcgatgctgtgcggttctgccgatcacgggcaccgcagaaaacggtcgtgggacattgaacgtgcatcagctggttggtcaggtctgcgtcatataacgactgcagcagagccagagatgattttttatcgagcggccggtctttaaaactgccttggggaagcagtcgccaccgagctgcctgccgtttcaagcgagccgttgggatttgatactgcggtttgaccagcagcagattatcaatgcggccaaacgcggtaacggcgactttaagcgcgatgacggcaccgatgccatccccaatcaacgtaaccggctgcggaacctcgcgcaccagctgttcaacggcccgcgccaaggtctggtagtctaaagccgcatcgctgaattgacgataatcaatcagtcttagctgatgacgaccgactttaagctgctgccaaaatgcagatgattgttttaaatcaggcaaaacgatgaccgttcccataactagtgccaactttctatagtgttctttaagaaaaatattttaccacaaaacggcaataaaaaccggcgtgaagatcataggcgttataattgcaatatgttagattaaaagagggattcaaatgctgttttggctgttaaggcatggctggctgattttgccatttgtgttcgtctttccgctgccagccggttcgcaccagaagcgatggctgatcgttgaactgattggcttggcaggattactgatcttattgttctggtggtggcagacggcgggaaagtcatcggtttgattggtgattttcagccatagtcaggttgatacctgtgctttttcgcggtgagtatttcaaaatgaggtgaagattttgctgacaaaagattttaaatatccagataccaaggcccatgaatttgtaattacgcgcttaaaagaacgcggcgttgatctgcatcagctggccaagattgcttttgacctgcagcagcagtttattcctgaattaacggaagccgactgctatgaggagctgctcaacgtcatgcacaaacgcgaactgctcaacaatgccatggtggcactggaactggatcgcctggcggaagaaaatcaaatcaaagaaccgctgctttcaatcatcagaaaagatgccggcgtttttggcgttgatgaggctttggcactgcagatctctgatatctatggcacgattggcgcaacgaacttcggctatctggaccgagtcaaatacggcatcatcaaaagctttgataccgatgaaaaccatatcaatacgtttattgacgatctattgggcgcgatcgtggccgcagtctgcggcaagattgcccataaatatgcctagcatgatggatcgttcggtaattggtcttttaacgattctggattcgatattagcagctggcggcaggagatttcactaattaaaaattcctcagcagcggcgtttaggacgattgccggtaaaaaaattaagcttttttcacgaaggtcagacctaaatcatcgatgaatgttctataattaaaaacaattctgaaattatttagggaaagagatgacgggagtggaatttatccttttgatgatcggcattggcattttggcagggatcatcagtgccgcagccggcttggcatcgctggtaacctatccttcgctgctggctatggggctgccaccggtgacggccaatgtaaccagtgccttttcgacgattgccagcggctacagctcactatttgcctcgactaaagagctgcagggccatcaaaagcaggtaaagatcgttttgccattggttttggttggctcggtgctgggtgcctggctgttgtttgccttgcctggatcatggtttaaatatctggtgccaatctgtatcggcattggcggggtaatcctgctgtttcctcaccagcctaagcaagctcaggcaacgatgtcggccaacagtcgtatgtttggcaagtcattggtgcagcgcgggttcaacatgctgtggatctttttgattggcgtctacgcgggatacttcaatgcgggcgcgggcgttttgtgtctgacgctgctttcaatcatcaaccgtcaagagagctttgccatcaacaatgccttaaaaaacgtggcaatgacggcaaccaatacgacggcttggatcgtatttgccttggagacgccgattcactggcactatgttttacccttgatgatcggcaatattattggcggcatcttgggcccaatcatcgtacgacacctgcctggtcgactgatgcagattctggtcgggatcggtgccttgatcttggcagtttcactaacgattcgcaatttttcataagcgttgctcagctgcagcgctttttttgaccccaagatcgtaaagaatggtaaattaagaataatcagttcaaagggggatgcgcagatgaaaaaggatcaagcaattttggattttgtcgatcagtggctgtcggtactgctaaaactggatgagccgactgaggcgctgttagattcagaatttgtctggcaatgtcaaaaactgcattttgatcagccaacgcttgacttggatgcggcctttccaatcgaacagccgatgacgtcgctgaccggcttgaaaaagatcatttctaaaatcaatgacaagatgatgctggggcatgcgatctatcgtcaatggcaaaattggcaggccaaaccagctgactcgcaaaaagcctggctgatcgcggccttacagcagttaaagaaactagcgctggccaatgaatccttaccatttgtgtttcatggcgtcatcgcgcatctggagttgatctctcaggctgccaccaatttaccggcaaacgtacaatggctgaagctcggtcgtaatggcaaggccgagctgcgcatcatgaatgatcaatacaagctgctgacaacgcaaaccgagaatctaaaaggtccgcagctcaacgtctttttcgagaaactggccctttattttgcaaaacggcatgattttaagccgaccaacattgaaaacgaatggcagctgactttgacggcaacgaatgggcaaaaatttcagacgcgcggatattggctgaccgacgcggcgctgggtgagctggctcaagagctgcggcagatctggaatggggatgccaagctatggctgtttgatggtctggtccacgccgaaaagatcgatcggctcacgattcgctatcatcggcagctcaatgcctaccaagaagatggcaatccggttcagcttgattatctggaaagcatcgtaatcgaccgtgctcagcaggatttgatctatcgcaagcatctgagcgacgattgcgcaatggagcaccgttaccatattgcggatgcgatcgatgccttgctggatgtactgcagacaccggattttctggcatacgtcaatggcaatgatgacgacgtggtgtttgatccggatgaccagcgctggtatgcaattgagattcaaactgctgctggtcagacccgaatcatcaatggctcgtttgataagcaggggctgccggttgattttcccaaactggccatgataatcgaagacttcttaagcttttacggcaacaatgagcttattgatccggcactctacaatcatcaatggcggcggccgggccaatatatctattgtgacgtctcctttgaagaggatggacgcacgtattgctatcgcacggaagacgagcgtttggcagaaggcgatctggtcagggttcccgtggggcgggacaatcatttggcaattggccgaatcgaaagaatccagatcgtcgacggtcagcacgttccttacccgttgtcaaaaaccaagctgatcattggtccttatcaagcagatgaggactaggacgacagcttgatatcaacccatcagcagctgctggtgggttttaatatttgagtagttgcatcaaaattgatcaaatagcgctaaactctattctagagagaatcttttcagtcaaaaaccgctttattatgtttggaattacgtcttgaaaagaggactaatttgaaattcaacaagcagcaatgggaatggatcttttatgactgggctaattccggctatgccatgctgataacgaccgcggtttttcccatttactttaaagccgttgccttgcaaggcggcatctcttcagcggattcaacggcctattggggatatgccaatagtttcagtactttgatcattgcactgctggcgcctttgctgggagcattggccgattatccgcatgctaagcgacgctggctgaatatttttacctggctggggatcgtgaccgccatgattttaggcagtctgcccgcaaatggcacgctggcctggctatggctgatcattgtctatgtgatttccaatatggggtattctggcagcaatcttttttatgatagttttttaaccgatgtggctgacgatgagcagatggatgaagtttcttcggccgggtttggctttggctatctgggcggcgtgctctcatttgccgtttttttagtcgctgaattgacgaatggctttggcatattggacggcaatggcgtggcccgattcagtttttggctctcggccggctggtggctgctgtttgcctggccattgatgaaaaacggtcagcagcgctatggcgttccagataccgaaaatcgcattgccaacagctggcagcgcgttttgcagacgctgcggcatattaatcactatcgtcaggcattttggtttttggtggcctatttcttctttattgacggtgttgacacgatcgttaccatggctacggttatcggtgaggatctggggatcaagacgacgacgctgatgatcgtcatgctgatagtccaattgattgccgcgccgttttcaatgctgtatgcctggctggccaagaagacctcaacgcggcgggcattattgttgagtatcattgtctacatgctgatctgtctttatgccctaaagcttaagtctgccgctgatttctgggtgttggcgattttggtcggaaccagtcaaggcggcattcaggccctgagccgttcttattttggccgtttgattcccaaaagcgacagcagcgagttctttggcttttacaacattctgggcaagttttcggcaattctgggaccggttttggttggactggctacgcaatggaccggcaactcacgctggggaatcttttctttggtgattctttttgtgatcggtctggtcatctttttgattctgccacgcctgaacgatgttaaaccggaataggcaaaattaaaaatcaaactgctggactgctctgctgacttgcgtgaagcacgattcttcgctatactaccagtgccgtcttagctcagataggtagagcacatccatggtaaggatgaggtcggcggttcaagtccgctagacggctctatcaaaccggcgataatctacaaaggctttctgcagtttgggcagaaagcttttcttttttgatgaagccggtggtcgtttttggtaagataaaaatatagtctcgtttttgaacattgaagaaaggggaaagacatgagctttattgccactttggcgggaattcttctagccacgcagcttgtttcgcatttgttcgcgcggtggggcattcccgatgtcattgggcagatcttagtcggggtcgtggctggaccggccatgctgaattgggttcaccaaacagaaatgatcaatgagttccaagagatcggtgtgatcattctgatgtttatcgctggtttggaaagcgacttgaacctgctgaagaagtaccttaagccggcagtggtcgtagccttgatggggatgattctgccggttgtggtcatgggactggcatctgatctgttcggcatgcagtggtttgagtcattgtttgtcggcgtgattttttcagctacctcagtcagcatctcggtggccgttttgcgcgagtatcagcagctcgacagcaaagagggcgcgacgattcttggtgcagcggttgccgatgatattggcggcgtgattgcgttgagcgtcttgatcagcatgatgcgcggccaaggatttgatggtgagcagaacatgagtcttggcctgaccatctttttgcagctgctgttttttgtcggcacctatctgctggttaagtttttggcgccttatctgatgcatgccagtcaacgtatgctcacaattgctgcccctgcagtcgcggcaatgatcatctgtctgacgatggccgcgttggctgataaggttggcttgagcggtgccgtgggagcattctttgctggaatcgcgattggcaataccaagaccagcgaagttgtcaaccaaagcttcgtaccgcttggctatgccctgtttattccggtgtttttcgtaaacgtcggcttgagcatgcggctggatcattttgtcgattcattgctgtttatcatcgtcatgacgattctggcttgtctgaccaagctgcttggctgtggcggcggtgccaaaatgatgggttttgactttaacagcagctacgtgatcggcagcggcatggtcgcacgtggcgaaatggccctgattacggcacagattggctatgaagctcacctgctttctgaaaagtactattcagatgtgattacggtgatcgttttggcaacgattctggcaccgtttatcttgaaaaatgccttgcagaaggttaaacagacagcgaaaagtcaagcatgataaaaagtccccgtgcagattggcacggggactttttgaattgtcaggattctgcagtctctaaaagctgggctgcgttttgctcaatcaccgaactgacgggaccagcactgatcaaagtcagctcatgcattgcacgggaggccatggtatagatcaatccaacggcacgctcggctggcaggttttggtctgagacgttccaggcaatcgcagcgtcaaactccaatcctttggccagatagattggcaagacgacaatgccaactggcagcacgctgtcttggctgtcaagcagatgcacgatcgacttaaactgccggtgcagcgtttgatagacttgtttggcctgcgcgcggtccttagttaaaacggcaatcgttgcgtagcgctcatgcaaaattgcagtctgctgcaaaagcgcggtggcggcgtcggctgaatcagcagcggcaatcagtcgcggtttggcaccatgtctggtaaacgagatgatctgatcaccatctggcagcaggctcttggcaaaatcggtaatctccatggttgatcgatagctgcgcttgagttcgatcaggttgggatgcttgaaggccagggcatcgtttagctgctgtaaaagctgaccgggcagctgaagcggtttaaagagggcctgctcgctgtcgccaagaatcgtaaacctggctttggggaaggcgtgctttagatagatcagcatagccagtgagtagtcctgcatctcatcaataaagacgtattggaaagaacgattctgcccgctgccgctcatcaagtcgcgcagatacatcagcggtgccgtatgcattagagcgatgcgatgatactcaagctgctgccgatagccaaagagcatggactgccagtcgctgtttttgactgctgcgggccggctgagctgctgcagaaatttttcgtattggctgttaaagtcgatgaagtaatcgttatagatggcatcatagacgatccggagccgctttttggccagttgataggaaagataggcatactgttcatcttcatcggcaaaatcgtcaatggttttctgaccatacagattatgcaggccaatgacgtcttgatcgttaagctccttggcgatccaatcgcttttggcaacgtcttgaatgcgactcttcagctctttgatcaaggtgtttttggttttcaacaggcggtcggcaatcgtcatggctgctggctgtgcttgatagatcgactggatatgttcagcactgaaaaacggctgctgtctaaagttcaaatcggtaaagcagattgcatctgggtgctgctggagaaattccagatatgccttgacttgatacatgcagtcggcgccttccagataattggcaatatcaaggctgatagcggggttttgcgatcgtgtctcgtagcgttcaaacaaggattcaacgttcagtccctcaaatcggcgccttaaaaaaccttccagcgttacctgacgcatgttgcgctcacccaggctgggcagcacgtcagagatataatggctgaacaaaaggttgggactgaacaagacgatctgatcggcattgagtgcggttcggctatgataaagcagataggcgattcgctgcagaatggcggaagtcttaccggatcctgccaccccttgaaccagcagcagatcgcttttggtatcacgaataatatcattttgttctttttggatcgtcgccacgatattttgcatgtactggtcgttttgatggcctaaagcttcctgcagcatttggtcgccgacggtttcattagtatcaaacatgttgatgatctgaccatttttaatggtaaactgccgctttttaaccagcgtcgttgactgagtgccagccggtgtctggtattggaccttgcccagcgtaccgttgtagtagattcctgagattggcgcgcgccagtcatagacgataaaatcggtcttgtcatcgttcattaaagaagccgtcccgatgtaaagcgattctggctctttttcaccaggatccagaatgtcgatgcggccaaaataaggcgattctcgcagctgctgcagggtctgcagctgatgacgcaagatggtctcgttttcgaccgttcgcgccaccaattgccgctgctgctcaagctcagagcgggattcggcaatatcatcaacttcatagcggttgatcgaggcgttttcgccaaagttcttttccacggcccgcgtttcctggtgggcactgtctaaggcagcctgcgtttttttgatctgggcgtcaatctgctgaatcgtccagtcaacgcgctgctgttcaagctttcgttctgagtattcgtctgccaagctgaattcctcacttttccaaaaaattagcttaactattttagcacgtccgaacatcgattgcggctaaaccgaattttaatggcaaaatcggtgtttataccgaaagataatggtaacattaaatggatattgaaaaattaatgatcaacaagtaaagcggaggtgaaagtggtggaaaacctcgcgattgttgacctgggatcaaattcagctcgaatggcggtaactgaaatctctccggatgggaagtttcgggaaatcaagcgcgttaaggaaaatacgcgtctttcggaagggatgggtcatgaaaagattctccagcccgaggcaatggaacgcacaatccaggcaatcaagcactttaagcgtcagtatcaaggcctgcccaatctgcaggtccaggcgattgcaacggcagcagtgcggcaagccaagaatcgacaagaatttcttcaacgggtcaaacaagaaaccggtctgacggtccgcgttctttccggctataaagaagcatattatgactatttaggcgtggtgcgcacccttaagctcaatcattgcctgattctggatgttggcggggccagctgcgaactggttctggtccagcatcgcaaggccagagacctgatctcgttgccgattggcgcggttaacctgtctgagcagtatcatctgggcggctacgtgcgcagtgccgatctttttaaggcccaggcagccgtctgtgatcgactcaataagattccttggctgcgctatgccacacggatgccgatcgtcttgttagggggcgccaatcgaacgctggcccggatgagtcgttcgtatcggcataaaaatcgcggctcgattcatggttatcgcttaacgtcacgagtggtctacgcgacctatcgcgagcttttgagccgcaatctggcccagcgcaagaaaatgcccggattagaaccagatcgagccgacatcattattggcggcatgctgccattagtgacgcttttggagcgcaacagcgatggccgcgttattttttcggaaagcggcgtgcgggaaggaattattaccgaatacattcagcagcgcgaaaaacggagtcaaaacgatgaaaaacaatgatcttaatcatgattggatgcatggcctctaccgcttgccaaccagccagcgacagcaggttatcagtgatcagttttcattagcggatgatcagcaggccttaatgaaggagaatgccagtcagcttggcagtcagctgattgaaaactatctgaccgactaccgcttgccagaaggggtggtaaccaacctggtcgtcaatcacaagacctatgccgtgccggtagttaccgaagagccttccgtcgtagcggctgcctgcaacggtgctaatcgggcagctttaagcggcggctttacggctccggcagctgaacgggcaatgctggggcaggtggttttaaaaaacgttgcagaccctgcagcactaaacaagtggctgcttgaacatgaaaccgagatcctggcggttgccaatgccgcgcatccctcaatgcaaagacgcggtggtggcgctaaacggatcagaatcagaccggcagcaccgtttgtcagcgttgatctgatcatcggcgtaggtgaggcaatgggcgccaataccgtcaatacgatggccgaggcagtcgcccattacttaaaagagcagggctatgacgtcttaacggcaatcttgagcaacgcggcctttatgagcctgcagtcggctgcttgtcgggtcagctttaagaacctggcaacggcaacgatgaatggcgaagtcgtggcacagcggattgccgaattaagccagctggcgcaggtcgatccatatcgggcggctactcacaacaaaggaatcatgaacggcattgacgcactgatgatcgccagcggcaatgattggcgagcaatcgaaagcggcgcgtatgcctatgcagcaagcagcggtcagcttaaaggactcagtacctgggaaattgatggtgatgccttattgggccggataaaactgccattgccagtgggaacggttggcggctcaattgggcttaaccctttgaccaggctcaactttaagatcaatgatattcattccgcgggcgaattggccagggtagctgccagtctcggcttggcacagaatctggctgcactgcgggctttagcaaccagcggcattcaggctggtcatatgcagatgcagtatcgctcgctggccgttgcggtgggcgcgacggcagctgaggttccagttctggtcaagcgtctcaaaaaactgccgcaggttaatcagaatgttgccaagcaagcacttcaagaactgagaaaggactcattatgacagaagaacaaccaattaaattgaatcaagaggcccaaagcctgttggatgccgttaatgccatctatccgcagggcagcgtctttgtccagtttgaaggcgagaaatccggctggctcagacacgatcaggcccgtcagacaacgctgcctggcggtttggtaattacggtgactgatctgacggcccctgactatactgcttcacatgagctactgcatttattgatgcttttacgcggctttccgcagattttctttcagctttcattaggcagtgaggagctggacgaacaaatgatgatcatggcaaccgatctttacgatacggtcatgcatcgggtagttacggctgagcagcgcaagcacggcttgattgacgatcagatcgaagcagagtattttaaaggcatcgaacataccctgacgcctgaatccgatcaagctgatgatgagcgaacgatgcggctgctgacgattttggatgccctggtcttttatggtaccggcgatcatctggcagaatatgaagcacagctgaccaagctttatccagttgcaacccaggccgctgtggcaatgtatgaaaaactggtcgccaagccgatcaattcgccgtttgacctgcgtcgcaacgttgtcaagctgtttgagctgtttgatgagcagatgacggcctgggagctgcctaagctgcacaataaggaattcgttacactgtcgccggttttaagcgaacggcaattgcgattgagcgttcggcaggtatttgagattttccattccgacatgaaagatcgtaagactggcaagcgggcctacatcggcgtacggcgcaatgatggacagaactcgtttacgattccggctcctgaaaacgatgcaccggctgaattcttaaaactgtatgatgagccggttgaaaaactgctgacggatctaaacgtgccatttatcgttagaaaataactaaggaagtggtttgatggatgctaaagatcaagaattgttcgatcaggcaaagcagattgtctttttgaccggcgccggcgtttcaacggcttcgggaattccggattttcgcagtgccaatggcttatatacacagaatcacaatgccgaatattatttaagccaccgctattttgaaaccgatccggatggcttttatgaattctgcaagcaaaatctgtattttcccgatgcactgcccaatccgatccatcaaaagcaggtcgccttggcacttcaagatcgagcaacgattattacccaaaatatcgacaatctttatgaagttgaatttcaaaaacaaggtgccaagccgcgacatttaattgattttcacggcaacctttaccatgtgtattgtgaaaaatgcgggcagacggtaccagtcagtgagtatttagacagtcggctgcaccagaccgatcaagggccgctccgtcctgacattgtcttatacgatgaaggcatcaagcaggatgacattctcgattccgttcacgcgatgcaaaaggccgatctggtcgtaatcgtcggtaccagcatgcgcgtctatccatttgccgggctattggagtaccgcaatccgcaggctaaggtaatggcagtcaatcaagaaaagcttgacttcccatttccatttgagatgattcaagccgatgccaccagcttttttgccgaactgcgtgcttaaaagctactgaaggcccagcctgctgctgcaagctgagcctttcttaatcttgatgcatgattccaaggcgaaaggaatggttttgtgacccagattacgcttggcctgacgacctggtcagagcatcccgcgctgattgatggtcaacggcagacaaccacgcttaatgaatatgctcagcattttccgaccgttgaaatcgatacgtttttctatgctttgcctaaatcggcaaccgttcagaaatggctgactgaggtgccgcgcgactttcagtttatcgttaaggcgcaccggctgatgactcagcatgagaacctgaccgagcaggactcttcattagcggaggtgtttcaaaaatatcgtgatgccatcatgccattgattgctgctggtcagctgaaatgcgtcctgtttcaatttccgccgttttttgatgcacagcttgatcatatcgactatctgcggcggattcgtcttctaatgggaaatctgccaatcgccgttgagtttcgaaatgccagctggtaccagccagcgattctccaaccactgaccgaattttgccgcgacctgcagcttacgctggttgctgctgatgagccgcacgataccttgaccagcgtgccgttttatctgattacgaccaatcccaagctggtaatgatcagactgcatggccgcaatcgcgagggctgggatcatccggacaaagagtggcgaaagaagcggacgctgtatcgttattcaagccgtgaactgcagggattggcgactttgattcaaaaccttgcgccggcacctcaagaaatctgtgtcatctttaacaacaattcaggcaaagatgccgcgccaaacgctttggaactgcagcgaatcttgcatcttgagtttaagggactggcaccgcatgatcccgagcagctgaatctgttttaaaatcaagaaaaaaccgctcattttatgttaaactaaagattattaaatccgtattagaaagaagggccaacatggctgaacaaaaaccaacctactacattacgacaccaatctattatccatctggcaagctgcacatcggcaattcctacaccgaagttgcctgtgacgctgaagcccgcttcaagcgtctggatggctatgacgttttcttcttgacggggactgacgaacatggtctcaagattgaagaaaaggctgaaaaactggggatggaaccccaagcctacgttgacgagatggcagccggcattaaaaaactgtggaaaaaattggaaatctccaatgataagtttattcggaccacggatgactatcatgaaaaagccgtgcaaaagatttttcaaaagtttgttgaccaaggcgacatttacaaaggtgaatacgttggctggtattcggttgacgatgaagaatactttacggaaagtcagctggctgaggtctaccgtgacgaagccggcaacgtgattggcggtaaggcaccatctggccatgaggtggaactggtcaaagaagagtcctacttctttaagatgagcaagtacgcggactggctgatgaactactacaaggaacaccctgactttatcgagcctcatacgcggatgaacgaaatgctcaaaaacttcttggaacctggtctggaagatctagccgttacgcggacctcgtttaactggggtgttaaggtaccaaatgaccctaagcacgtcgtttatgtctggatcgatgccttgtccaactatattacggcactgggctatggcagcgatgatgacagcctgtttaagaaatactggccagctgacgtgcacatggttggtaaagaaatcgtacggttccacaccatctactggccaatcatgctgcacgcgctgggattgccattgccaaagcacgttatcggtcacggctggctgacgatgagagacggcaagatgagtaagtccaaaggcaacgtgatctatccagaaacgctggttgatcgctatggcctggatgctacgcgctactacctgctgaaggcgatgccatttggcaacgatggcgtgttcagcccggaagactttgtcgacaaggttaactttgatctggcaaatgacctgggaaacctgcttaaccggaccgttgctatgatcaacaaataccaagatggcatcttgaagggcgaaaatgcagcggccactgactacgatcaggacctggaagccacggcagctcaagcctttgacgaatacaaggacttgatggacaagacgcactttgccgatgcattgagcgcaatctggaagctgatctcgcgtgctaataagtacattgatgaaactacgccatggctgctggctaaagatgaagccaaaaaagacgagctttctgacgtcatgacgcacctggccaagagtctgcgcatggtagccgcaatgctgcagccgattatgacgcacgcgccaaaagaaattttggatcagctcggcctgccaaaagaagatatcgccttgactgacctgtcatttaacgacttccctgctgaagttaaggtcgtagctaagggaacgccaatcttcccacgtcgtgatgttgaagaagaagtggcttttatcaagagtcagatgagtgccaaccaaaaggccaagggtcgcaaggcaatggctgaggctgccgaaaaagccaaggtacaagctcagctgccagaaatgaaaaaagatattcgaattgacgtttttgacaaggtggatctgcgggttgctcagatcaaggctgctgatcatgttgaaggtgccgacaagctgcttaagttccaactggacgatggcacggctgagggtcgccagattttgtctggaatcgcgcaatggtatccagatccaagcgtcctggtcggcaagaaggtcttgatcgttgccaacctgaagcctcgtaagatgcgtggtgaattgagtcaaggcatgatcctttctgatgaggatgctgccggcaacgttcaagtcgtaacggtaccagaaaacatgcagccagggacgacggtctgctaatggctgggttaaaacctgaattaaagatctatgattcgcatacgcatctgaatgacgatgtcttttatgatgatgtaccggcctatctggcacgagctcagcattttggcgttgttgaaatgaacatgatcggttccaatgaactgcttaatcagcgagccattgagctggcacaccaatacaagggactgcatgccgtgattggctggcatccagaagatattgcccgctttaataatgcagccgaagaactgctcttaaaacagctgacggattcagtcgttgtgggaatcggcgaaatcggtctggactattttaacgatgagcattcaccgcatgatgagcagaagcgggtctttgagcgtcagctggcgattgccagagacttaaggctgccggtctcgattcattgccgtgacgccctggctgatacctatcaaatcctcaaaaacgcgcacgtggaggaatttggcggggttatgcatagctttaacggcgatgttgaatggatgcagcgttttttggatctggggatggcaatctcctacagtggcgtcgtgacgtttaacagcgctaaggacgttcaagcagccatgctggcaacaccgctcgatcatctgctggttgagaccgatgctccctacctgacgccagtgccatatcgcggtcagcgaaatgagccgggctttacgcgttttacgcttgaaaaaattgccgagctgcgtgaagaatcactagaagatgttgccagggcaacttatgcgaatgccagtcgattatttttgaatcactaatgaaaggccttatggaaaagattaaagaagtcatcgttgtcgagggcaaggatgataccaaacaaattgctaaggccgtcaacgccgacacgtttgagacaaacgggtcggcgttgtcgtcaaaagaccttagccagctagcaaaactacaagcagcacgtggcttgatcgtttttacggatcctgattttaatggcgaacggctgcgcaagattatcagtcaagccgttccaggcgtcaagcatgccttcatcagacgtgatcagggcgtgccggatgaagcacatggcagcctaggcgttgagcatgccgatccggcagttatcaaggaagctttggcacacgtttatacccaagaaaccgcgccagcaacggtgattacgactgccatgatgcgtcaggccgatttgatgggtgacaaaaatgcccgtgctcggcgcgagcggcttgggcagctgctgggaatcggctatggaaatgccaagcagatgcaaaaacggcttaatatgttccgcattagtcaagaacagtttgaaaatgccattgaaaaaatcaatcaggaggaaaaaatcgatgagcagtaatctggaaatcggcagtctgaatcggacccgagccattatgaaagagtatggcattcacgctaaaaagggctttggtcagaattttttaacggatctcaacgtcttaaaaaatatcgttaaagcagctgctattaccaaagaagacaatgtgatcgaaatcgggcctggactgggtgctttgactgagcagctggcacaggctgctggtcaggtggtggctttagaaatcgatacggatctgctgccggttttggatgaggtgctttctccgtacgacaatgttaaagtgctcaaccaagacgtactgaaagcagatctgccggcgctgattcaagaacagttcgctgatccgagccggccgattaaagtggttgccaatctgccttactacattaccagtccaattttaatgggcctattggaaagcccggttgcctggtcggcgatctgcgttatgatgcaaaaagaggttgctcagcgtttaacggctcagccaggaaccaaggaatacggctcgctgacgctggcgattgagtatcgtatgcaggctcggattgcattcggggtttcgcgtcacgcctttgtaccagcgcctaacgtagactcggcaatcgtggttttaacgccgcgtactcaaccgttagctgctaagccatatgacgaaggaaaattcttcggtttcgtaaagaattgttttgctcatcgtcgcaagagcctgtggaacaacctcaaaccattagctggtaagaatgctgataaacaggttgttattcagaatgtgttggcagagttaagcatctcaccgcagattcgaccagagaagttaaccttggagcagtttattactttagctaatcaacttcacgcccaaaaactactttaaaaaataaattgctttttgggatgtcttgtgataaaatttgactttttaaagattcttgccgtataatgtttctttgtgaggtgagaatacatgccaacgacaattgcaggcatcaaggaaaagcttgatgcacaggtaggccaaaaagtactggtcacggcgcaggctggtcgtaaaaaggttacccagcgtcaaggcattttaagcgagacgtatccagcaatctttatcgttaagcttaacaagcgtgaaggttcttttgatcgggtttcttacagttatgccgatctcttgactaataatatttctttgacattcgaagaagctgaataactcagtaaaagcatcgtgtttaacgcggtgcttttttgtttagcagcaagggaatccttaaggctggctttagtctttgagcaatagttgcaactcggttagccacatttgtataataattaaaattacttgtcaaaaaaggggggtatgaccttgatcataactgaaaaagctcccgccaaaatcaatctggctttggataccccgatgcgttatattgatggtctgccacgctggaatatggtgatgaactccattgatctcgcggattacgttacaattgagacgcaccagcatcagcatcgtatcaaggtttataccgacagcagctttttgcctaatgaccagcgcaatcttgcctaccaggctgcccatattcttaaaaatcgttttcacattgatgagggcgtgacgatcaagattcaaaaacgaatcccagtggcagctggcttgggcggtggctcatcagacgcagcggctgtcttacgagcacttaatcaaggctggaatctgggactttctttaagagagcttgctcagctgtcgctttcgatcgattctgacgtgccctactgcgtctacagtcagaccgcccatgtaacgggacatggcgaacaggtcgaggtattaagaccgtttccgcattactgggcagtcgtggccaagcctaagatcagcgtttcgacaccaacgattctgcggcagatcaattatgaaaagctgcagcatctggatgttgattcgttggttgactgtattcaaaacggtcgctggcaggaatcgtttgcttatatgggcaacgttttggagccggtcacgatgaatgaatatcccgagattcgtcagctcaagcagcgtatggaaaagctgggggcagacgtggttcagatgagcggcacaggtccaaccgtttttgcgctttgtcataatgagtcaagagcacgccggctgcataacagcttatgcggtttctgtcgggaagtatatttagccatgcttttatagtctaagagcgtcagacgcgttgcaatgcggtttgacgctcttttattcattttgcaattataagtaatgaacaatagctgtctttacaactattagtccatttaaaaacagtcattttcaaaattttttaaaaaatgatattctcattctatgcattattctactaaaatatattcataaattgattgcataagcatatttaagaaaacgtattcattttatattaaacagtcgttaaaccgttgattttaaaggattgacaacgcttacttaacgggttatattaagaacgtagtcaagtaagaaaacaaaggagtgactgtattatgccaagtccaattcatgtaacttcggaaattggcaagctgaagacggttatgctgcaccggcctggtcgtgaaattgaaaacattacgccagattcgatgtaccgtctgctgttcgatgacattccatatctgccaatcgcgcaagaagaacacgattactttgctcaaacgctgcgcgaccaaggcattgaagttctctatttcgaaaagctggctgctgaggcactggctgaccaagacgttaaggaagaattcgttgaccgcatggtcgctgaatccggctacgcagctggtttgatccacgacgttttgaaggaatacctgttggccatgaatacgcaagacatggttaacaagatcttcgaaggggttcgtcgcgaagaaatcgatctcccacacatgacgctacaacaagctgctgaagacactgaatggccattcgtaatggacccaatgccaaacgcatactttacgcgtgacccacaagcttcaatcggtgacggcctttccatcaaccggatgacgttcccagctcgtcagcgtgaatccttaatcactgaatacatcatcaagcaccacccacggtttgcaggtcaagtcaatgtatggcgcgaccgcaaccacgaaacacacattgaaggtggggacgaactggtattaagcgaccacgtatttgctatcggtatttcccaacggacgactgccgatgcaatcgaagacatcgctaagaacctgttcaagaagtcaaactacgacacggtcattgccatcaagattccgcacaaccacgcaatgatgcaccttgacactgtctttacgatgattgactacgacaagtttactgttcacccagcaatcttggacgaaaacggtcatgttgacaactgggtactgcacccaggcaaagacggcgaaattacgatggaacaccacacggacatcaaggaagtgcttaagaaggccctgaacaaggacgacattgacttgatcccaactggtaacggtgacccaatcatcgctgcccgtgaacaatggaatgacggctctaacacgctggccatcgcacctggtgaagttgttacctacaaccgtaactacgtatccaacgatctgctgcgcaagcacggcattttggttcacgaggttcgttcaagcgaattgtctcggggtcgtggtggtccacgttgcatgtcctgcccaattgttcgtgaagacctctaaaagcaggcatgcggcttgaccgcattaaaacaggcgccgatcaatgagatttggtgcagattaaaagcgaaagttggatcatcgcgatatgaattcgcaacggtacgactttcgcttttttcgattaagaattaaaataatattagacaattctcaatcatttattttttaaggtgtgtaagggttcagaggtgggcgattgagtaggagtcgaagtatttttaagttatttaagcggctttaggtttgattagtttaatgatgagtgttctagtcgatctatgaatagaaacgaggggatatttatggatactcaaaagaaaggtatcggtaagggcgaactgattgccctgatcgttagttcatgtatcggtaccggtattttcgggattaccagtgacgttgcagctgcggctgctccaggcccagctcttttagcttggctgttcgttgcctttggtttcctgatgctggtgctttctttaaacaacctgtccaacaagcggcctgacctgcaaggtgggatctttgcctatgctggggaaggtttcggtccgctgggtgaatttatttctggctggtcctactggctgtcagcttggctgggtaacattgcctttgctacgatgctgatgagttcaattgggactttcattccaacttttaagggcggtcaaaacgttccatcaattattgttgcaattattttctgctggctgttaacgatcctggttaacaatggtgttgaaagtgccaccttcgtcaacatgattgggacgatctgcaagattgtgccgctggtcatcttcatcatcatcatgtttgtctgcttcaagggcggcatgtttacggctgacttctggggcaaggttgcaagcaacgccactaaaggcacgacgactggttcggtctggactcaaatgaaggggacgctgatgactctgatctgggtatttatcgggatcgaaggggcatcagtcatggctcaccgtgctaagtcgcgttctgaagccgaacaagcttcggttatcagtttcattctgctggtaattatctacgttttgatttcaatcctgccatacggtgcgctgacgcgggctcaactggccggcatgggtcagcctgctttgggccacgttctggaaatgacggttggccactggggtgcggtattgatcaacgttggtctgatcatctcaacaatcgtttcctggctgtcttggacgatgctgccagctgaaacgacgatgctagttgccgatgacaaggcaatgccaaaagcttggggcaaggttaactccaagaacgcgccaacgacttctttgatgatcacgggcgttttacagacgatcttcctgttctcgctgctgtttacggaaaaggcttatgaatttgcctactcactttgtgccgccgcaattttgttctcctacctgtttgttggtctctaccagatgaagttgagttccgaacgtaaggaatggggtcaatacacggtcggtctgctttctgcgctgttcatgtttgcctgcatgttcctggctggttggcaagaagttctgctggttacgatcagctttattccaggcttctgtgtctactacgctggctgcaaggaaaacaatcacaagttctctaaggctgagctgtggacgatgggcctgattctggtattgagcgttgttgccgtcgtattggtatgcaatggcacgattaccattagctagcaatttttaacggatggttgtcattgactgaatcaagactatgtaaaagcttaaagacgaatttaaatcgtgttggaatttctccagcacgatttttttatataaaggattgcgctgacgtacaaaattaggtaagatagtcactgttgttaaatcgtaattattactatttatttttgtgaggtgaaaagatggatcgacgcttttggaaaatcgtggctggcttgagcttggcattggcggtgattttttgcttggcagctactgactggcatccgcagcaaaaatcacagcggccgattaaaatcgttgccagcctgaatttttatggcgaagctgcccaggccgttgcgggaaaatatggccaaactgtttccgtaatcgataatgcggcggttgacccgcatgagtatcagccggcgaccgttcaagccgagcaggttgccaaagcgaatgttgtgattttaaatggtctgggctatgatcagtggatgaatgatctggttaaggctaatcaaaatggatcacaaacggtcgttaacgtcggcagacagatcgccggccaaaagaatggtgccaacgagcatgtctggtaccgaccacagacgatgaaaaaactggcgtactatctggcaaaaaaatatgccaagcttgatcctaagcataaacaatactattatcgcaatgccaaaaaatatgtcagttcattgaaagcgattgatcagcagattgaaaaatgccgtcagctggctcaaaaacaaaaagttgacgtcagcgagccggtttttgattatgccttagagaatctaggctatcagatcaatgaccgtcattttgaaaaagcaattgaagatggcaacgatccatcgccaaaggatattcagcagctgcagcaggatattcaagagcatcggatcgcattctttgttaataacaaacagtcgcagagcaagacgatcgacaacctggtcgcactggctaaagaaaatcacgttccagttcttaacgttaccgaatcccagccgaatggcaaaacctatcggcaatggatgttggggcagtatcggcagctctatcgaatcctacagcgaggtgaatgatcatttctcttattacagttaaaaacctgactttagcctatggtgataagaatatcgttgacgacttaagcttttctttggcgcctggcgattttctggtcgtgattggtgataacggcgtcggcaagaccacgctggtaagatcgcttttgggacagctcaagcctaaaaaaggcgtgattgagatgcctgacaagctgaagatcggctatgttcctcagtttcgcaatctggatgaagaatatcccttatcgattaaagactttgtcgctttaaatgccggcaagagtctgcgcccatggctgaatcaaaaagaacgccagcagttgcaccatattttagagctgacggatctgacacgcattcaggatcgcttgttggggcaggcttcgggcggtgaaaagcagcgcgcctacctggcacaggcactgcttggcaatccgcggcttttgatcttggatgagtcaacagccagtctcgataatgaaatgaaatatgagcttttagacttggtagccaagctgcaaaagcagggactcagcgtcatctttattacgcatgactgggatctggctcgcagttatggcacgcgctatctaaagatgatgccggatagctatcagaccggatcgattgaagaattccgacagggggttaaaaatgtttgagttgagctttatgcgcaatgcgtttatggccggcacgtttatcgccattgttagcgggacgattggcgtttttgtgatggcgcgcagcatgtcttttctgacgcacacactgtcagaaatcgggtttgctggggcttcatttgcggtttttgcagggtggccggcattaaacgggatgcttttgttcaccatgcttagctcggtcttagtgggtcagatgagcattaaggagtctcgccgcgaagctgttatcagcgcggtctcagctcttttcatcggcttagggatcttgtttttgtcgctttccagtcaaacggccagttcagccaccagcattctgtttggcagcgtggttgggatcagcaggcaagaggtctggcagctggtgggcctgtcgcttttggtgatggtggtcgtgatgattggctaccgccagctgaagtttgattcgtttgatgctgtcggtgcacgggttaatggcatcaacagcacgctgatctcggtcgtctttttgcttttgctggcattaagcgtcagtgtggcagctcagatcgttggttcgctgctgatctttattctgctgacgctgcctgctgccagtgccaagtattttacgcatggcgtggccaagatgatcgttttagcaatcctgtttgccatgctgggaacctggctgggattgtatctgggatatttgaccaactggccggtgagtttctttattgcagtgattgaagtagtgatctatgtgactgccttgatttttcagcatttggtcaatgattagcagaaagtgttaaaataaaacacggctcaagctttgggcggtgttttttattttcggtcgcatcagccatccgttggcaatctaagtccggaatttctcttttttgcttgattaaatcggttaatccttttaggtggcgctgtcatcgtgattgtttgccgaaacagctcttaagattctgaataaaattgcggtaaaagacgaactattatgttatgatttgaaggtatcaataattattagctcaagtaaaagagggaaatcacatgaaagtcagacgcagtaatcgcttggttgatatgacgcgctatttgatggaacatccacggacgctggtttcattgaagttttttggcgaacgttacggctcggccaagtcatcaatcagtgaggatctaagcatcattcggcggacgctgcacacttggggcgtcggtcgtctggaaaccctgcctggtgccagtggcggggcccgtttgacgctgctctactctgaagaaaatgctgcgcaggtcattgacgatctggttaaggcggttgacgatgacagccggctcttaccaggtggctatgtctatctatcggatcttttgggacggccggacgtgcttcgcgaagtcggccgtttgattgcgactcaatatgttgacgatgacgttgacgtggtaatgacggtcgagacgaaaggaattccgattgctcaaagcgtagcgatgtatctgaacaagccattcgtaatcgtacgtaacagttctcacattacggaaggctcaacggtcagcgtcaattacgtctcgggttcgtcacagcggatcaaaaaaatggagctttcacggcggacgcttaaagaaggtgccaacgtaatcgtcgtggatgactttatgaagggtggcggtacgctgaacgggatgaagtcgctgattgaagaattcggtgctcatctggtcggcatgacggtctttgcagaggggcaattcagtggtcagcgcttggttgacggctgcacttcattgatcaaggttcaggccgttgacgatacgaccaataaaaaaatcactgctcagccaggcagctatatggaagccgtatttggcaataaaaaggagaaataaataaaaatgacgcaacgcaatgcaattattctcgcggccggtaaaggtacgcggatgaagtccaagctttataaagtgttgcaccaagtgtgtggcaaaacgatggttgaacatgtcttaggtcagctggaagaagctaagatcgacaacatcgtgacggtggttggctatggtgccgaaaccgttgagcagacgctgggcaatcggaccaaatatgctttgcaaaaacagcagctggggactggtcatgcggttatgcagactgaatcgctgctgggtgatcaagaaggcgagacgctgatcgtcagtggggatacgcctttgtttactgccgcaacctttaacaagatgtttgaataccatgagcagcgtcatgcggcagttaccattctgacttcagtggcacctgatccgactggctatggccgcatcgttcgcaatgacgtggggatcgttgagcggatcgttgaacaaaaagatgccacgcatgaagaacaggaaattcatgaaatcaatactggtgtctactgctttgacaatcaaaagctgttccaggcccttaagctgatcaataatgacaatgcccaaggcgagtactacttgacggatgtcatcggcattttaaagaaccatggcgaaatcgtcacggcttatcgaatggctgactttgacgaatcaatgggggtcaatgatcgcgttgccttggcgcgggccaacaagatcatgcgtaagcggatcaacacccgcttgatgaaagacggcgtcactatggttgatccagaaaccacttatatcgatgccgacgttaaggtgggccgcgacacggtaattgaaggcaacgttgtgatcaaaggcaataccacgattggcagcgactgctttatcggcgctcactcagtcatcaaggattcagttctgcatgatgacgtcaaggtctatgcctcaacgctggaagaagcggaaatgcacaccggatcagacgttggccccaacagtcatctgcgtcctcaggctgagatcggcaagggtgttcatatcggcaacttctgtgagatcaagaaagcctacattggcgaaaataccaagattggtcatttgagctatgttggcgatgctactctgggtaagaacatcaacatcggctgtggcgtggtctttgtcaactatgatggctccaagaagcatcacaccaacgttggcgatcatgcctttatcggcagcaactctaacattgtggctcctgtcaatattgccgaagactcgtttgttgcggctgggtctacgattacggacagcacggaacgttttgacatggcgattgcccgagcacggcaggtcaataaaccggattatgctaagaagcttccctggtaacagttgctttttgggctttaaatcaatatgattagagtgatagaaaaagtatgcagatttcggaggaccccatgaaagaacgttatgctgaccctaaattaaaaatctttgccttaaattccaaccgcccactggctcaaaaaattgccgatgaggtaggtgtggaattaggtaagctttcggttgaccgctttagtgatggcgaaattcgaatcaatatcgaagaaagcgtccgtggcgataatgtttatgttattcaatctacttcagctcccgtaaacgataacctgatggaactgatgatcatgatcgatgccttgcgtcgggcaagtgccaatacgatcaacgtggtcttgccttactacggctatgctcggcaagaccggaaagcgcggagccgagaaccaatcacggctaagctggttgccaatatgctgcagaattccggcgtgacgcggattgttgcccttgatctgcacgctgctcagattcaaggtttctttgacattccagtcgatcatttgatgggggcaccgcttttggctgactactttatcaatgagggcgtggctgccaatgccgttgtcgtttcgccagaccatggtggggttacgcgagcacgggccctggcagagtttctcaaggcgccgattgctatcattgataagcggcggccacggccaaacgttgccaagattatgaatatcattggggacgtcaagggcaagaaatgtatcatgattgatgacatgattgatactgccggtacgatttccaaaggtgcgcaagccttgatggatgccggtgcagaagaagtctatgcttcagctacgcatgccgttttgtcgggcccagcaattgagcgcttggacaattcaccgttaaaacaggtcgtggttacggattcgattcagctgcctgacgaaaagcagattgacaagatcgtgcaggtttccgtggctccgctgattggcgcggcgatcaagcggatcaatgaaaatcgtcctgttagtcctttgtttaacaaccgttttgaacaggctaacgaagattagatttaatcaaaagagtcgctatctaagcggctttttttgattttgggactaaaaggcggtccatggtataatagtcgaggcaagacgaaaaaggagcaaaaaaatgaaatttaaaactttgctgaaacggctgatgctgggcacggttacggttgcagccgggattagcctggttggctgcggcagctcgaccagtacgcagtcaagcgagtcgtcatctgagtcgtcacaatcaacgaccaagacgacggcggcttccaaggcccgcgatcaagccaataatcagattatgtctggtcagtataaggaagccttaaaaacgctgctggcggtcaagaatccagattcgcagacgcgcagcatgattaaagatctgcagaaatacttagcggctcaagatgcctataatgatcaggaatatgatgaagccgtcaacgatctcagttcggtatcatcaaattccaaaccgatgcgttcggcattcatcagtatgaagaacaaggctaagcaggctcaacaggcagcttctgccagttcctctgctcaaagcagtcaggctaactccagcagctcaagtacgacggcatcatccagctcaagttccagttcggcggtcaattcggcagcagccagtcagaccggcatggacgtaatcaatgcgtttgcggctaagatgaactttaaccagtcgagctacgggattattccagaaggcaaggatggcgacgtatatacttttgaggttcgccaaaacaacgatgataataccgttgctcatttgattggtatctatcagtacaacgctgctactggcgcagttaccaaaatcaattaaccagtctaagtaagaaggcgagaaatggcatgagtgaggaaatcattgcccgtccgttgattacgatcaccaatatcatctggagctttaatcggcagacgcatgagatgcagctgcttttgatcaagcggtctgaagcaccatttaaagatgcctgggcgctgccggaaacgctgctgcggagtacggaaagtgccgatgatgccgcattgcgcttgatcaaggataaaatcgggcttgaggttcggtcaacggcaacggaacaattggcaacgtttaccgcgccgcaccgatcagtcggtgagcgggcattggcgttggcgtacatgacttttttgccggcaatgcctaagcttaagccgggatatggtgccgttgccgccgaatggtttgcttttgagaattttggtcatcattacttattgagcgatggcaggcatcggtttgatctttcaaatacctcacaggcactggcgtttgaccatgatcaaatcgttactacggctattcagcgcattcgcaacaaattggactatcagccaacggttctgcaggtattgggacctacgtttacgcttaaagaggcacgcgaggtctatgcgccattttggcagctgacggcagatcagattgataattcaaatttccgcaagacgcaccaccatctttttaaagaggttgggacagcaacgattcgcaagcgcagcggtcgaccacccaagatatattcgttggcgagcttgccaaatccgttggaaaggagtaaagttgacaacaattaaagtcaactttactttttttacgaaaattaaagtaatttgtacttttatttaaagaggtgagacaaatggcaaatgaagcattgctgattattgactacaccaatgattttgtggctgatgacggcgcgctgacttgtggccaggctgctcaggctttagacgagcacattacacaattggcagatgattttctaaaggctggcaagtgggtctatctgccgactgacgttcatcatcaaaatgacccgtaccatcctgaaagtcggctttatccaccccacaacatcaagggaacctggggacgcgagctgtacggccggcttggcaaatggtatcagaaacaccaagatgatgagcatgtcgttttgctggataagacgcattactcatcgttttgcgggacaccgcttgatctgcggctgagggaaagaaaagttgacacggtgcatttggcgggtgtctgcacggatatctgcgttctgcacacggcgattgcggcatatgatctgaactatcaaatcgtggttcacgaaaaagccgttgcgacctttgatccggctggccaggtttgggcgatgaagcattttaagaacgttttgaacgctcagatagaagattgaaagaagtttagggagaagagaaatggcaatgtctgaagaattattgactgatctgtatgaattttcaatggcgaatggctattatgcgaccctgccgcatgatcaagaagcggtttttgacgtcttttaccgtaatgttcctgataatggcagctttgtcattgcggctgggttggctcaggtcgttgaagcgctgcagaattttcattttacggatgatgacatcagctatctgcgttcattgaatctattttcgactggctttttggactatctggccaatttaaagttttcctgcacggtccgagcaattccagaggggacaccggtctttccgcgtgaaccaatgctgacggtcaaagggccattgctgcagtgtcagctgctggagacgttcgtattgaacatcttgaatcatcagtcactgattgccactaagtcgcgacggatctgtgccgctgctgaaggccgtgcagtcatggaatttggcgcgcggcgggcacagggacctgatgcctcagtctttggtgcacgagcggcggtaatcggcgggtgtaccagtacctccaactgcctggcagctaagaagtttggcctgcaggcggctgggacgatggcacacagctggattgaaagctatcctgatgagctgacggcttttcgcgcctgggcacaggtttatccagacagtgcctcactactggttgacacctatgatgttttgaagagtggggtgccaaatgcaatcaaggtctttagagaattacgggctgctggtcatgagccgattggcattcggattgattctggcgacttgactcaattggcaaccaaggcccggcagatgctggatgaagctggatttgaaaatgccaagattacggcttccaatgctttggatgaaacggtgattcaagcattgctaaaagaaggcgcaccgctggacaactttggtattggcgaaaagctgatcaccagctcgacttcgccagtcttgagcggggtctacaaaatggcagcgctcaaggttgatggtcaatggcagccaaagattaagctcagcaacagtcgtgagaaggttacgctgccaggcgacaaaatggtctaccggctttatcgaaaagatacgccggaccaagcctttgccgatgtgattgccctggctgatgaaaaactgcctgaaaagctcttggctattaatgccgatccactggcaactgatgacgagattgagctgaccgattttgttgccaagccgctgcagctggaagtagtcggcgctaatgccagctcgattgagaccgatgtaatgaaactgcagacgtcgatgaagcatcaattggcacagctgcctaaggctacgcagcgcttgatcaatcctgatgtctaccaagtctacttgacgccaaagctgtttgagcttcagcagcggctgattaaagagcatcatcaaaaggctcaggcttaaaacaaaccagttaaaaaatcgtaaaccgacaaaaacgacgccgctcaaagcagtcttattgctttgagcagcgccgtttgtttttattggtaaattgatcaggcgtttaaaacgtacttttcgatagcttcggcaacgccatcatgattattgtcattttcggtaacaacgtcggccatctgcagcgtatgtggaatcgagttggccatcgccacgccggttccggcaaactcaatcattgactcatcgttttgcgcgttgccgattgccatgacgttgtcagcggtcagattcagcttgtcggtcaaggcagataaggccacgcccttgctggtctgtttgttgatcagctcgaggtagaagtcctcactgcgaacgactctgaaacgatcactgagttcttgaggcatgttggctaaagcggcatcgattttttctttttcatcggtcatcatggccttgccaatcgtaattgaatcgcgcatatggttcagctgatccatgctgcggtagcgtaatggcatggataccagattggattcataaaccgtgtatgggttgatatcttggttaggcgtgtagatatagtcgctggtctcaataattgatgaaacatcctgcttgcggcagtatgattcaaaatcaatgtagtcgtcaaaatcaaccgtgtagtgagccaaaacggtaccgtcagtcgcctgggccaaagcaccgttatagcagataacgtattcgtttgcagaatcggcgagtcctagctggttgacataggctttcacgccagtcatcggacgaccggtacataaaacgatccggacgtcgcgcttagtggcttcattgattgcggcaacggttggtggggtgatctgacgctggtcattgattaacgtaccatcgatatcgattgcgacaagtttaatagacataaaaatacctcctggatctttaattggcaacgacttgattgtttttaatgcagtgctgaaaggcttcatagattggctcgaaaatctcgatgtcattttgctgagtcagcatctcacgcgggaagaaaaagcgctgatcgccggcttctcggcctgagacgcttgccaccagcgtgctgacctgtgacagctcagtcagttcgccatttggatagatgagctcaatttgcgtttgcggctttgagtcttgcgggttgtaggtatcgtaaggcagcttatagctggagtcgacagcggtataatagtcgacgtcaaagccggccgtggtaatcaattcacgcagcttgggcagcatgaaacgggtctgctgatcatagacggcagatttgaatggccgtcggttgataaagcgctgggccagatcgcttaagattttatcgcttgaattcatccaatgaataaaataagtagtcaaaacgccatcgtcaagcgttaaatagtcattcaagtcataatgaccgttaaaaaacggcatcagcagtcgcggcatgaactcgggctggtattgacttggatgctgataaagccacttggcccgcatcagcaggtgatccaagatgacctccatcgagcgtgaaactggatgaaagtaaacctgcagatacatctgcaaccgactgagaatatagtcctcaacagcgtgcataccattgatctcaaaagcaatgccatccttgaccggccgcatcatgtgcagaacgcgatcgagatcgaacttgccgtaattggtacctgtatagtacgaatcgcgctgcagatagtccatccgatcagcatcgacttgacttgatatcatctgaaccacctgtggattttgataggtgtgatcaatcacgctggcgactttttgaggaaaatcattgccgacgcggcgcagaatgcgattgatattggttgattcactggtgatgatgcgccgcgtaatctgctcgtggtcagtgtgaaagatatgttcaaacgtatgcgagtaaggcccatgtcccagatcgtgaagcagtgccgcgcaaagggctacggggcgctcttgatcgttccacaatccatcttgaggcgcttgctgcggatagttgcgctgaaaaaggttgcagatgcggcgcgtgatctcataaacgcccagacaatggccaaaacgagaatgctcggcgccatgaaaggtcattgaagaggtgccgagctgtttgatacggcgcagtctctgaaattccggcgtgtcaatcagatcaagaatgatttgattgtcaacgataatcgtaccgtggatcgggtcacgaaagactttttcgcgcggcagctgttcatctttaaatgtcatgacgaatcctttcttagaaaaagcagttggtttaattatacaaaattattatttagcccgcattggttgagaaattaaaaacaatccgcgtataatcaaattgaaaaaatcgagcaaagggggccgatgtctatcaaatccattgtacccgttaaggtcagcttaaaaacaaaaatgactcaggatggcaaaagcgatcattatcattttgaagaagacggccaattcgttacgttggaaaatggccagcattatttacgctatgtcgagcatcaaggcagccaagccacgccggttcagtttcggttagcaccggatgagattcatctggttcgcagcggcgcacagaagacgcattttcgctttgccaatggcagcgagcatctgacgcactatcaaacggaatatggtcggatcgccctgcgtgtcgttaccaatcgcttggatgccgatttgaatctggcagccatcgccggtcatgttgagatccgctatcagctgctgatgcaggatcaattaatcggtaactatcagattcaattgcaatttggcgcgtaatatcgtattatgtagagtagactttttgagactttttgaagggatgtgcaccagtttggatttaacccatttggatttaaaggttttcgatggccaagacaagtcggaactgtccatgatcgaagtagcgcacgctattttggcttaccatggtgaagcaatggcgttcgctgatttgaccaacgaggttcagcaatatcttggtaagagcgatgaggaaattcgggaacggctttctcagttctacacggacctgaacgtcgatggcagttttatttcccttggtgacaatacttggggcctgcgtgcatggtacccatacgaatcaatcgacgaagccacggttggcgaaaacgaagaagaagaagatcgtccaaagaagaagcgtcgcaaggtcaatgccttcttggcaggggctgacgatgacgatgacgttatcgactacgacaatgatgacccagaagatgatgatctggccgacgttgatgatgaagatgacggcgacggcgaagaagaagattacgacaacccagattacgatgaagacaatccactcgccgatgacgatgaggacaccaatctggaagatcagctctcatcagaaaactttgatgatgaagatgacgttgaagacgatgatgacgaggaataaataatacatcgctcttgactaacctgtttggtctttgtattattttacttgggctcccaagtttatcttgggacttttcgttttaaaaagctccctgtttcagtgaaatggggagctttttttgtattagagaaccggacgcagttccaaaaggagagaaataatgactaaatacattttcgtaactggtggggttgtttcatcattgggcaaagggattatcgctgcatctctgggtcgattgctgaaaaaccggggtctgaaagtggccattcaaaagtttgacccatacttgaacgtggaccctgggacgatgagcccttaccagcacggtgaggttttcgttaccgatgacggtacggaaactgatttggacttgggacactacgaacggttcattgacaacaacctcaacaagtattccaacgttacgaccggtaagatctactcagaagtattgcacaaggaacggcgcggcgactatctgggacgaaccgttcaagtaattccacatattacggatgctattaaagacaagatcaagcgggccggcgaaagtacggatgctgaaatcgtgattaccgaaatcggtgggacggttggtgatattgaatcacagccattcatggaagccattcgggaaatgaaaaaggatgccggtgccgaaaacgtactctacattcatgctacgctgattccatacctgcatgccgcgggcgaaatgaagactaaaccaactcagcacagcgttcgcgaactgcgtggtctggggattcagccaaacattttggtcgtacggacggaagcaccggttactgacagcatgcgcaaaaagattgccatgttctgtgacgttgatgaaaatgccgttatcgaatcccgcgatgttaaggtattgtacgagattccgctgaagctgcaaaaacagggcatggaccagctggtagtcgatcactttggccttgacgttccagaagccgatatgcgcgactggaccaatatgattcaccatattgaaaatggtctgactaacacggtaacgattgccatggttggtaagtacactgatctgcaggatgcctacatttcagttaatgaagcattgcgtcatgccggctacccagtcaatgccaaggttaagatcgatcacttcaactctgaggacatcaatgacgaaaacgttgccgaaaagctgggcaagtacgatggaatcttggtaccaggtggatttggctcacgtggggttgaaggaatgattgctgccatcaagtatgctcgtgaaaacgatgtgccatacctgggaatctgccttgggatgcagacggcctgcattgaatttgcccgcgatgtgctgggctacaaagatgccaactcaactgaatttaatccaaatactgaacataacatcattgacttgatgccggatcaagaagatgttgagaacatgggcggtacgcagcggctcggctcttacccatgcaggcttaaggcaggaaccaaagcagcagctgcctatgacaacaagacgatgattcacgaacggcaccggcaccgttatgaatttaacaacgaataccgtgaagccatggaaaaagctggtctggtgatctcgggggttaatccagatcggaacctggttgaagtcgttgaactgcctaagaacaaattcttcgtagcagctcaataccacccagagttcctgtcacgaccaaaccgtcccgaaggcttgtttgccgcattcgttaaggcagctgccgaaaatcaaaaataattagtctgtatcataaaaaacgacgcgatcagagatggtcacgtcgctttttagactagcggcacgtaagttatgaagattgtttgaaaaggttgtaatttagcggtttattaattattattaaagctgactgttttaaaaataaagaaagattcaactaaaaacaattatcaatttgtaagcgaggaaaacacaatcatgaaaaaaatgatcattcaaggaggaaaccgactttcgggcgaagttaccatcggcggagctaagaacagtaccgtggcgttgattccggcggcaattctggccgatacgcctgttcagtttgataccgtgccggatatcttggatgttcacaatctgatgattattttggaatcaatgaatgttaagtcatcattcaagcatggcgttttaaacattgatcccactcaaatcatggaagctgaactgcccagcaaggcgatcaagagtctgcgggcttcctactacttcatgggagccctgcttggtcgctttcaccgagcaacggtaacttttccaggtggcgacaacattggtccgcggccaatcgaccagcatttgaaggctttcaaggctttaggcgccaacgtcagcgagtcgggcggtaccgttaagatggacgcgccaaacggactgcatggcacgcggatctttatggatatggtttcggtcggcgctacgatcaacgcggttttagcagcagtgagagcccaaggaaccacgatcatcgaaaatgccgcgcgcgaaccagaaatcgttgacctggcaaccttcttaaacaatatgggggctaagattcgtggggttgggaccgatacgattcggattaccggtgtcgatacgctgcagtcaatgaacacgcatacgatcattgccgaccggatcgaaactgggacttatctgtcattagcagctgcgatgggggatggggtcatgttaaacaacgtgattcccgagcacttggaagcttacaccagcaagctgatcgacatgggcgttgacttgcagatcgacagtgataagatctatgttcccaaaacggatcatctaaagccaatcagcgtcaagacgatgccttatcctggttttgccactgatctgcagcagccattgacgccactgctttctaaagcggctggtgaaagcacgattgttgatacgatctatccaaagcgggtcaaacacatcccagaactacagaagatgggaatggatattgaggcacaggatggtcggatcgtggttcgccatactgaaaaactgcatggcgctgatgtcaaggctggcgagattcgtgccggggcctcattgatgattgccggattgatggctgatggcgaaacggttattcatgacgcggaccacatcctgcgcggctatgaccgggttgtttggaaactcaaccggctgaatgccaacgttaggattgaagaagaatagaaaatgacagagtagttgcaagttgaacaaagatatgttaatctgtgaaggttgattatctatgtttcaggcaatgattcatggcaaaaggagcgtaaaatttatgaaacaaggaattcatccagattaccacttggtagtttttgaagactcagcaaccggctacaagtttatctccggttctacggctacttctcgcgaaaccgttaaatgggaagacggcaacgaatacccactgatccgggttgaagttacctcagattctcacccattctacacgggtaagcaaaagttcacgcaagccgatggtgccgtggacaagttcaacaagaagtacggcctcaagtaagccgcattttggcaaaaagtctcactgctggatttttccgcggtgggacttttgttttatcattataaaagtcgaggaaactaaatatgcatcgcaagttaaactggctgcgctggaccgttgccgtaatcctgtttgtcgttggactggctttgatttttaatcagcagatcaagtcggctttggttgacagctatcgaccgaccgttacgcggcaggctgtggttaaaaatcaaaagaaaaaggccagctatgattttgacagcgtccaggatcttagcctacaaagcgtcgcagcagcgcgggctaaaaaacaggatattaatgtaattggcgagattgccattcctgatattgatatggtactgccgattgccaaaggggtcgacaacaccacattagctttggctgccggcacgatgcgcgaagacatgcagatggggaagggcaactatgccttggctggacacaatatggccaatggcagcaaaatcttgttctcaccgctttattaccatgccaaaaagggccagatgatctatttgaccgatatgaagcgggtctatgagtatcgaatctatcagcgcaagttcatcaaggcaaccgacgttcaagtggtcaatgacaccaaaaatgccatcgtcactttgattacctgtgatgataccggtaaaggacgtttgatgatcagagggaaactggtccgcagcgagaagttctctcaagcacctcaaaaagcgcaaaaagctctcagcagcaagtatacaacgggacgcgatcaagaataaaaagggatcagacgtggttatctacgcctgatctctttttgcttatgattgattttacgttgctggattaatgctgatcgtgcagctggcgctttacgacatccaaccaataaggaagcgcctcggccaagctgtcgtaggtatcttggaaacgatgcgtataccaggggtcggggattgacgtaccagctttgcctggcaccacgtcaaaggcctgatgaatcttaaagcgatcctcttttggcgcgatggctttaagatgccgaatgttcatgtcgtccatgccgatgatcagatcagcagtggcgaaatctgcttgagtgatgggacgcgagatgagcccctcagtcggcagatgatacttatgcatgatcttaagcgcgcctggatgcgggccgttgccttcttcttcatagctggttgcggctgagtcgacttggacttgatcggccaggtgattttgggcgatcatttgtctaaacattgcctctgccattggggagcgacagatattgcccagacagacaaataagactttcataaaaaagctccttataaatggttttacagtttaattttataaaagattaagttttagtgcaaaacagcaaaatcattttattcgcctggcattaactgttatgattaagaaaatcaatttcctaaggaggagtattttatgatggcagcaattatcgctgtaatagtcgttattctgctgatcgtttggtacgtcagcatctataacggctttatcactacgcgcaatcaggttgaagaatcagccagccagatcgacgtgcagctgcagcggcgaaacgacttgattcccaacctggttaacacggttaagggatacagcaaatatgaagccggaacgctggaaaaggtaacggctttgagaaatcagttagccggaatgaatatggaagacgatccgcaaaaaacaatggaagtctccaaccagctgagcggtactttgaaatcattgtttgccgtaagcgaagcctatccagatctaaaggccagtgctgaatatcaaaagctgatggaagaactgaccaatacggaaaacaagattgcctactcacgccagctttacaacagctgcgtacggcgctttaacgaaaagctgcaggcatttccttccaacctggtcggcaagattcatcactttacgcagtttgaatatctgcaagtaccagctgaggctcgagaaacgccaaaagttgaattttaaaaacggtttggggtaacgcatgctttatcaacagattaacatgaataagcggcggacggtctatgtggtctttggcttttgtctgctggttgcgctggtaggagctgcagttggctactggctggccggatcaaccgttgtcggcatcatcatggcattagtgattgccttgatctatgcctcagtcatgattgggcagtcaacggatgtcgtgatgaacatgaatcatgctcatgagattcattcggctgctgaatcgcctgagctttggcatgttgttgaagacatggcgatggtcgcacaggtaccaatgccgcgggtcttcattattgacgatcccagtcccaatgcctttgcaaccggcaacgatcctaaacattctgcagtggcggctacgactggcctgatgcagatgatgaatcgtgaggagctggaaggcgtaatgggacatgagattactcacgttcgtaattatgacattcgcctgcagacgatcgcactggcactttcagctgcaatctcatttttggtcaacctggtcagcaatttttggtggctgggcggtggccgcagtgacgatgatgatgaccgtggtgtcaatatcttcggtatgctggcgtcattgctgctgattattttagcaccactggcggcggcgattgctcagatggcactgtcacgcaatcgcgaatatctggctgatgctggatccgtagaactgacgcgtaatccacaagggatgatcagtgcactgcgcaagctggaacatgccgaaccgatgcagcaggctgatcccagcagcgcatctttatatatcactgatcctgaagaaaatgccaagcgtcatcgctggctggatcatcttttcgatacgcacccgccactggaggatcggattgcccgcttggaagaaatgtagggcttgatcaatagtcgaattaaggctcaaggtttgcctgacgacaaccttgagccttttttgatccataaaaattcaatgcctttgctattgataaatttataaccctcgttttgtgatcgtaagggtgatataattaatcagttagactagtcggtacgaaagttcaaaaaaacaaataaaagaggaaatttccatgaagatgagtttagccgagattgcaaaggcaattcgggtgcaaaatgatattgcaaaatggcaggacctagaagtaaccaatgtggcctttgacagccgtgctctggaagctggggcactgtttattccattaatgggtgagcaggatggacacaaatacgttgctaatgcgtttgaaaatggcgcggtggcatcgctttgggccagtgaccacgatctgccgtcaactgatcagccattgctggtggttgatgatccgctgcaggcactgcaggaattaagtcaatactatctgcacaagatcaatccattcgtggttgccgtaactggcagcaatggcaagacgactaccaaggatatgacggcttcaatcttggcgacccaaatgaacgtaaccaaaacgcatgccaactttaataatgagattggcgtgccgattacgctgctcaacatgaacccaaatacggaagccgtagtggttgaaatggggatggatcgtccgggacaattagactttttgagcaagttgactacgcctgacattgcagtgatcacgatgatcggcgaggcgcatatcgaatttttcggtacgcgcgataagattgctgatgccaaaatggaaatcacgcatggcttaaaagaggacggtacgttggtatacaatggcgatgagccgctgcttaaagagcgtgccgccaagcttaagcaatacaccaagacatttggccgtgaactgggcaacgatctgtatgctaccagtgttacggccgcacctaatcatgttacgttccaggttaacgagtggccgggactgaattttgatctgccaatgggtggcgaatacaacgtcaacaacgctttggcagctatcatggtcggcaagctgctgcacgtcaaaccggaaaacatgcagcaggctttggctggcgttgaattaacggccaaccgtgctgaatggattcaaggtgatgctggtgaggcaatcttaagtgatgtctataattcgaatccaacggccgttaaacaggttatcaagacgctggccgcggtcaagaccaatggccggcatattgccgtattgggtgatatgcttgagctaggcgatgcttcggccaaactgcatgccagtctggctgaggccatctcgcatgatcagatcgatgccgtttatctggttggtcaggaaatgaacaacttaaaagatcagctgatcaaagacggttatcctcaagaagccattcacagctatgcagctgaccagctggaagagttaacgagtgatttaaagtcggtcctaacggctgacgatgcaattctgatgaaggccagccacggtattcatctggaaaaggtactggcagaactggccagtgccaatgagaagtaatcataatcatgtctagtcatgattgaattttaaggagaatttatttaagtgaaatttggagaattagggttgtcaaacagcctgcttaaagccatcaaacgcagcggctatgaagaagccacgccaattcaagaacaaacgattccgatggttttaaatggtgatgacgtaattggtcaggcacaaaccgggaccgggaagacggccgcgtttgggctgccgattcttgaacacattgatcctcagaattcggcaattcaagccctgatcatttcgccaacgcgtgaattggcgatccagacgcaagaagagctgtatcggctgggaaaagacaagcgggccaaggttcaggtcgtctatggtggagctgatattcgccgtcagatcaagagcctgaagcatcagccagagattctggttgggacgccaggccggctgcgggatcatattcggcggcatacggttgatttgagtcagatcaatacgctggttttggatgaggctgatgagatgctgaacatgggctttttagaagacattgaagccatcatcaacgaaacaccggcaacacggcagacgctgctgttcagtgcaacaatgccgccagaaatcaagcggatcggtatgcagtttatgaaagaacctaagaccgtacgcattcaagcccaagagctgacgaccgatctggtggatcaatactacgttcgggcacgcgattatgaaaagttcgacatcatgacgcgactgattgatgttcaagatcctgacttaacgatcgtatttggccggaccaagcgtcgcgtcgatgagctgtcgaagggcttaacggcacgcggctataacgcggctggtattcatggcgatctgacacaggatcggcggaccaagatcatgaaacgcttcaaggaaggcaagcttgatatcctggttgccaccgacgttgcggcacgtggacttgatatctcaggagttacgcatgtctacaactatgatattccatccgatcccgacagctacgttcaccggattggtcgaactggccgtgccgggcatcatggcgtttcgttgacgtttgttacgccaaatgagatggactatctgcatgagattgaaaagctgaccaaggtgcgcatgctgcctttgaagccgccaactgaagaagaagcgtttaaggggcagctggccagtgccgtcagtgagatcgatgaactgatcgcacagccatccacgcagcgctatgccgacgccgcgcaaaaactgctggaaacgcatgatgcccttgatctggcagcggccctgcttaatgatatgaccaaagaagctgccagccaggtaccggttaagattacgccagaacggccattgccacggcgcaagcgtcgtcagagcagttatcgtggcagcagctatcgccatggcaactcatcgcatcggagttatcgcggcggcaagcgtaccggtcagagcaagagtcgccgcagctatcgcgaagactcacatggcaagggacgccgcggctttaacattcgccgtcgtggtggtcaggaacaatagacaatgattcaaggatttggaattgatttaacggaaattgcccgcgtgaagcgtgccgttgaaaagacgcccagtttcgtcaagcgaatccttacgccgcctgaattggaacaattggcaaaattaggcggtcagcgtcgctatgaatacattgctggtcgctggtcgctaaaagaggcctttgctaaggcttggggaactgggatcggtcgtgaggtcggctttcaagacattgcgatcatcaataatcaaagcggtcggccaatcgtggttaaatcgccatttaaaggtcaagtgtgggcatcggtcagtcatacgaaagatctggtcatgactgagatcattttggaaaggacaagcgatcagaaaaatgattagcgcacaattgcgggatgccgctatggtagtcgatctaaaggcattaaagcataatatcaaacagcagcaggccgccttgccagccggcagtcgaatcctagctgtcgtcaaggctgatgcctatggacatggtgccgtaccggttgctcatgccgctaaggaagctggtgttgatggcttttgcgtggccatgcttgatgagggactcgagcttagaaatgccggtatcgatcagttgatgctggtattgggactgacgccggttcactatgcgccggttgcggctttaaacgatatctcgctgacggtgggcagcgtcaactggcttaaggaatatgctgaactggctaaaaatgagtcgttgccgcccctaaaggtccacttggcactggataccggtatgggacggatcggttttcgcgatgctgctgaactaaagcaggctttggcactggttaaccagccagcttttgtttttgaaggaatgtttacgcactttgccacggctgacgcggctgatgatacctattttaagcggcagctgggacgttggcatgactttttggctgcggttgatcaaaaaccgccttatgttcacatggccaattccgcagtcggcatgtggcatcgcgaaacgatcgcagccaacacggttcggatggggatctcgatgtatggctgcaatccttctggtcgtgagctgcctgattcgctggatctgcagccggtagcttcaatcgttgcaaagacgacttttgttaagcatctgcaggctggcgaatccatcagctatggcgcgacctataccgcgcaaaacgatgaatgggtcgctacgctgccaattggctatgcggatggctatctgcgccggatgcagggctttaaggtcctagtggctgatcaggaatgcgatatcttagggcggatttgcatggatcaaatgatgattcggctgcctgagtcaatgccaatcggaactgaggtcgttttgatgggaagttcaaaaggcaagacgctttcagcaaccgatctggccgatcatgcacacacgatcaattatgaaatcctgacgagtattacaccgcgattaatgcgacgctataaaaactaggcaggcgatgatgaatggggaagatacggattcagcgcggtgacgtttatcttgcggatctgtcgccagtgattggctcagaacaaggtggcgtgcggccagtactgattattcaaaatgatgtcggtaaccgctacagtccaacgacgatcgtagctgccattacggcccagctgacgaaaagcaccttaccgacgcatgttaagatcaaagcagccgaatcaggaatcgcccatgattcgatcatcttgcttgagcagctgcgaacgattgataagcagcgcttgaaaaagcatttaacgcgcttcgacgatcgaatcatgaaaaacgtcgaccatgcactgcacattagtttgaatctatcgtaaatcaaaaagatccagtcgctgttgactggatcttttttcatgctgaatctggttttaatagttgggatgcagatcttcgatttctggaacttcaaagcccttgcgattcagccgtttgacgattttgtcaaccaaagcctgatcggcactggccggcagcgtaaacagaatctgcttgttatgcgtctgggttgggtcaaggttaagcgagatgacgttggcaatgtcggtaaaacgggtaatttctttggctgccgttaccaaagcaccgcgctcatcagggaccgttaccgttaagacatagctgccagcattaatgttccaggcttcagccagcatgcgcaggacacggctgtgcgtcagaatgccataaaagtggttgtcctcgtccaaaacagcaatgtatggcagatcacgaatggtaaagaagacattgaaaaaggcggccttgattgagataaacttggttgagtttttcagcagggtggtaacgggcagatccatgtcgccatgtcgtgatttatgccgatagatgtgcatcttgtagatgttgccgcgaaaaatcgtccccgtcttgtctaaaaccggtacgcagcgaaaaccggtattttccaaaacagtcaatgcctctgccaaggtggcatcttcaggtagcgtggttagttgatccttggttttgatcagagagttaaaaatcatgctattgcctccaattaagttgcagtctgtggattatctatcaacatgatagcacaagtcgtaatggtctaatcagcaaaaatagcgtgggcatttgctttttgattgatcgtcacttgcggtataataattgcactgatgctggacggggtacggctccgtgcggcctttttgcgtgtaaagaaaggtgattctaatgaaaatgatcgtaggattgggcaatattggctctcgttatgatgaaacgcggcacaacagcggctttatggttgttgaacagatcgcgcgcgactatcagctgggggcctttagtcataccaaatacgaagccgtggctgccacggggatgattgacggtgaaaaagtaatgctggtcaagccaaccacgtttatgaatgattctggtcgtgccgttaagccattaatggactactatcaggttgatctggctgatctggttgtcgttgccgatgatctggacatgccggttggccgcgtgcgtttgaagacacatggcgcttctggcggccacaatggtttaaagagcatcattcaatacctgggaaccaagaatttcaatcgggtcaagctgggaatcgatcatccccaaaacggcacggtggtcagtcatgtgctgggccgctttacgccacaggagcgccctgcttttgatcaggccgtggcggttgcggaaaaagccttgatcgactgggttcatggcgagacgtttgaccaattgatgaatcaatacaactaatcaaaaaggagctggcttcatgcgtctgaccgaatttatcgaatcgaccaaggattttaaaacgattctgacaacgattcgcgatcaaaaaaatcaattgattactggggttgccggctccgctaagacactgttgctggcggcgctgcatgaaaagctgacgcagccgcagctgatcattgtcgatagcctttatcatatgcagaagctggcaactgatctggagaacctgctgcctgatactgaaatctatcagtttccagttgaagaggtactggcagctgaagtagcgaccagttcgcctaactaccgactacagcgggtattggccctcaatgcactgcagcagcagacacccgccattgtgattgcctcggtggcaggactgcgccgaaaattgattgcaccagcgcagtttgcccaggcctcgctgcagctgaaaccaggcatggaactggatccaactgagctgcgcgctaagctgggcgcaatgggctatcaatatcagcagatggtactaagacctggtgactttgccatgcggggctcgattattgatatctatgccttaaataccgagctgccgattcgaatcgatctttttgatactgaggttgattcgctgcgtacttttgatccggaatctcagcgcagtcaagaaaatcttgctgaagttacgattctgccggcaactgactttatcctgcccattacggaatttgaacgggttgcgcaggaaatgaccaaagagcaggctgacctgcaggcagtggttgtcgatcaggaacaaagacaagtgctcaatagtcattttgccgaactgatcacggcgctaaaaaaacatgagctgccagttgaaatgctggaatatgtggatctggtctatcctgaggcggcctcgcttttagactatctgccgccagctggcagtctgtatctggacgattggccacgtattaaagaaacgggtcagcgtctgaaaaaagacgaattgagctggctggacgtaaaaatacagcatcatgaacggggacaggccggttttctgggtcatgatccagagcagctggtggctgatgacgcccatgcccaggcctacctggcgctgtttaaaaaaggaatgggtgccaaacggtttgccgcgctgactgatttaaagacgcgtcccatgcagcgcttctttggtcagatggcgcttttgaaaagtgagctgcagcgctggcaggcccagggcgaaacgattgtcttactagcacagagtcaagagcgtcgccagcagatggctaagacgatggctgagtttggcgtcaaggccgttgagacaaaacccgaccagctgttggagcatcagacgcagctgacggccatgacgctggcaaacgggtttgaatatccacaggccaatctggtcgctattactgaaaacgagatgtttgctcagatcaaacagcgacgggtgcggccgcagaaactggctaacgcggaacggctcaaaagctatgccgacttaaagcccggtgactatgtcgttcatgtcaaccatgggatcgggatcttttctggcattaagacgatgacggttgatggagccaatcaagactatatggtgatcaactatcgcaatcacgcgcagatctttgtcccagtcacacagctggatctggttcaaaaatacgtggccagtgaaggcaaggttcctcacgtcaatcggctgggcggaaccgagtgggccaaaaccaaagcacgcgtagccgccagagtcgaggatattgctgatgagctggttgatctttatgcagccagagaaacagaaaagggttatgcctttcctaaagacgattatctgcaggaaaagtttgaagccgagtttccttatcaagaaacgcctgatcagctgcgcagcatcaaagaaatcaaagccgacatggaaagcgagcgccccatggatcggctcttggtcggcgatgttggctatggcaagacggaagtagcgctgcgagcagtctttaaggcggttttaggcggcaagcaggtggcctttttggttccaaccacgattctggcccagcagcattatgatacgatgaagagccgctttgaaggctttccaattgagattgctatgatgtcgcgctttcgaacgcctaaacagcttaaagaaaccgaagcaggcctcaagaatggcaagattgacgtcgtagtcggcacgcaccggctgcttagcaaagacgttcagtttaatgatctgggactgctggtcattgatgaggagcagcgatttggcgtcaagcataaagaacggctcaaacagctaaaaaacaacattgacgtgttaacgctgacggccaccccgattccgcggacgctgcacatgtcaatgatgggcgtgcgtgatctgtcggtaattgaaacgccgcctgctgatcgctatccaattcaaacttatgtgatggaacaaaaccaagccgcgattcgtgatggaattctgcgcgagctgcagcggggcgggcaggtctattatctgcacaaccgcgtcaacgatattgaacgaaccgttgccgaattgcaggagctggttcccgaggccaggatcggctatattcatggcaagatgaccgaggcacagctggaaggcgtcttatatgacttcattcaaggcgaggatgacgtcttggtaacgacctcaatcattgaaaccggcgtcgatattgccaacgtcaacacgctgtttgtggaaaatgccgatcgaatgggcctgtctcagctctaccagattcggggacggattggccgcagcaatcgcgttgcctatgcctattttatgtatcagccaaacaaggtgctgacggaacttggtgaaaagcggctggcggccattcgcgactttactgaactgggtagcggctttaagattgccatgcgtgacttggcgattcgcggcgcgggcaatcttttgggcaagcagcagcacggctttatcgattcggttggctatgatctgtatgccgagatgcttagcgaagccgtggctaaaaaacgcggccaggttaaaaagccgattgccaatacagaaatcgacatcaacgtggaagcctatctgcctgatgaatacgtcagcgactcacgccaaaagattgcgctatacaaacaggtgcgccaggcaaaatcagatcaggagctgcttgatctgcaaggcgatctgattgaccggtttggtgattatggcgagcccgttgagaatctgctgctggtaggtgagctaaagatgaatgccgatgcggcaatgctggaatcgatcaagcgtcagcgcgaaaatcttgttttgaccttcaccaagaccggcagtcgtgccatcaagcctcctgaaatcatcaaggctctggcggcgacgcggtttaaggcaacgatgggtcagaccgatgatggccggctgaccgtcagattaatcattcagccgaagatgacgcaaaaagactggctcaagcagctgatcgtctgcgtacgcggcatcaatcaggcgcttaacgatgccgataatgatgccaagcatgatttaaaagacaagcaagaaaaaagtcatgatcaagaaaggaaatagataaatgcggttagacaaatttttaaaggtttctcgaatcatcaagcggcggacggttgccaaaaagattgccgatcagggacgaatcctggtcaacggcaagccggcaaaatcgtccagcagcgttaaagccggtgatgagctgaccattcagtttggcaacaaaaccgagaccgtccgaattgatcagattattgagactaccaaaaagagtgagacggatcagatgtataccatcattgatgaaaaatttgccgaggacttcagcaatccatttgacgattagcctttgatctgaagcgattgtgccggttaggctcgattaaccaaaaatgagtcagcaggtaatttaggattaggttggacagttgctaaaaaatcctgttatactttggacaataattacaaggtgaggaattctcaatgaaaggtcgcaatgtctacagtcttgatacgccatatgctcagcagaaaacagctcagcaggcggcggataaggcctatgctcgaaaaatccataagcaccgctttttagcgatgattggcataattggcgtttttgttctggtatttggtgttcagatctggaaaaaccagcggcagcttggccgggtcaatgctcagattcaacagacgcaaacgcagctaaccaagcagaaaagcaagcaaaagcagctgaacagtcacattaaagagctgaatgatcctgaatatcttcaacagctgattcgttccaaatacaactacgctaaaaaaggcgaaacgatttataactttgctaattaagctaaaagcgctttaaaaatcgtgacagcgtttaattgacgatgtaagaaagcggttttggctttttttgttcgctttattacgataattgttcacttgtaacaatgttgatttatgttatactcaaaactgtaaataaatgattaatttttaatgaggagggccagctagttcatggcaattgaagaaggagcaaaggtttcagggaagatctcaggtattactaatttcggggctttcgttgatctagacgataaccagacgggattggttcatatcagtcagatttccgatcgcttcatcaaagacattcacgacgttctgtcagtcggcgatacggtaactgtcaaggtaatgaagattggcagtgatggcaagatcgccttatcgatgaaggaagctcaacctaaggaagaacgtcaccaccatgaggagcgcgaaaaccatcgcgaacagggacacggcttccacgaacgacgtcatgatgaagaggctcatggtcatgctcacactcaagagcgccatgaacaccgtgaattcaaccatgcaccacagcgcggcttttctggggctcgtcatcaccggcaaaatgacagcttcgacaatatgctggccagttttatgaaggaaagcgaatcacgcctgtcaacgctgaaacggcaaacggatggcaagcgtgggggccgtggcggtcgtcgcagctaaaatgaatcttcaacaacagattaagcggcgtctaacagggcaccgcttttttgaatcagctgctcccttggtagttgccgtttctggaggcgttgattcaatggtgctgctggacgtgatgcagcagctggttgatcgtagacgattaatcgttgcccacgtcaaccatgaattgcgcaaacagagccagcaagaggaggcttttttaaaaagctactgtcaaaagcatcaattaaagctggcagtcagacactggccgatcaaagaacatccgcaaaccgggattgaggatgccgcgcggacaatgcgctaccgtttttttgcccagacgatgcatgcacatcaagctgattttcttttgaccgcgcaccatgccaatgatcaggcagagacaatgctgatgaagatggtcaggggcggccaactgacggcactggctgggattgaagatgagcggccgtttgctggtaaaacgctgctcagaccgcttttgaccattcccaaggatcggctttatgagtatgccaatatgcatcagttaacctggtttgaagataataccaatcaggaccttgctttgacgcgcaatcgttttcgaaatctaatcgttcccgccatgatcaaagagaatccacgttttttggcgcatatgacggtatggcatgaacagttgagcgatctgctgacttttagtcaaaacagtttggcgcagcttctggcacagatgacgacggcaaatcagctgcagctggcaaagtatcgacagcagccacagtccagtcgccggctgctaatgctgcaatggctgaagaatcaggctgtctatgacttgacacgatcacagatcaggcagatcgaccagctgctaaacgatgacaaaaagccgcagcagatcatgcaattgccaaatgaacactggctggtgaaagaatatgatgtttgttggcttaaaaacgcggctaaaaaggtcgataattcgcaaaaaaagtccgcagctgtggtagaattgggccaatggcatgaaatcaacgatgaattgacgtttggggtctttagtaaggatcagctgcctaaagacgccattgtgctggccagattcaagctgccacctgatgccttgccgcttagattaagaagctggcaaaaagacgatcggctgcgcttaaaaagtggcggccatcaaaaggttcggcgcgtcttgatcaacgacaaggtaccgcagccgcagcgccaggagcaactggttttgactacggctgctgagacggtgctgtgggtagttggccataagtttgcctggctggatgagtcaagcagcgctgctgaggaccaagaatgccaaatcattgtagttgcccaacgaaaatgctaaaaggagcagataaatgaacaacgatattgaacgcgtcttgtacagcactgaagagatcaatgctgctgaagatcgcctggctaagcagatcaatgccgactatgccgacaaaaagccactggtggtttcagtgctgactggcgcggcgcctttttcggttgatatgtttaaaaagatgacctgttacgcacagctggactttattgacgtttccagctattacggcggcaccgagtcgactgggacgatcaaattgattcatgacttgaaggctgatctggagggccaagacgtcttgatcatggaagatatcgtcgacactggccgcacgctgcgctatctggttgatctgttaggcgagcgtggtgccaacagcgtcaaggtatgtacgctgctggataagccagagggccgcaaagtcgaaatcgaggctgactatgttggttttgtcgttccaaacgagttcttggtcggctatggccttgactaccagggctactatcgaaacctgccatacgtaggaatcctaaagccttccgtatatagcaaatagttgatcaaataatggtcaatgatggtcaattatgctatcatttagtccatcaaaataaattaaacgttgccgttggataggaggttgttatgaacaacaatcgtaaaaataatggattcgctcataacgtgctcttctatgcgataatctttttgtgcattatgggaattgcctacttcttctttggaggaagcagtacggatacgcaaagcaaaaacgtttcccaaagcacttttgttaccgaattgaagaacaataaggttaagagcttccaacttcaaccagacggcggagtctacaagatcactggtacctaccgcaagccacagaaggtcagcggcagcgatgccgggttctcgatcgtcgggcaaaagagcagtaccacgaccagcttccaaagctcagtgctggacagcgacgtaacgctcagtcagctgcagaagtatgctgaaaagcacaacgttaccatcagcaccaaggccgaagaatccaatagtctgtggatgaacctgctgtttaccattttgccattgatcatcatggtatttttcttctacatgatgatggggcaagccagtcaaggcggtcgtggcggcgggatgatgaactttggcaagtctaaggccaagcccgccaatgccaaggaaaacaaggtccgtttctctgacgttgctggtgaagaagaagaaaagcaggaactggttgaagtcgttgaatttctgaagaatccaaagaaattcacgcggctaggggccaagattccatctggtgtgttgcttgaagggcctccaggtactggtaagacgctgctggccaaagccgttgcgggtgaagccggcgtaccattcttctcgatttcaggttctgatttcgttgagatgtttgtcggggttggtgccagccgggttcgtgacctgtttgaccaagccaagaaggccgcgccatcaatcatctttatcgacgaaatcgatgccgttggtcggcggcgtggctctggcatgggcggcggtcacgatgaacgtgaacagacgctgaaccagctgctggttgaaatggacggttttaatggtgatgaaggcgttatcgtaatggctgccaccaaccgggctgacgttttggacccagcactgctgcggccaggccgatttgaccggaagattctggtcggtgctcctgacgtcaagggtcgtgaagcaattctgcgcgttcatgcccgcaacaagccattgggaccagatgtcgacttaaaggaaattgccaagcagacgccgggattcgtgggtgccgatttggccaacctgctgaatgaggcggcattgctggctgcccggcgcaatgaaaacgagatttcagccgctgacgttgatgaagccgaagaccgcgtgatcgctggtccagccaagcgtgatcgggtcgtttcgccaaaggaacgcgaaaccgttgcctaccacgaagccggccacacgatcgttgggctggtcttaaacgatgcacgggtcgttcataaagtaatgatcgtaccacgtggccgcgccggcgggtatgcaatcatgctgccgcgtgaagaccagatgttgatgagcaagaaaaatgctgaagagcagattgctggtctgatgggtggccgggcagctgaagaaatcatcttccattcacagtcgtccggggcttccaatgactttgaacaggcaacgcagattgcacgggccatggttacccaatatgggatgagcgacaagatcggtccggttgagctgcagagctctggacaggtttttgctggccaaggctatgatcaggcaggctactcagaacatacggctgccttggttgatgaagaaatcaagcggatcttgaatgaaggtcatgaacaagcgcttcatatcatcgagacgcaccgtgaacagcacaagctgattgccgaggcgctgctcaagtacgaaacgctgaacgaaaagcagattctgagtctgtacaagactgggaagatgccggaagccgatgttgaagctgctgaagatgaacagcatgccgcaacttttgaagagtccaagcgtgctttggaacgtcgcgaaactgaaaaagtagaggacgagcatgacaacgatgctgaatcggatcatgcttcacaaacgccagacagctcagcttcaaacgatcaaaatgaccaccatgacgatcatgatgatcaggcataattgccaattaacaggagcgtttttgaccactggtcgccgctcctgttttattatggaatcaaaactagaaaaggtgaccaatgatggaaaacaatgactatttagtaaaaagcatgaccaaggatggaatgtttcgtgcgtatgcagtgcgtgctaccaacctggttgaaaaagcccatgagattcacgatacctggagtgccagctcggcagctttaggacgcacccttatcggcacgctgctattatcaacgtccagcttggatgaaaaagccggcatgacggttaagattcaaggcaatgggccagttggctacattgtcgctgatggtacggctcacggcgaggttaagggctatatgaaaaacccgcacgtcaatctgccattaaacgatgctggcaagattgatgttgccggtgcgattggccgccaaggaacgctttcggtaacaacgatgacgccaggcgacaagacgccttatactggcgaggttgatctgatctcaggcgagctgggtgatgactttacctattatctggccaagtcggaacagattccctcggcagtcggcttgtcggtctttgttgaaaaagatgattcgattaaggcagctggtggatttatggtccaggtaatgcccggtgccagcgatgaggccattaccaaattggaaacggccattcaaggcatgccgagagtatcggatctgcttttggaaggtaagacgccagaagacatcctgcatctgctgttccctgatgaagaactcaagatgctgcagacgatgccggtatcatatgcctgccactgcaacaaaaatcgctttgcacatgccctggcaacgatcaaaccggctgatctaaaggaaatgattgaacaagacgaaggtgctgaaatcgtctgtcagttctgcggcaagaagtatcagtttgacaagcaggacttggaagtgatcttaaagcaagccaccagcagcgaccaggcatagtcaagcaaaatcccgtgctcatcagctgagcccgggattttttgcagttttggatatttttaccagccagctgccggcctctgattgacattttgaatccgaccactgaaaattaaggcaattgtcaaaagataggtgagggatttgaaagacgatttgtttaaatggctgggtggactggcttttctgaataacgttggctatagctgcgtatggccggtgacgacgatctatatgcataatcagctgcatcagtcgttggttctggccggggtggttctactgtgctattccagtgccaacgtaatcggcagtattgcagcaggcagccgatttgatcgcgggcatacgtttggcttgaacctttttggccagctgattacgcttctggccgtaacgctgttgatctttatgcatggctggccaagctatcccattttgttatgtatttttggttttggcaatggctggattttaaccttgatcaattcaatggggaccagagtcaaaaaatatcccagcgttaaggtcttcaatcagctttatctggctgaaaacatcggtctggtagtcggtacgggactcactggctttatctatgaacagggaattggctggctgtttgtgctgattgccgggatctatctggtcagtctgattatcgttggcattaagttcgccgaagttgagctgcatggtgagtgcccagtcagacaaactgttgacgcatcggctgacttgactggcaagcgcaatcttttcgtaatcatcgttttgctgctcgggctggtggtcgtctgggtcatgtatgaacagtggatgagcaatctggcagtctatctggcacggttcggcatttcaacggggcgttatggcatgctttggacgatcaatggcattttgatcattatttttcagctgctgcttgactggattggccgctaccatgcgacgcttgatcttcaagtgattctgggagccttttttatggctggctcgtttatgctgctgctttttgcggctcactatgggcagtttgtcttggcgatggttgtgctgacgctgggcgagtcacttttgattccaggcgtgcccgcatatgtcaatcgcttgtcgccggttgctcaaaaaggtcgcgggcaagggatggtcaatgcattttcatcgattggcaaggcgattgggccgctgtttggcggtttggtcattgaaagactgggctatttcaggttatttgcaatctgtacggctgctgatctgattgttggtatgatgatcggaatagtgctgctgattttacgtcgcggcctgcagacctatgattaaattggaattgctgagggtctggcttgctaatctggcaatgattaggctacaatcgttttgattgcaattttaaggaggatatttttgtggaatggcaaattggcaatgttacgattccaaatcaagtcgtagtagctcccatggctggagttaccaactctgcgttccgtgtcatctgtaaaaagtttggcgctggctacgtggtctgcgaaatgatttctgatcgcggcattatgtaccacaacaaaaagaccctgtcgatgctgaaggttgagccgatcgaacatccgatgggcattcagatttttggcggtacaaaggagactttggttcaagcagccaaattcatcgatgaaaataccgaagctgatgtaattgacatcaacatgggctgtccagtcaacaaagtcgttaacaccgatgccggagcaaaatggctgttggatccaaataaagtttatgaaatggtttcttatgtcgtcgatgccgttaaaaaaccagttacggtcaaaatgcggatcggctgggatgataagcacatttatgccgtcgaaaacgcattggcagccgaacgtgctggtgcccaggcaatcgccatgcatggtcggactcgcaaacagatgtatacaggtcacgcggattggaatatcctaaaagaagtggccaatgcattgacgattccgtttatgggtaatggcgacgttaaaacgccagaagatgccaaacggatgctggatgagacgggagcaaccgcagtcatgatcggccgggcagcaatgggtaatccatggatgcttaagcggacggctcattatctggaaacgggtgaactgcttccagaagctacgccagagcaaaaaattgcgatggccaaggagcatttggctggtttggtagaattaaaaggcgagcatgttggcgttcgtgagttccggggacaatcaaccttctacatcaagggaattccccgggcggccagaacaaaggcagcgttggttgaagcggaaacgcagcaggaaatgattgatattttcgatcgtttcttggaggaaacacaaaagcgggcggcacagcaagagatgcatcgtgctcaacgccaggcaaaaattgaggaggaagactagtgtcacaagaactggatcaaatgcgcgttcgtcgcgaaaagatggatgaactcaaagcagcaggaattgagccatttggccgtcgctaccatcgcgaccacttagctcaggatctgcatgaacaatttgatcaggtagataaagacgagctgcttgaacaagaaaacatggtcagcattgccggccgaatgatgcgtaaacgcagcagcggtaaggcgggctttgcggatttcgttgatcggacgggcaaaattcaggtctacgcgcgcaaggatatggttggcgatgaacaataccatatctttaagcgggccgatcttggcgacttcatgggtatcaaaggtgacgtcatcaagaccaacaccggtgaactaacgattcgtgcgcgtgagattacctttctgtccaaggctttgcggccactgccaaacaaatgggaaggggttaaggatccagaaaccatctatcgtcagcgttatctggatctgattgccaacccagaaagctttaagcgtttccaccaacggacggcgattatcaaggcaattcgtaagtacatggatgaccatggctttaccgaggtcgaaacgccaattctgaatacccaggctggtggtgccaatgcacggccatttattacgcaccataatgccttaaacattgacatgtatctgcggattgcgacggagctttatctgaagcggctgatcgtcgggggctttgaacgggtctatgaactgggacgggtctttcgtaatgaagggatggacctgcagcataatccagaatttacaacgattgaaacctatgccgcttactgggatctgtgggatgtcatggacgaaacggaagggatcattaaggcagcagccaaggtagtctctgatgatggcaagattacctatcaaggcactgagattgaccttggcggcgaatttaagcggattacgatgaacgatgccgttaaggaacagaccggcattgactttaaggaaatcaagaccgatgaagaagctcgtcagctggcggcagaaaagcacgttaagtatgaaaaatggtggtcaaagggtcatattctgagtgccttctttgacgaattcgttgaagacaccctgattcagccaacgtttatctatgagttccctgttgaggtatcgccactggctaagcggaaccaagaaaatcctgaaatggcagaccggtttgagctttacattgctggcggtgaaatgggcaatgcctttagcgaactgaacgatccaatcgaccagaagtatcgttttgaaatgcaggccaaggaaaaggctaatggtaacgatgaggccgaaccagttgatctggactatgttgaggctttggaatacgggatgccgccaactggtggtctgggaatcggtatcgaccgtttggtaatgcttttgacggatgccaagtcgattcgtgacgttattctcttcccaacgatgcgtccagaaaagactgctgatgaagaagaaaaataatatttagcatactaaaaacacgtcttgcagatctgcagcgtgttttttatttatcgttggaattaataagtagatgagccgctgataaatcatagattgcaatctgaataacagttggtttctaatcactttttgttcgttaaatagcgaatcatattaagctttgtggagcactagttcgtaaacctaaaatagatttagaaagtttgaaaatagcgttgacgaacccctgggaaacctgtatagtatttattgttgtcaaagcgattggatggcagtcagctgttcggtcgttaatgatcagaaaaaaacttcttgacattactttgacaatttgatatattagttaagtcgctgatttgcttggttttgaaattaaataaatttcttcttgacaggcaattggagatttgataaaataataaatgttgtgattgaacaacgtggtagacctttgaaaactgaatacagtttcgacgaacacaaatgtgcagggtcatcaatcgtaatgattgatgcaaaaacatttgcgaagtcaattcgcttaatttaaatttgagcttttcaagttcttatattttatatgagagtttgatcctggctcaggatgaacgccggcggtgtgcctaatacatgccccccgctttgggacaggttacctacgtgttactcacccgtccgccactcgctggtaaaccaacgtcaagtccgtgcaagcacgttcaacagttgggccaacgcgttcgactt

SEQ ID NO: 700 - DNA, 58304 bp, Unknown
  Metagenome-assembled genome
ccataatcttgcaaaaatacgaatgatttcagtgatgagatggcataatgttcatatcaaaatgaggagggattacccacatgaacaaggcctcccaccttcagccacatccggaaagggctagtaccgccaaatttaccacagtgctgatacgtttgtgcccgctacagtagataaggagcgttattactacacgtcgatttactttttgcttgacgcaagttcaccgtcccactttcaccgcctaaaacacgatgagctgtggtattatcatgcgggtgacccgattacgatttaccgaatggatcgtctaaccaggttgtgcttgatccacacttagagaagggcgagcagcttcagtaccggatctcggcgggggttatatttggctccgcggtcaatgcggcgggctttagcctggttagttgtgccgtggcgccgggctttgactaccatgattttgaaatctttgactagcaacaatataagcatagtctctctgcgcccggcactccagctgataacgcagtaattgagcactattggggcgattttaagacatctggatggcgcatcattcacatccgcaaaccttgacagaactgaaagattggttaggcagggtgttgagtacttcacacaagtcgaatttccagcagcaaataacctcaccgcgaggacttccgcatgagccgtatagactaattttttattttttaagtgttaccttgacagggtacagtaccggattatgccgcatatggctttactaactttggtcatttcatcgcccgaatccgattacatcaaatgggaacggaagcagcaaaaaggcggtgccaggtgcaagcaccggctgccgcctaaaatgacccatcaacagtatttgacaaagagccataaaaataaaaaccagcaagctacttagtgtaatctgctggcctatttttatttaattacaaaaactcatcactgatcgataacctaacaatcttattaattcatcaattaatgttgtttcctatttccatgggctaaagaagtagcccaagagaccggtctaaaatttaactcacgataaagttgttctaaaacagttaatgtttttaaatcaatgtttgaaatactacttttccggtttttaagaatcattgcctcgatttctctagggtcttgttttatgccgtttggaagtcgaaattttatcatctctaatcgattgtccacccatgagtaatcattttttgtactaaatcttttgtttcattttctgtattgattcgtctaattccatagtaattctcctaaatattttttcactaaaaaaaccgcttaatattcacactaagcggttccttacttaggagaatatcaatctacattgaagcacgttgcaaggcttcccttgtacgttgctgtcgggtcattgtgtgtagccactaaccgaactctcgatactcaaacgatttctttgattaaaaacagtataacatagctattcggtagattgtaaataagactctaggcatgttaagagagatggtatctcaaaaacttttgggataggggggtgaagcctaataaaaagcccccgccttattttgacgggggttatttatatagcgagagatgaacggcaatcgactttcacacgcagcaagttccatcaaattttgcttctgaaatgttggaaaatgtgggaataaaatcctaaattgacaatcggctataatcctcttaagggtgacacttgaaataataaaagtgttattttcttaagggggtttttgcatttcaagttattcgacaatgaatagactagagttgctttatggctatcaaaagacagaatccggcctcaaagtatatgccgatatgcatcatgtcaatcagaatacgatgacaagatggattcgacagtttctcttgcatggtttggcgggagctcgccatcaaaccttgacagaactgaaagacttggttaagcagggtgttgaatacttcaacaaagtcgaaatttccagcaagcgaaataatctcaccgcggaggacttccgcaatgaggccgtatagactagttttttattttttaagtgttaccttgacagggtacagtaccgttaatgtaataattattttctgtaatgagaattgatagtaaaaatactccctcgttcatatttcatttaagcttatgaacgagatttttttctggagatagttcaagacatatgtcctcaaaatcgaacaaaaaatccgttatttttatgaaaccgctatcattttaaggaccggtgtcatagaatcaataaatagatttacgtatcatattaagtaatgagagggcagaactatgagcattgaaaagatatacgcggcaatcaactcggacccagccgttcataaagtcatggccaacgcgcctttaaaaatcattgagcgcatgcgggtcgtcgagtttgagattggcgaatttaatctgcggcagggcgaatcatatgatgaaacgtatctgctggtcgctggtcgagtcaaggtgtatctggattcggcaaacggcaagtcggtagtgctggatgtctaccggccagggatgtttcttggcgagcaggaagcggtgatcaacaagccttacagcgcgtcgatcatcaatatcacgccggtgcggctgctaaagatcgacaaccgggatttcgtggcctggctgaataacgatcagcagtttgccaaccggatgatcagctacctttccgaacaggtctatcatcttaccaaacggacggagcgctacagcctgtactcagccatgcagcagatcggtctggagctgatgcgttcggctaaggaaaaacggccaatctcgcgcgagcagctgacatacgaggtcgacacgtcataccgcaatatcaatcgggttcttaaacggctgtcagagcttggaatcattgatgcttcaaagcctgccatcaagattttgaatgttgaggaactacagcggattatcaaaacggaggaatagcaatgagtgaagaagtacaaccacacacgcagctgacgacggcaatcaatactgatcgggcaatcatcatgggtgacccagcccgtgtcgacaaagcggccaaattgttggataatgccaaggaatgggcatacaaccgcgaatacaagtccgtaatcggcgaatatcgcggtcagcgcattctgctgatgtcaacgggtatcggcgcgccatcagccgggattggcgttgaagagctgcacaacgttggcgtcaaaaaagtcattcgggttggctcagccggtgccatgcagacgggaatcggtctgggcgagctgattattggcgaaggcgccgttcgtgacgatggtctgaccaagcaatacgtgccggcaatgtacccagccgtaccttctttcaaattgatggcactggctcacaagtacgctcctgacgcggtctatggtattatccgctcacacgatggcttctacatggacgacaacgcggaaaccgaagcctactggtcatccaagggaattgttggcgcggacatggaatccggcgcgatgatgacgattggacgcctgcgcggcatggagacgctgtcgattctgaacaacgtcgtactctatgaaggcgatctggctgccggcgtcaacagtctggtagatggcgaggaactgatggctaaaggggaaatcgcatcgctcaaactggccatggacattctgagtgacgattcaattaaagaatagaaaagaaacgggggaatcaataatgggacaaacgcaagaacaccacagctggctgtacaatcagctgtttaccaactggaagaagtttgaaattatttatgttagcgtattggtggcattgcagattatcgtctatctcatcgttcccgacagcattatcgggatgatttctggggtcgcagggacgctttgtctggtctatgggatgaaagggcgtaagattacgttcatcttcgggatcgttcaatgtctggccatgacctacattgcgtggatcagtcacgcttatggatcgtttgcgatggacatcttctacgtaatctcgcagccgattggatggtacatgtggggtcatgatgaggctaccaagcgcttttcgccaaaagttcgccgcttgatcttcctgggcgcgttcgttgcctgggcaatcggctggtgggttctggcaatggttcacggccagctgccatactttgactccatcaactttgtcgtcagctttatcgcacagttgctctacattatgaagtaccaagaaaactggtcgctgtggatcatcgtcaacggtgccaacatcatctactggggcatcttagccgttcaaacgatgatggggaccaaccacatcggctcactgggtgccagcctgtcgcagattgcgcttcagtttgcgctgctgttcaactcgctgtacgctacgaaggtctgggccagcggtgaggccgacaatgaaggtggtgccggcaaggacggtgacaagtaatgacggagccgaaattcaaacgcgttttcgccatcgtgctggactcagttggaacgggcaacgcgcctgacgcggccaagtttggtgatgagggcgctgatacgctgggcgatcttggccatgcctggaagggtgcgctaaagctgcctaacctggccaagttgggattgagtaatctgcgcgtggaaccgattgagggcatccccgccgctgataagccgctgggatggtatggccgtatggatgagaattccgccggtaaagacagtatggacggtcactgggaaatgatgggcttgccggttgaaaaagagctgtcaacgttccctaatggctttccagacgagattatcaaaaaaatcgaacagtactcaggccgcccagtaatcgtcaataaaccatactctggcacgcaggtcattcatgactatggcgagcgtcaaatggataccggcgagttgatcatctacacttctggtgattctgtcatgcagattgcggcgcatgaggacgtcatcccgctggaagagctgtatgacatctgccgttatgcacggacgcttttgaacgggccggagtacatcgttggtcgggtcatcgcgcggcctttcgtaggaccggacaagaaccacttcacacggacggccaaccggcatgacttcagcctggcgccaaccggcaaaacggatctggacctgctgcatgaagcgggctacaaggtgatcgcgattggcaagaccaacgacatcttctctggtcgcggcattgatcaggcctaccacaacgaaagcaacatggacgggatggatcacgtggacgaggtgctggaaaaggacttcaccggcttctgcttcacgaacctggtcgactttgacaccatgtatggccaccgccgtgatccaaagggctttggccaggcgctgatggactttgatcagcgtttgggtcatgttctggcggcgctgcgtccagatgatctgttgctgattacggctgaccatggcaatgatccatgcttcaagggcacggatcacacgcgcgaggaagtaccgttgctggcttggtcgccaaagatgcagacgtccggcagcctcggcgttcgctcaacgtatgccgatcttggcgccacgattttggataacttccatctcaaggccctgcatggcacgagtttcttgaatgaattgaattaataaagacacccccagtttacttggtagtaggttgggggtgttttggagttataaatgaaaagaatgtatgtataaaaaattaacctttttaaaatttatgttaaaaggcttgacagaacatgtgaatgatatattactatgtaatatatcattcacatgttaaccatgaagggaggagaagaaaatgactgaatttgaagctcaaaacccaatcaatgtagcaaacttcgttattgatcttgggattcatagtaatcaaccagtaactaatttaaagttacaaaaaatactgttcttcttgcagggatactcccttcatgaatacggtagaaaattaatagacggaaatttttctaaatggaaatatggaccagtagaagaagaggtctattttaattataaagaaaatggatcatctacaattaatagcatgtctgctacagtaactacctctggaactggtggtgttattcatagaccaataaagctaagtggcaattcttttgaagataaagaagtttttcaaaagcttacaaattttacagaaaaactattagagaaggacgcatgggaattagtagatcttacacatcaacatgcatcatggagtaattataaaaaagaaatatattgttatgatgctgatgattatactgatgaagaaattaaaaaatgttatgaggatatgattcttcatgagtagcagtatcagtaaggtaagtagttctgaaagtataagtgtggctattaaatggtgcattaggtatggcaacaatgaaagcgaaaaaacgaaagaattaataaacttttttaagaactttggtagtgatggaaattactgtaaagcgtatgaagttattagcaataagatatatggattatctcctgaagatttaaataaagtaaaagtatttattggggcggaccctaagattaaagagcctttatctgatgcggtttttcaagattcggcgcttgatgatacagaaaaaagcaatttagctaaatttcagcgacatgttaaactaagttgttttcaaaaagaatatattgatcgtttagtttcagatgctaaaaagtcagctgatttagcagaagagatggcaaagtcagttgaaaatagggcaaaagaagctgaagaacaagtgaaatcagctaataagcaagcaaggaaagcaaagaaaaaggttacctcaatatattctgaatttattgctattctagggatttttacagctttatcgtttgcgcttaatggatcgtttcaaatattaggaacgctttttaaagatataaagcatccaacaactggatcaataggttatgctttggttattggtggagtatatctattattggtttacggtgtaatactgattcttttcataggcatgagtaaagtagtggatgaagaagcgcattatagaatagatatatgttttttaatatttatatttgttttttctttcattatggtaggtataggaatgtttgttttaggtgttttgtaagcacaccatattgaaccgtgttgcctactaagcggtggtcaatttcaaaaattaaagaataaaaagggtctttgtcaaatcgtattggtgaagatcaattccctacttcaaaaatgaagtggggaatttttgaggatttaatcatatgcggttggttatagcgtgcttacggtgtttttaaattactttaatagaataggcgttgtatactctagttttctttagagatacaacgcctatacttatattatttatatttagtgtttaaccaaatttgcgacttcgctaccactgaccttaaacagaatttcaggttggagccgttctgtaggctcaacgtaatcatattcttctccggcaaaagtcttaagcacagccatcagaatatgtttcatcccttttggaggaattgccatgcctatttgacgacgtacgctttctttgccacctatgaattcataatcatcggggaatgtttgtaggcgagcacgttcgcgattggttaaagcccgattttccttccaatgatacatatgtgtaccgccgccgccagaaccagttacggtatatgatggcttgtcgaaggtgagacgtttgtagatattagagagtttagctcccttaacgtttaaacgcaactcttcagggatagaaagcgaccatgcattaccaccttcagggatatacttgagcatctctacggttcgcttattatggtgtgttttttcattatttggcgcatctttaggaattggcggttcagtcaatgcttcaccagcggttttatagtctgaaggatttggagtagtgggagctggaacgtggaacttgatacctttttcagccaaatcatttctgattccgacgatgataatacggtgacgcatttgaggaacgccatattgttcaaatttatagaagttaggcgtcagagtgtagccagattcttgaagggcttttaggatctgaatgaatgcttcaccttggttagcggaagtaaggccaccaacgttttcagcaacgaataccttaggctggtatcttcttaaaacatggactccatagctatagagaggtccatagtttccgtcaagtcctttgtgcttacccactaccgagtaatcgttgcagggaaaaccaaagatcaaggcatcgatattaccaagcttttcatcatcatctagattaaaatggcgaacgtcttcacagtaaactgttttagcgtcaggattattaagtatgtttaacttgtatgtttcaacggtatcagggtcatattcgttggcccaggcgtgttcaaagccccattcttcaccatttttatctataaagtggctgttcttggcagcataggctccgccgccaggaccagcgaaaagttcagcagttctaaatatcatgatatctccctcaactctttaattgttttttcgcaaacatacgttttggcatatggctatgctaaaattttacacttttttgtttgcacaagcaatgtttaaatataattgaaaacaattttcttgaagcggggtaaaaagagatgtctattctatatacaaatgttccaccaatggtaaaacctagtgacaagaaaagtattcgtgatacattcgaagaaattcttgctcaatcagataaattggaagtagcagttggatacgtatccgtaaaaggattacagagaattgatgaactggtagaaaagtataagataaaagacatcaaactagcctgcggaatgtattcagttgatggattgcctgagagcattaaaaatgagatcatccgactgcataaaaagtggcgtggagttggaattggcgaaatttacgtcgttaaaaacatggactatcatggtaagctttataacttctggaaagatgggaaaccattccgtagcatcgttggatctgctaacctaggagctttagcaccaactggccgaacaatgcggcaatatgagcttgcaaatactattgaaaatgagaaagaaaatcaagaacttgctgaattcattgatgatttaatcaagaaatgctgtgtttcagcagataatatggatagtattaaggtagttcatgagcgaattgaattattgaatgcgattgaagatgtttctgaactgactgaatcatctgttcagggcttcaataaaaaggaaaatgggattgttgttcgtgttccaattaaagcccctaaattcgccaatcgatttagtacggatcgaaaagactatgctagttcgaatattaatgtctgctatggtaagggacgaaaaggcaaaaatggtaaatacacacgacgtaattggtttgaaactcagattacagtaagtgttgatattacacgtgatccagactatccaaaagacaagccattctttctagtaaccgacgatggttatatgtttgaagcacatactactgctcaaaataataaacagctaactgcatacggagatgatcgaatctttggtcgttggattaaaggacgtttggttgctgcaggtcttctaaaagcgtttgatgatgcagatcaggatccagatcgattgggcgtagtaacggaggagatgcttgagaaatctaacatgaaggtattagagcttcataagactaatgagaaacgtctcggtaaagtatatgctcggaacgaaagaaataggttagataagaagcatagcactgaagaaccgctggatgtatggactattcattttagcaattaataattttgtgagggactaattgatgagttatttaggtaattatgtagggaaaatgcgaagtgagggaaagaaagattttgctgattcaattgaaaaaacggcaaaaaagatcggtgacaaggaactttctaaatttgactacgcatcacaccaaatgggacttttatttggcaatattcaatcaggaaaaacaggacatgtatttggagtgatttgcgaggcggttgaccttggatttccgttctttctttttcttacaacagacaataccacgcttcaagaacagacctatgaacgcgcaaaaaaagaattaacggattttgtagtctgtgatgaaaatgaagagcaaaagtttcgcaatcatggaaataagcctgtaattgttgttgtaaagaaaaatcatagtgtcctaaaagcatgggcaaatcgatttaaaaattccaacatgcttttaggaaatccacttttcattattgatgatgaagccgatgctgcatccctaaatactaaagttaatcaaggggatgtttcttcgatcaacaaattccttcaagagattattggtacggctcaaagcagtatttacctgcaaatgacgggtactcctcaatcattattattacagtcaagtacctcaggatggcatccattatttgtagattatttcgagccaggaaaaaagtatattggtggtaacttctttttccctaaagatacaacgcctgattttgtgcgttttattgataatgattcgtcgatggaaattgctcataaggtagtcgtgcgtcatttggttgtaacggcacaactatttctgacagggcataaagtctctaattgtttaatccatacaagtcgattgcagtctgatcacaacagaacaggtggggagatacgaaaggtactggctaagcttacttataatcatgatgatcctgaattaaagacagaaataaaacaagaatacgcttcgcttgctccagaagattcggccaagcagtcatttgatgatatttaccaatgcattcaagatattctttgggaagtgaagtatagtattgtcgttctgaatggtgccagtgcagatagtagcgaagattatatgagcggttgcaattttattgtgggaggaacaaatcttggccgaggcgtaacctttggacaattgcatacgttctactatgctcgtactagcaagcacccacaagctgatactatgtggcaacataatcggatgtttggatacgatcgggataaaggattggttagcctctttattacacatgaattgtataatctgttttctgaaatcaatgaaaccaataatgcaattgtggaacaggcacgcaaaggagaaagaattaccattagttatccggatggtctgaacccaacgcgagagaatgtattggataaatcattgcttaacatacttccaggaaacagcaaccatttcccttcagatccacataacaatacctttaaagacatttctgctatggttaagaattttgatggaaccgaggaaccacaacctgtatctttaagatttattcttaagcttttggataagtttgaggatgataacttcaattatgaaggctacaagagcatgattcaatctgaattgaacaaatcatcgcttgctactgggatgttgatggttcgcagaaatcgcgatattacttatggaatgcgtgccttgctttcgccaaatgactgggcggccactaataagtttaaagataaatttgtcttgactctctaccaagtaaatggtgataatccaaaattaaattggccagacggaaagaaaatatgggtaccaaatattaagcttcctggtactagtaatatttatatgattgattagcctgtataggagtgtgtttatagatgtctaatctttattcaaatattcctcccttaactacgagtaacgaccaagaaacgattctagaagcttttcattcaggcatagcagaagctgacaggttagaaattgctgttggatatgttaccagcaaaagtcttgaagaattagcaagtcttgttgaaaaatatcatgtatcagaagtagtcttagtatgtggaatgtatcgtgatggcattccttctgatgtcaaggacaagattgttaaaattcaacagaattgggaaaaaaccggcacaggaaatatttatttggttgatggtataacttatcacggcaaaatttataccttctggaaaaacaataaggtatttcagagtatagttggatcagctaatttaagtgcacttgcacctaatcaaggttcgggaagtcaacaatatgaatttgcagttaccatagacgatgaagaacagaataagcaaatttcagaatttatccatagactattagatgagacgtgtgttttggcaaatgaaattgataagtttccggtcattgagaaggtgtcccatactggtagagggaaagtacctgcatcatcaatgatctctgatgatgaatcaaagcttactgaaagcacgttagagaaatgcaaccaatcattaacagacagagtcttgaagattgaaattaaagctcctaagttagcagatttggaacaagggaagagaacactaatgggatctaacattaatgtttgctatgccaattccaataaacgtccacgttcctggtatgaagcgcaactaaatataagtaaaaatattaaagattttccgcgaaagataccatttttcatagtaacagaagaagggaatgtcttcttgactgaaacgaagagtcagggcaataagcagttgtcagtcagtggtagtgatcttattttagggaagtggttaaaaggtcgtttagttcggagtaaaatgattaagccaattaatactagggacgaactgattagtgatggcaaacggcttgtccctaagggtgcaattactcaggaacttttggaacaagcgaatatgcgttaccttattcttagaaagacaaagctaaaaaaagaggggacagttattgatagcaatggccactctgttcttgcaaatctagatgtatgggtggcatcttttgaagcataatgtagatgtagagtagggtgatattgcgatggagtatgagtttgaatctgatcaagaaactcgcaagcgcatgtcaaaggttcatgtgactgagggcaaggatgaagtcgttattcgcaagattctctgggataatggcatccactatcgcaaaaactataaagagttacctggaaagccggatatcgcaatcacaaaatacaaaatcgctgtctttatcgatggagagttttggcacggctatgattgggaaaactatcgcaatcacattaagagaaaccgtgactattggattcccaagattgagcataatatgaaacatgatcaagaggtcaatgccaagctggaagagaagggatggaccgttcttcgcttttggtctaagaaagtgctgaagaatccagagtattatgccgagttgatcatgtggcatgtcagagcaaagcagaattcacaagatactaatgataaataaaatccgagccacgggtgcagacctgtgctcggattttttgatgaaaattaaaaggacagccgtgaagctgccctctgcaaaaaggtagtcagctgggtcatgaccaaatgaacccaatgcattgactacggtaggcctattataccataagataatctagccttgaaaaataacatcattatggtattcgataaactcaagagaaggagtaaacctttcaggcatattaatctgcttatggtcatatgtctttaaccattcgcgtgttgactcatccatatcggttttagcaagattctgagagattattacatgaaaggttttatcaattgtaattaaaccgcagtcaaaagctttatcgtgaaatgaatttaaacaaaggccgtttctaggattggttttttcagtaattggatcgctaactcgccatggcttaatgtgactagcaacaagtaattcagtattattaataccagttatgcagcacttattttgataagaatttaatacggcatttcggaaagcgggagtgtaaaatattttgtgtaaatttctaaattaaattgaaaaagggaaagccttccccgtatgattaaatcgctaaacacaatcaaaacggaggctttccctatgaatcagtttaacaaagaaattcttgacgcgctatcttctgactctaaaaaatcattaaaagatgtctttcgcaatcagctagaacaaaccgtcaatacattacttcaagaagaattgtcggcagtcttaggctaccaaccctatgagcgtaacgacagttccgctcatggggacaacgccagaaacggatcgtatcagcgaaccatcgatactgaatttggaccaatcaatattacggttccgcgcgatcgtaagaataaatttcgtaacgctttattcgaaccatattcacggcggacagatactctggaatcgatgatcattaaaatgtattccaaaggcatcacaactcgtgaaatcgctgatttagttgagcgcatgtatggcgattactattcaccaactaccgtttcaaatattactaagcaagttggcaacttggttgaagagtttcataacaggacctttaagcactcacagtatgtttgcgtgttcttagacgctacttatattccgctcaagcgcggaactgttgagcgcgaagcggttaatatcgcgattggaattcgtagtgacggcggtaaagaagtcttagacttctcggtagcaccaaacgaaaatggtgaagcatggcgtgaactacttgaaagtttacgcaatcgaggaattgaacaggttcagttattcatcgccgatggttttattgggctcgaaaatgtgattgcagaaatttatccaactgctaagtttcagcgctgcttagtccatgtgcttcgtaacctcacatcacatgtgcgaaaaagcgatatgcgagatttgatgagcgaatttaaagaaattcgccaatctgaatcacttgaagaagcaaaacaagctttagataacttcattttgaaatggaaaagcaaatatagcaaccagatgcgaaaattgggtaagttaagtaacttattcaccttctacgaatttccgccaagcattcgggcatcaatttactcaacaaatttgattgaagctttcaacaaaaagttgaagaagaaaattcgccagaaggagcagtttccaaatgaggatgcccttcaacgattcgtgacaactcaaattctagaatacaatgacaagttcgaagaacgagcacatcgtggatttcgaggaagcaaggataccttggattccatgtttatttaagtaagcatttcatacagagaaggattttcaaaagtacacaaaattattgacactctccggaaagcatcttgaccaattcgtgtttttactttgctaagctgttccttcccctcaggtagtttttttaatttcttatcataaaagattccaatatgagattgttcatgatagaggttttgcttgattaaattaacttggtaagcaagctcttcaagatttgattcgtatttttggaacacaatcccatctaacttacttccatttttaagaccgatgacgtttcttttttgcaactcaggatcaaaacgtgctaagttgcacattttcattgatacagcgcctggtgttcttccaattagggctgctaacttctgaattttcggatttttagcgccaatttggccaaacggcatcgaacagtataaagcatatgctagtgtagtttcttcttctgtccagactctgcggctagtttttgtcatagtaatgatctcctgattcgttttgctaatataaatctatctcttaactaaaaatgaatcaatatctcatgagatgctatagtataactgcgagagaaaaattgattttccaagtgtaatatttagcagtatatgctgtaacagatgcgtaatatatgagtaacaaaatagagcactattgaaagaaacgatactactgtcatatccccagcactgatgggccacaggcttgccggtggtagattgcccttatgctctttaaatctaaacaaagcacaacagattatgttatttaggataaatcagctatatggaaaaaccgtcgaactttggtcattaccagagttcgacggcttttagctgagggatgagttttttaccgaaaaagggatatttcgtaattaagtttcgtggatatatagttagtcaaagtagttaatgcccattgctgcctttacttctttgagtgtcttgtcagcaactagatttgccttttcacatcctttatgaagcatgtcatatactgcaggaatgtccttggcaaattcagcgcgtcgctgacggataggcgttaactctttgtttagtacttcaaataagtactttttgattgttacgtctcctaacccgccatgttgataatgctctttaagttcctgaactttttctttgtcaggatcgaagatgtctaggtaggtaaagacgatattgccttcaacctttccaggatcttcaacatgaatatggttaggatcggtatagattgacattactttttgtcgcagcgtgtcttcatcatcagaaagatagatggtattgcccaatgatttgctcattttggcatttccatctaatccgggaatccgcccctggcctttaggaggaaagattccctttggttctaccaaaacgtcgccataaatgttgttaaatgagcgaacgatttcacgagcttgttccatcattggttcttgatcatcaccaactgggataagttgtgctttgaaggcagtaatgtctgctgtttgactaaccggataagtcaaaaatccagctgggatggagtgattgaaatgtttttgctgaatctcagacttaacggttggattgcgttccaaacgagagactgtaactaagtttaagaaatacatatttagctcagaaagagctggaatctgtgattggacataaatagttgacttttctggatccaagccaacagcaagataatccaacgcgacttgagtcaagctgtcttgaatctttttaggattctttgcattgtctgtcagagcttgttggtctgcgatcatgatgaacatgtcgtattttccttcgttttgcatttttacacgttgtcgaagtgaaccaacatagtgtccgatgtgaagcttacctgtaggacgatcacctgaaagtacaattttacgttcattttccatagtatttccttctctctttagaaattaaataaaaactaatcgtcaagtaggttcgtaatattgaaatagatatatctaaaaaaattggtattaacgtagttatcaagtgtgtagatattaagaggagagactttaaatactatccaaatcaaaattaaagttcttgacttttagcaatgatgcttgtcgaaaggatcccactcatattttgctcgtgcaccgccaatatacttaggtcttgagcgaagaaaagtgacatgggcccttccgatttcttttactgaagtgcgtacaggtacctgtacgaattttacatgcatacctattgcagtatcgccgatatctatgccggcatcggcgacaatatgttctacttctacaggatcgttgagattctcaaaagctgctatctgccctgcgccgccagcgtgaatttgaggaaatacgtttacgatttcgaaattatgtgcttcagcgacgcttctctcaactactaatgctctatttaaatgttcgcagccctgtactgccaaatgaatatgcaaaggatttagaatgtctagaatttgcttaaccacagctcttccaatctcgatatttgagtacttgccaattcgcttaccctggatttcgctagtactcatgcctaatacaagaatgctgtctggtttgagatgagcctgctgtaggagctcagatattgccattctagtagattgaaggatgctttcaatatcaaattcttccattgtaactgctcccttttctagaagtggaaaatagctttaaggataaagaatccaatcgggaagagtagggcaggaagcatattggttgtcttaagatccttaacgcccattaagctcagaccagatgaggcaaccataaacccaccaagaatagcaaattcagtgatcaaatcgttagtcagccaagttttagcaaatgtagcaattaagataagaacgaattgatatacaaaaataattggtgcacaaacgatcattccgataccatcagcagctgccagtactaaaaccataacaaagtcaagagatgcattgatgaaaagaaatgcaaagttgtgctgagttgcagccatgatacatccaacaattggaagtgcccctaaagttgataggatacattcagtgacgatggattttcccagaccagctgattttccggcagtcaatccgttaattcggtcatccagcttccacatagtccctaagacagtcccaaataccattgaaataataaataagcaggcatagtgagatttaggcatatattcagccaagctttcaaagccgaccccaaatgcgacaaaaccaatgattgtcagcataactgccttatatttgtcattcatcttcttgccgacaaatccaccaaggaaagaagcaagaataataccaccgacatcggtaaacgtaccagttagacttgttaacataatatcaacgaccttactacttagattattaatagaaagaggctcagccaatgctgagcctctaaagagtgattaaagcccatgctgagttagaacagatggttacagaatgttttcgtgttcagcaatcagctcgaacttcttttgcaaagcttctttgatgcgtggtgcccagtaatcaaacgtttcgtcatcatagcaccatggtgtcatgcaggatgcccgcaggatttccaacttaccttccttatggtattcttctccgtcaatgcccaaagacttaatgaatgaaagtggagcatcgccgtagttatcggtaccaaagttactgtcagaagtaagcaggtcgagactgtacatgtcaccgccttttgaagtagaagtatattcgaagacagcttgagtcagatcattcattgccttcagactgtcgttgccttcttctttgtatacccagtcgaccatgttaaagtctgggtcgtaaactgcgtgagatacaatggtcttgccatttacttcaaacttcatgccatcaacaaaatcattgaagcgacgggcggcatacagagtacgggcaaccaagcggccatagccagagatgttcagaggaagaacgcgatgagctgcccaaacagctgcggcagaaccagcagctttagatccttcaagagtaaattggccaatagaagcaggaactgcaacaccttcttggaatgcataaggtgcgtagtaagtcagcgtgtccttttcgcggttatctttgatagccaaaccaccggcgtcatatggaacatatcccatcttgtgagggtcaacggttacagagtcaacttcggacattgccttgtatgcgttgtagacatctttcttcaagaattggttgttttcggtaaagatgccgtacttttcaaattcgtccttcagattttcgtaaggaataaagtttccttcttcatccaagtacgttgcgcgaccatagccaccgtaagcagcatcgacgtgaatagtaaagttgacgccttgttcgttaaacttcttacgcaattcgacgatttggtcaacatggtcaatggcaccttcttcggtcgaaccaacaacagcaacaacccctaaaacaggaatgtgcttatcagtcagatcttgaataatttcttcaagcttcttgatatcaatgtggtagtgttcatcgacaggaagtacgaccaattgatcttcaccaacaccagtgatatccaaagctttacgccatgaataatgcatagtagaaggaacaagccatttaccaagcttatcaagattcttaccgctacgagcagaacgggctttaacgtcgttcttcttgtcgccagacttgtcaagaaggtctaatgattcctttactgacatgttaagcagttcccattcgctcttaccttcaaccagttcaggacaaacttccttgatggccaatgggatggatgcagtattacgagccaaccacaaagcagttacattggcgatagaaccatcagttgcaacatagccccaaccgttatcatcaaaaccgctaagtttagctaagtctaaaccaacttctttttccattaacgtggaagctggactgccggcccaagcaacaccgttcccattccaaagaattgcaaagttgtaggccaggatggatggcagaagcgtttcattgtccatttgagcccagtagcgccctgcagttggccaaggaatagaaccagaacgcagcttacgtgaaagttcatgcataacgttcttcatattaactacggctttttggaattctggagatgccttttcatcttcagaaatggattcggcatcttcaggattaaagttcttacggtagccgacatggtcatcgattaattcattagttaattccttgaacagttcaacgttttcacctttagggccaaggaaataagcggataagtccatgtctttataatcttttacattactcatttaaagttcctccaaacacctgcataaagagaatgtaagcgtatttagttgatcaactgtctcaaatttaccatttttttttttttttcaactgaaagtgcgaaaatgtaagcgaaaacactggcgtggatattttagatacgattcgtttacttttttctactataatatgtaagcctaaaagcaaatttctcatacggatataaataaatataaatttaattgcttacatgaagaaatattcatatatatatatatcggaactaaacgaatgatgtgccttttttattgatattaaagaacttaaaaattcattttgtttggggcgtgtttgtgggagtaaatatgagtatcgatacaatattgattaatatttagatatttcttgcaaaaatatgttgaaaaatcgtatattaatggcattaaagagtgattgtatttataaatttgctgttgtaaaaagccctttgctgtttgtagcaacgatgagattctatgattctgcatgtagataatgggagtgattttaatgaaaaaatctgcaacggttagacatttggtattcacggcgcttttgacggcgctgactttgatctttggtcgtttcttcttaattccgctgccttggacgcatggtaacatcaatctctgcgatgttggcatttttatcggtgccatgctgctgggaccatgggcgggtggctttatcggtggctttggcgccatgtttctggacttgatttctggctttgcccaatatgcaccattttcgttcatctcacacggtctggaagggatcgttgccggattggtctttaaatacgttcgtggcaaatggggccgtattgccggtgtagccgcgggaacgattgtgatggtagtaggctacttcttctcagatgcaattctttatacctgggcaactggtgcagccggtatcttcccaaacctgattcaaggaattgtcggctcggtaatcgcgcttctgattgcctcgccagttgaaaaagccattcacccgactttagttgggaaatagcagatgctgttacgtagatttcaaaacatttggagggaaacttaaatgaatattattgatgaactgacctggcgcggggccgttaatcaggtaactgacgaagaaggcctgcgcgaactgacggaaaatgaaaagatcggcctctactgcgggaccgacccaaccggcgacagcctgcacattggccatctgattccgtttatgatgctgaagcgattccagctggccggccaccatcccgttatcatcatcgggggcgggaccggtgcgattggggatccatccgggcgcaaaaccgaacggaccctgcagacagaatcacagctggagcacaacgttaaggccctgaccaaccagatgatcaagctgttcgggacggaaaacttcaccatcgtcaacaactatgactggctgtccaagctgagcatgatcgactttctgcgcgactacggcaagctgttcagcgtaaacacgatgctgaacaaggaagtcgtagccagccgtttggaaaccgggatctcctacaccgagtttacctaccagatcctgcagtccatcgacttcctgcatctctaccggcataatgacgttcacctgcagattggcggggctgatcaatggggcaacattacttccgggattgatctgattcataagattgaaggtcccgacgccaaagcttttggtctgacgattccgctgatgctcaaagcagacggcaccaagttcggtaagacagcgggcggcgcagtctggttggatccggaaaagacgacgccatacgagttctaccaattctggatcaatcaagatgaccgcgacgtcgttaaatacctgaagtacttcactttcctgagcaaggacgaaatcgacgcgctggctgaaaaagtcaagaccgagccatggaagcgcgcggcccaaaagacgctggcacgcgaggttaccaagttcgtgcacggtgaaaaggccgttgaagaagccgaacgcatcacggcagcactgttctccggcgacgttgcccaactgtccgccagtgagatcgaacaaggctttaagaacatgccatccgttgaggttgccaaccaaaagcagaacattatcctgtggctggttgacgacaccaagatcgagccttcccgtcgtcaagcccgcgaagacgtcaagaacggcgccatccgcatcaacggcgaacaaatcatggacgagaatgccgaaatcgatccaagcacgcattttgacggtaagttcgtgatcgtgcgcaagggtaagaagcgctactggctggcacgggtaaagaagtagctattccagatagagaaattaatcagtagcaactgttatcaatatccaggctcggcttaactccgcgctctggtctcccctccggcgggccgcatgtgccatgcttaccatcgcctcgggagagccctatcgctgctccgtgtcgccgagcctggtgatggggcctgcatactcatctggtagttctgaataacataagcaattccttttgtagagaatctttccgtggattcaaagtcggcaaaagcaacttgggattcaataaataaaatagacagcatatgcaagatagaagtcgcgatcctcactgggtcacggctttttgcgtactcaaaaagcgcgccatgtaagctgacgcgctgattaaatgctgttgtattcttagttttggttctttaactcagcttcactctttaactgtgatgcatatttggcgatctcagccttttgtgatgacgtttgatagtaattctcaatcaactcatccataggaatcgtgtttttaacatagtgtccatcagccataacgccgtcttcaccaatctcgaacgtcgtatagataacattattgccatcacgtttgaagaacacttcgcttgctgcgtcaccatttccagtgatttccagatagccattgaattcaggtgaagtactggaatcaagcggcttatcgatgaagtagacgcccgttcccgcctcgttattaatcagtgaaataaaccattcttgattatattgaagtcccaccataacggctaacgtacggtcgtcaagcttttccgtttgcgagcttgaagtacttgacgccgagctgctggatgaggaactactgcttgaggatgaagcaatcgaagcggttttagctgatttctgacttgaagtgctgctggttgacgaagagttggacttagcgtttgaagaactgctctgttggccacgggcggctaatccgaagccggctaaagcgatcatcgctgtggtgatgattttcttgttcattggttctcctcctagtttccgtaaaccttggcagcgttagccagttgatttacctggtcagtggccttctgggatgagacaaagctgttgatgttcttttgactggcagtaccaatctcacctgaatcagttggtgttgtcttatagaagtgaatcgtaccgtctgcatctactgaataggcaatgtatgagtccaactcgccaggtgctaaatggtagagcgtgtttcctttatcatcagtaaccttgctgactgccaactgggaatgcttaaccgcgaaatcgtaacagttcttgaattcctcattgttcagtttgttagcgccatagtaggtaacggtgactgaatctttgttgaccgtcatggtagtagtgtgggcgccgaaatcaatggtgtaggtgttgctagattgcttccagttcatgttttgaatggcgttattaagcagattgtcaattccctggccatcttgtttcaagaaacccatcatggcgtattcttcatccgtgtacttttgtgtttgagatgaagagcttgaagaagaggcaacggattgcttctttgatgtactggtcttagtaacggccttgctgcttgattggctgctgctctgttcagacgatgatgatgattgacttccacatgcagtcagcaggaagcatgacattaatgcggatgtgataacgatggattttttattgatactcccccaagagtgttgtttttgtttatatagtataaggataactcaaatcaaatattatagtatgcaccatcagtaaaatgatagtgtaagttagaaacacttttatgttgtctatttaaagcggtataaatttactttcacttcattctcacaataatccctagcaatcaaggacgtacttcctcaatcttggcacaaattggtgtttcaaaatcattataatatagtataatcaattcattaagcatcaagaactagggagagatacatatgccattggaagattttgaattcaaacgtgatggcaatacgctgagggtttttgacaaggcaaccggcgaacttatcgattccggtgagtacgttgaagttgccagtcacaagcagaaacggcgctttgtcgcatttgagaagtactcatataagaagtttgaactggaagaaaagctctgggtcggcgcggatttcctcaaacgcaacctgatgagctcggtccgttattttaacgcgccggtgctgggctgccggacctatttcaataaagaggatgttgatcggtgggtggctgacaactttctgccataccgacgaacaatcgcgctttgtctcagtgatttgacgcctgaagagcaggaatgggttaaaggatttgctaatcgatacaacgaacgggcaaaccagctaaaccttaaacgaaatccaaatgagaaaaagcaatttatcaaggatatgcgcaaggaatgggttgattatatcggtcatgagcaggctaaccgccgtatggcaatgtttcagccggtagaaacacccgatcgcacggcaatctatccacctgttcaaattcaagacgggcagtaccgttttcgattgtatcgcgcgggagatgtcaagccgctgccaaaaggtaatatgtctgaaatcacgatgacgcgccgagcatatatgatcaatggcagtacgattgagtggaagtttggcaaaggtttgcgtcccaagactctatttgaagtcgagaagctgccagatgacgcgatgtggcggttattttctcgtaaggtacgcagcattatctcgcaaatctattcaacgaccagctacgaactttatctcaaaaatggcggcaaacgcagatagggatagaaaagcgtccagacatgggcgtttctatttgtgttgaattttatagttataatatagtacaacatatttaaaaagacaaaagaaagcgctataatatcaatgaagggttagcccatcccttcagaaatttcatctcacgaaatttttcacccaattcacattgattttgtttcgctagatagatgattaacaatctcattccgcttagttgattatccagaatcgtctcactgactgccagtggggcgatttttttgtacgattaagcgaacgtcccaaatgcctgattggttcgtgcgttgcggcaggcgacatatccgtattgatggttcgcgcgcggctgtctgagccaaacgaagccaccgtgacgcgaccaggcatcatagctcacgatgacacccgccggcagcatggcgataatggctgaatcggttcgtgctccccagcgaaggtgcagcgacatacccaacagaaagctgcctttttccttgtgccacgtatcgcccagttcatcaacccatgaatcgggaacgggaatcttaacctttggcgttggtgcctgttcaacctggatcgcgagctgaccatccgcgtagccaatcttagggtcggtgtagtagccatggaagtcataggacatgtcgacaccgataccagctaccgaaaagctgttggtgaactgccaggtaccaacgttgggaacgccaggctgcgactcgccatagttggccacccaatcatttttggcgatcagctccgattgaatcagccgcttttcccagaaccaggacgccatcgaatacacgtccacgtttaagtgctgctgatcaatcagatactgcaaaaacgcgttgacgtcagcggttgggtaatgggcgagggcgtcatcttccgcatccaccgccaagacactttctttgcccaatcccagtgccgttgcattttggtagaaccacttggcctcattgatcgcgtcctgccgaccattgaaacgcgcgtagtgatagccatgcacgcccgcgcgttgcctatctgcgccttggctttgggattgatataggcatccccatctgcggagccttgcgtaatcttgacgataactgctttgactccttgattcttcaatgcttggaaaaacgccggctcatcaggctgatagctgctgatgtcggcgactaatggaaaactggtcataaaaacatctcctttaaaggttatattataaatagactaatactgaaaagccgaaccaccattcttgattagcaatccgtggccgactataatgaagacgtaaataaaagggctcgacgcctgcacagcgccaagcccacgttgtcatcatcgacagcgccttacttcagatcaatagcagaaataaagcaccgtcccagtcgccaaactgcgggacgatgccttttttattctcgtggcttttttggccagagaaagaccaccgcgatgaccaacgccagaaagcagacggttcccaacgcggccaattgcacggtttccggtaggccaggcagcgcgctgagcacttttgccaagccggcgaacggatcaaggtctgacatcacgcgagctccttcccgaaagaaggcggcccagagcagtcaaaacgactttcatcatggcaatcgcctcccctcataatgtttccagaagaagcaaagcgctgccatcagacaacaccttaattatattgacttccgcagaggttaccaattcttttgcgtgataagtcattttattatcagttttttgttataatatagtataattaataatggttggacggttatccccattctcgcccaacttaaacgcctgtatatatcaatagtttgctgcatgttccgactaatcattgttagtcattcgttcatataatagtagtcactgacgtccgcgttttcctcagcgcgggcgttttttgtcgtcttcatatgatatattaaagataactacatatactaaggggaaaatttcatgtcagagatatatccattgggagagtataaggataaatatatagagctgttagatgactatgagtttgatccaggtgatatcgtggccatgggaaatctgattgggttcctatctgactacatttacagtccggtagaatatctgtttttggatgaagagattaaccagattctattcaataaacgactgatgctgagtaagctgacggaagtattattggatagtaatcatgatgacatttccatgctgatcaatctacagctcgcacaggctttgttctttcgaggggattggaaaacatcaggcaatatatatcacagcattttgaaatgggagctggggcgtgccgaaatgggggatgccgattttgaagatatcgatttcaatgacttggttctgcggttgattcataatatctgtaccatctgtgatctaagtggaaatgccgatggtgccgatagcatcaaacgcagtgctcaaggtatcttcaacattaactggaatttttaccagcgatttatgaaaaatcatcccgaatatgaagaaatcacttcaaaacaactgtacctgcttcataatgattcttcctcgctttatttggtcgatggtccaagcgcgtctgactatggtgaccttttggaatcaatggagttcgacttggaggataatccaggcagcgtggagaatttgaagctttccgatgagccttgtctgcttactgtcagcgatgatcaacaaagtgtttttgcaggctctcttgatggcaatggcgctggttcgttcatcttctggttagacaatccaatggctgaaccgacagaatcaactgttgacagtacggatagtgtagagccttcaaccgtgtccgatgaagaagaacagacgaatgatgataataacatcacggaaaccgttgctgctgaagaggatgacgcgaccctggaagaactgttggcccagctgaatgatctggtcggtctcgattccgttaagaaagatgtcaactcattgattaacctgcttaaggtccgtaagattcgggaacagcgcggaataaatcagcccgccatgtcgctgcacctggtgttctatggcaatccaggaaccggtaagaccaccgttgcgcgtctgttggcgaaaatctaccataaaatggggattctctccaagggtcagttggttgaggttgaccgctccggactggtaggcggttatgtcgggcagacggcaatcaagaccaagaaagtgattgatcaggcactgggcgggattctgtttatcgatgaggcctacacgctcgcatcgggaagcggcagcgactttggtcaggaagccattgacacgctgttgaaggccatggaggatcaccgtgatgactttatcgtgatcgttgccggctatccaaatcaaatggccaccttcctggcatccaatcccggcttgaagtcacgcttcaacaagtacttggagtttgaggactatgaaccagccgaactgttggaaatgttggacaagatgtgcgcccagtatggggtagagctgactgacgaggcacgcgactacgctatgaatcttttccagacgacctgtgccgaccgaccagacgactttgccaatggtcgcgcagtcagaaacttctttgaggatgccttaaccgcacaagctaatcgtctggctgccgaaaatgactttgatgagggcctctcgattattaaatccattgatctggccaatgccgaactcgattagctgcaatgacagttttttggcagaacggctaatttaaaatcgctttagactagagtataatcattcttgagggtatggtttcccctcacttaaattgtctgctagctattattcaatccttatataactagcacttaccattcatatagcgccttgcttggtctggcaaggcgttttcaaattgcaatgccgtttgaaatcagctataattatggcgtaaacaaaaaggctaacgtgagggaacacgttagcccgaatgtccttgaaaatcgacagtgtttcgcaaattaatataggttaataagcaataacaccatctttacgagttgcagctctaagatggttttttctttttggtcagaaatgactgaccatgtagcagccggctatgagggaagcaatcacaatgattacgaccgtggccaaggctgcatactgaacgccaattggcaagccatgcagttcgtgaagaacagcggcaaaaccttttaagtcggcgccatcttgatgtcggtttgacacttatgaatccctttcctaatgatgggaagcgtcgcacgttttttcaactccttcattggcatcgctcccttcgaaaagcgaagcaccgccaatgttcttggacaaaaatattataccataatcgagtcagcggctaactggctcgattttttagtgtatttcgataattgcctcttagacgaaacgtaatggacaattacccatctatttaaatttcagtgcgtctgagaggcaatttttgtatttcggaggtttgggctgcttgatcggccatgatcatgatccgaagtgttatttctatcaaataacacctcgaaaaaggcggtttaaaggcatccgtttttatgctaaaattaagacgtgttatttgttcatatataataaaaatgatacttatcgattttgcgaaaaaaagtggagtgacaagatggccagactgattgacgatgtatttaagcatcaaaaattcatccccacgcagatgaccgaatttggttttcagaaaactggggattcctatacatacgaagagaattttctcggtggttcatttcgagcggtcgtcaccgtgaaaaacggcaaagttcatggccaggtcattgactgctcaactggggatgaatattaccagattgacgtgccggcaatgcagggcaagtttgtcagttcagtccgatccggctatctagagatcttagggcagattgtcgatcactgttgcttgtccatgccatttacatccccacaagccaatcgaattacagacaggatttatgatcagtatcgcgtcatgccggattttccttggaagtccaagagcaacaaggataatggcgtttttcgacatttgaattcaggcaagtggtttggcttgatcatgaacggtcggcggggactcattactaaagatgatgatgaacaaaacgttgatatcatcaatctgaaaagcgacacgctgccagttgacggcaaatccattttcccggcctaccatatgaaccataagtactggatttcagtcgtacttgacgatcagctgggcgacaatgacgtaatgagactgattgatgaaagtttccgtttgacgggaaagcaggggtgattaaatgcgacagatcgtattgccaatcaaggatgatgaggtactcaagcaagtgcaggacacgctgttgaacaacttcaagtctggtcggcgcaactacaccatctttcaagtcggcaaggcaacgctgctgcgggtcagcgacgtactgcgacttaaacaggcggacgttttcgatgactatggcgccatcaaacagcacgcgttcatcaaggataagaaaaccggtaagcggaacacgctctacctcaagccggtgatgatggacctggtgatgtatcaacagtggcttaagcgcaacggctatgagggtacaacggaatggctgtttccttctaccacgcgaccgcagaagcatattgacgagcgccagttctataacgtgatggccaaagtcggggatttgttggacatcaactacctaggcacgcacacgatgcgcaagactggggcctatcgcgtgtacgtccaatctaactacaacatcggcctggtcatgaagttactgaaccattccagtgaagccatgaccttggcgtacctaggacttgatcaggtcagccgtgagcatatgctggataagattgattttgggtaaatgaaaagaccttgccgtagtggaataccgctttggcaaggtcaattaatttaggcgtataagtttagcaacaatcagtcatttcttattttcattcgaatgccttttttgtactaatttttgaactgcatcagaaggtatgctcaaaacctcctttggaaaaagagcccaaaaaataagaacaaatgaaataagtgtagctgtaaattcaaattgctctttagtttgagttattaataaaccaagaatggttgaaattataattacaattaacgaaaaatcatctaaatatttttcatctatctggaattcaaacatttccgaaatccatgcaaggataaatattggaaaatagaaaagacctgctaatagaaaaatggtaattaagcagtcctgtactctaagtctttttaaatcgaaaataacagcatccggtctagcaaaaactgtaagatgactaactaccaaaacaaagaaataaaggcaaaggatacaagttataaaattaagtatttttttaccgtagtgatggcactttactaagtacttaaaaaatttatacataaagttttccatttttgatcctaataattaagtatttaaaatcaacgagtaatatattacttattgtaattgattatagagttaaccattattatagaccgctatataaactaatcataatacggatccgttatgacatttatttccatctttacgaacacttattcgcagattgtaatagaatacaaacagaggttcggggagggcagcaagatggacagttcagaagagccgcgggggattttcctggtcatcgacaataaatcattctatgccacggttgagtgcacgatgcgcgggttggatccgctaaccacgccgctcgtagtcatgtcggaagccgaaaataccaatggcgggctggtgctggcctcttctccaatagccaaaaagctttacggcatctccaacgtcaatcgtcagcgtgatctgccgcgcgacaatcacctgatcgtggtgccgccgcgcatgaacacgtacatcgagaagaacatcgaggtcaacaacatctatcgcgagttcgtggccgatgaggacctgctgccgtattcgattgacgagtcgattctggacatcactcattcctggaaactgttcggggatgatccaattgcggtcgttaaaaagattcaaaagaccgttcatgaccgcctgaagctggttaccacggtaggcgtgggcgaaaatccgctacaggccaagattgcgttggacgtctatgccaagcatgatccgcactttatcggcgagatcacctataacacggtcaaagaaaagatctggtccatccctgagatcactgacgtctggggcatcaacgagcgaactgccaaacgtcttgccggactgggaattcattccatgactgagctggctcatgccgacccgttcattctcaaggaaaagatgggcgttatcggcgcacagctgtatgcctctgcctggggaatcgaccgcaccgacctggctgaggaagtcctgccaaaagacaagagcctgggcaattcgcaggtcctgccgcgcgattatacgagagccgaggagattgaagtcgttattcgagaaatcggttcacaggtagcttctcggcttcgcgcgcatgacaaacaggcagggggcgtatacctttcaatcggctattcgctgagtacgccaacggaagaaaccggctttgcccactcgctgaagctttccgattcaacggtcgattcaaacctcatcaacgagcagctgctttatctgttctatacatactgggatggagtatcgccggttcgtcgcatcagcgtggccgcgactcgcttggccgaccgctatggcgagcagctcgatctgttcaatccgcccaaatacgacatggttaagctggaagacaccgttgacgccatccgcaagcgctttggcaagacgtcaatcatgcgggcgtccagcttggagaagggcggcacgtttatcgaaagaagtcagttggtaggaggtcatgccggtggacaaagcttggaataaagaaactgaaagcgaaaggatctgcgagcgaatcaagcgctgctttaccaatcgctggcgcactaagtactgggtctccgtggtctactatgagccggagcatggctataacctgtttttcaacatccagccacgcaacgcctatagccgatccatccccattgctcggctggcgaattgcgagtattatgggttgcttgatattataactgaggttcgccaaacgtatcatttcacgctcaactacctaaactttcctgatgaccaggtccgcgaaatgaggagaaaatttcgatgagaatgcagttttacgatgatcaagaggctgacaagatggccacgcagttttttaaatactactatcatgatcgcggcaagatgaagtgggcggtttcctgctttcggaacataccgccgcgctgaaaaaggaaatcgataaggaacaggatgctgaacatcaagaatagctttttcaacgagatccgcgctaaaatcgtgctataatagcgtctttgccaaataatgcacacctgtttatattaatttgcggtccatgtcatttcgacgtgggccgtttttacgcaaacacgccaaacggataaacccattcagcgtgttaaggaatagagaatcgattaaatgactactacttcatggcaaatcacatgcaatgtcgaacaggaccttgccagaatcattagcctataatcctgtcaatgatgatgctgatcatgttaagacgcacttattaatattgcgccattattttgagagtcttaaggctcctgcgtgtaaggaaatctatgaaatgatcgcagacaagagactattgttgaagcttttgaatcttgcgcagttcatcatactgtttcgtcatccaagaaacgtaattctctcccttaggttctgattcagttacattgagaaccggtatcccattcttcttggcaagcttaaccaggttctcaaccgttgagctactttcctgagtgttatttacgaaaaaatcaattcgatggttcttgatgtcatcttgaatccccttaatgtctttaggagaaggatcggtaccatcttcaaccgccttttcaaagtgagtatcgttaatctggtatcccatgttggtcaaagcatagtcaaaaacgggctcactgacatctacttgatgattgccttcaactttggctgcattgattttatcattcaacttggccaactttttcttatagttgcgtgcgtttcttacataatcgcgtctgtgggctggatcaagtttggaatattttttggcaagtaaatcggcaagctttcccatagtattcggctgataccagacatgttcattatcgccatcctgtttgtgtgctacttgcgttccaacgttaatcaaagccttggtgttatcgtttgctttagccgtcttttccatccaatgatcatagccaagaccattttctataactacgtttgctttagctacctgcattgcctgtttcgttgttggttggaattcatgtgggtcggttgctgaactattaataaaagaagttacctgcccgtggctgccagcgacctctctagccacctcaccataaaaattcaaactggcgactactcgaataggcttgtcagctgagggctttctattacccggttgccaattagtcagcatcaaaagcaaaactacgagcagtgcagaaaccagtccgagaattccccaatgtattcgtttcaaaaaaattcctcctaatagttctaaatcgtaatcattactatttacatttttataacttagtcttttattttgattttgtcaataataatttttatttaatccaaatttcagaaagctaaactactactaaataaagggtattttatgatttaaaaaaattttttatttgcgtccgacgttatgcactctaactcttttaactacaaattgttcaaagaaaatagcgctacttcaagcttttctcgagcctaaaacagcgctgttactgaattcttcgcaacttttcaattgttgtgtcgcattatttattgtgtcatgtaattaatcgtatcagataaataactgcatcattgtatacaactatttattaataccaggttttccagtgattaggcattgccaagagagggatgtttaggctacccgtttatcgaccatggccagtttctgctgcagctcagcgcgtacctggcatagaatcagataatgctctggtcgattataggacgcgggaccttccttcatcagatcagtctcgccatcaatcaaaccattcatcagcgcgtagacatagatgtgcgtctcaagcgtcatgtcatcggtctgcttggatctggtcagcacccgctccgctaagatcaagcaatcaaggtacatgtcgtagatttgctgattataaacgttatgatcgttcatcgcgctaaggcgttcaaacttatccatcattgcgtcgtatacctgggtaaacatcgcggaaacatcaaacatcgcaaagtcctcctttgaacataaaaaccgcctggaccaactctggcctgggcggcttctttaagggaacttaatgaaagtaaattatcaccaagtaatcagacttgagatagaatgatcatcggccgccgatcagccccatatccaaccggctgtctgcatcataaaacattatcatcagccgtgcctatcagttttaaacctgattgaacattcaaaattgatagttttaaatatagttatattatagtacaattgagtatttaaagctacttaaatcgatagaagttaccactcaaaacataccctaaaaataccgttatgaaattatgattttactgctaagataggcaagaagactaaaacagcttgcggtcgcgatatgttatcaacattaataaaaaagaaaggcgatttgctaatggaaaaacagattacaatcaagcgggatggcctgctgctgcatggactgatcgatattcccgagcaggatgagttcgacctggttattttgatgcatggctttacctccgaccttggctattcaaaacgccgggtcttttatgacttaacacctgccttacgcaaaaaagggctaggtactctccgctttgattttaacgggcatggtaaaagtgagggctcgctttcagaaatgacgattttcaatgagcttgctgatgccaatgctgtccttaattttgctcagtagctgaaaggcgttcgtcgaatttacctattgggacattcgcaaggtggcgtgattgccagcttgatggcggcatactatcctgacttgatcacgaaactggttctaatgtctccagccgccacgctgattgatgacgcgcggcttggcatctgtcagggcagcgtctatgatccgcaccatattcccaatacggttacggttaaacagaaaactatcagcggcttctactttagaactgcgcagctactgccattgtacgatatcgccaaacactatgagggtcccgtatgtttggttcatggcacggatgataccatcgttaatccagttgcctcgcttcggtaccatgatgtttacaaaaacagcacgctaaacttgattccaaactgtgatcactcctatctcgatgaggagaaacgtcaacaggccattgcaatcgtctgcgactttttaactaaataaacagttaagcatggcatgatacgtgtcatgctttttttatcaacaaaaagccgcgccctgggatggaacgcggcgaggaagataatctgaaaaagcatgagaggtaggggatgcttgcttgatcattcatctggcaaaacatatttcaaacagtatcttctcttctgcccctctatctatactatactctatgcaaggtatcgagttttgcacttttttatttcaattttttctgaatcaatggcaacttgaaaatgtatggttatggcagtcccaaattgtacaacattaccttcattattaatcaactttttacaatctacaatttactattcactatttacattgtatgagtttattacattatcacttaaatgcctttatatagccattttagctgcgttcacattttacaattcacaatgcacaatctactatttacaattcattattcactatttacattgtagaagttttcgaaaagcaacaatcagtatcgcttagccatcatagatactactctaaattcgtcaatttcagtcctgtaatttttagtcccaaaaaggaattgctgatgttattcaagactacatgcatcaccccaggccggcggaacgtgagcggaactaggggctcactcgaggcgatggtaagcatggcacatgcggcccgccggagaggagacccgtgaagcggaagcggagccggcctggggacgaacaaaaaatctcgttgacattctgcgaggataagcctagtattatgccaactctattttgtacaaagggggtcgatatcatgagcaagtttgattttctgaataaagcttcagacatgtgcattctaattattcgtcaagctgacatgatttcggcggggcgtttcttttaggatgcacaagcactcaacgcattctaaacaagaaacgattaaattccccattttctaagggctgccgatcatacctaattgatcgacggccctttctttttactttgggaggttttgattatgcgtaaagaagaagtcttaaaagtgctgcacaatgaatcatcaacggagggcgtaccaatctcattctggcgacattttgccgacaacgagtttaccgatgcggccaaacatccggaagtcatcacaatcaatctggatggtcaccaagattacctaaacgcggttgatgtcgatctggtcaaaacaatgctggacggctactttccatacccatttcatgaagttggcgatccacgcgacctcagccagctggcacaagtcgagtcgttaaatgaagacgacccatggatcacgggacagattgaactggctaagaagcagcgcgcgattgctggcgacaagccaatattcgtgacggtattctcgccattgatcctgttcaaatgggcactcatcaaacactacgaagaagcattgactctagctgacgagcgcttctttgatctgtacgagcagaatccagaaatcgtcaaatacgtgctgaacgtaatcgccgatgatcagatcaaagtcattaaggcgctgcgtgcacagaccgacattgatggcatctactacagcactcagtccattcaggatcagcgcgctgacaatcatgagttctttgctgaagttatggagccggttgatctgaaggtgcagaacgccatcaatcaggaattcgaaatcaatatccttcacatctgcggattcgatggcgccaccaatcatctggaatggttcaccaactatccgctgcaggtaatcaactgggccaccaaagcagacggttacacgcttggcgagggcaagaaactgtttggcggtcgcgtcgtaatcggcggctttgacaacagtcgcaagggcgttctttattctggcgacaaggaagagattcaagcctacgtacgcgatctgatttctgaagccgggacaaaaggcgtgattctcagtgctgattgcacggtaccgcgtgacatcccttatgagcatctcaactgggcaatcgaggccgcgcataagctctaaaccacatccccgatacacttgactattttgtatatgcattttgataaagtatcgaagcaagaccattacatttaatgattcgccagacatttgtctcttgtcttgcttcagatctaactcacgggttataaacatgctgctcaaacaacggactaatctaaatcattatcgatagctgataattcactattcacaatctacaattcatgatcaactatttacaattcattatttacattgtagaagtttatatagatgtgctataaatgcctttataatgacgtttttatgacgttaataatttactatacacaatccactatctacaatttacaattcattatttacattgtagaagttttcaagggatggaattaaagccttcttttcatcttcaaaatcaaccatggatctgctgattttcagtcttgaaatttttagctccaaaaaggaattactgatgatattcaagactacatgcactcatacatgaccagaatatcatgtatatgcagagggtgtatatgcatcatcccccaggccggcggagtgtgagcggaacatggggctctctcgaggcgacggtaagcatggcacatgcggcccgccggagaggagacccgtgaagcggaagcggagccggcctgggggaaacgaacataatttcatcaaataatcaggagccatattaccattatttttccattattgggtattgctcacaggttttataataaagtcgttaaggtacatgaatcaaagcttcttagcaacactatagattattcaaatttagttaaaatatatatcagcaaacagaaagaacaattgatgtcaagaaaaaaactattaaaaaaaggtatatatatactaaccgccatttttatagttgctgttgttgcttctataattaatgtaaatttaggaaccttttgttttctagctgctttcctttatggcctattatatttgggatatattatttatatatttatcactatttcattcaaccatattaatggcaataataataacaaaaatataagtggatcatcgaaaatccaaaacgccgcctcatctcaaaaaaagattgaaacagatatctctgcagactgtagaaccgctcacaagccagaaaacaagacttctgtatccattaatcttaaaaagccactccctgactcaagtcgtgaagatgtcatagttaatcaccctaacaaaaaatgtgataatagtgagtctcattattgtactcaagagttgtttcaagatcgtcatttccattttgaaccattagaaggtaatgtccctcaaaatatagtaaaggacttcgaaagagtggttgaagaagctaataaattaataggaagtcatgacaaaaagcagtgggctaaaggaatgttactcgttctagattttccaaatactttaccaaacccctacaaaacatttgttagtaactatataagcagttctatgtttggtggagcattttcctttaacgatccacattttaattctctccatccttatgatttttatggttggagaatcaatgaaacaaatcaaatatttcttattgatctcgtcaatattggtgagaaacctaaaatgcaaactctcgatgaatcttacgtggattgttacaaatatatcagtaataactatagtattagttcgtttttgatagaatcaagcgtcccaggtgaaaaggcacaaaaagaacttcaaagcatctgcaaagtggcagaaggctgtggcaatcttctattgaacaagggttacgcctaccaatgtaattattattttgatataacaactcatgacactgttaggcaagaagaagtattcaaatatttgagagtcccattccacttagtatcacaatttgattatttatatcgcaatctaactacttcaacgtgtaaatgggatcatgttaatttagataaattaaaaagttgtggccttggtaagcaaattctcaatgcatataatctacttttaaaaaagcactataaacaagactctactaataaaaaaatgtatgattctatattcgaaaaatatgaagacttcatcatttcgcaaattaatgaaaaagtagatggacatgtttataaatccgttggaaagcgttctaaatgtgtaatagttttaaccgacataactgatgatcaatttattatttataagaaaaggggattagatgtttatcatggatttgatgttttacgtgctcttggagtttggaatcagtttctaaaatacattaacccttaaatcgaagtatagaagcctactactgcaaaaataataatgttataaaagctagcttttataacctgccaaaaaatttatgtcctacaaactgtaatgtcccttcaagatttaatatcaaataacgaaaaatgagacacctcttaatgcaacgagatgtctcatttttcaattttatacagctatgtcttttttcgttgctatttgcgtgatgtcagcatgtctttttcttccagaatgcgcaggatctggtagaagcgtgattggtcactgtttggcagctggtcgacggccacgctgatcatcttcttttccagttcacgcacgttcttggccgcgccaacgttaaccaatgccgtcagctgattgcgaacgtggttgtcaacccgcacgttggtagagtaggtaacctgttcagagttttgaacgatgtcttcgcgcttgacctgcttttcaacaacaaagtccgcgccgtgcttcatttctggacgttcatccttcttcatgtcgtgatttaacaagcccattttaaatcgctccttttattgattatccgtttcttgcttgcccttgttcagtcgttcgataatttcctcggcgaccgctttgtacgcgttttgcgtcttgcggtcccaagcatccttgtcgttgtcggtgatcccggtcatgtccatccgcttgacccgttccatgatcgtgatgtggctgttgaaaatgttgtcctcgccaaattcctcgcttgctgactgaagaatcttggcgtcaacggaagagtcgcgcttggacagcactggcagcaggccgataacgtcaaccttggattggaaggaattgatgattacccgctgcagatattcaatcaggtattcagcaccaaccagagaacgttcctgcgtctgcagaacgatgataatctgatcgcaggcgtagaaggccgtatcgttggaaagtcccagcgtaggcggaacgtcgataaagataaagtcgtaacgatcaatcagctgatcttcaagcagcttgcggaagtaggaaacacggctcttttcatcagattccttgttctcaagaaaacgaccgtacaaagagaagtcaaccgccgttggaatcagatccagattttcattgattgacagaatcgcgttggtcagcggttcctcattctgcaacaccgtcatcaaagacttgttgatcgttgccacggcagactggccacgcgtcttggtcttcaaaaagagctgcgtgatgtttgcctgggggtcaaagtcgatgaccagtgtcttgtagccgagcttggacaggttgtagctgaccaaagcagtcgtcgacgtcttcccgacaccacccttttgattgcaaaaggacattacggtagcactcattatttttcacctcatcaatagttttttcgctgtttcgctagttatcaaaaatattatatcaaactttctcgctgtaaatagcaaataatgaataattaattgtgaattgttaacattgacaaagtttttctaatctattctgacacaagggatttcaaatttgccaattttttctcattcatcttccacattgtaaattgttaatagtgaattgtaaatagttaacaacccgaaaatcgctattgatttaggaatatttatgtgtaattattactttaatgatcgatatgaaaaccacatggagttgttagagatcgatcatccaaaacggttggtcttgaaggcgtaaatcgttttgaactttgttagatcaagactgcaaaatttaatcgatatcggttaaaatgtctttgtaaccgctttaaccaaaatgattagaacaaacagcagaatgttctttataaaacataaaacgaattagagattcaggcaataaaaaaagaatcatgagtggccgctcatgattctgagattatcctgaatactcaagcactgcaatcatgatgctataatgtaaagattgagatatccagtttggtttaatttttaatgtagtcacattatagcattaatgagtgcgttcatcaaaggcaattggcttggtcgcatgacttttgcgaattgctgaaagtgcttgagtgtttttgagatagtctctttcactgccgctggtaaggaaggagattttttttatgacttcaaaatttgttaaagtcgagctggacctgctccaaaatgacaactatcgaaaactcgatgtcaacgcaatgctgatgtactctctctaccgctcacggcttgatggctcgatccgcaacgcgcaaaacggcaacccacgcttcatcgacagcaacggtcagccatttatctacttcactaacgacgagatggccgacttgctgcacacgtctcgtcataccgtgaccaacgctcggaaaaagctgatcaagtttgggctgattcatgttgaacgaaccggaatgagtgaatatcgggtgtacgtcaacaattacgtgcggagtgcaaaatgtgaacaccgcgaaaatacccaaaacagctatcaaaccccgtcatatcaacaattcacccggagtgcagaatctgaacgccgcaacgtgcaaaatgtgaacacaagtaagacaaagctattaaataactatctagacaacgtagattcgattgattcctccgcgaaaaatcgcgaggaaaaaattcaaaacgaagccatcaacatcgtgtccgcaaaatctgacgacacgcaccagccaccagcctctgataatcaaaaaacgaagccatcgaatgagccggttgaagaacgctctttaggactcgttgacgataatgatctggacttcgcattcgccctgtatcgttcgcagtttgggcatcttaccaactacacggctcgttatctggaaagtctgcagaagcagtttggcgccagaatgctgagctgtgccatcaaactcagcaaaagatactccatcagcaatccaccggcctatatcgctcagattctctacacggatcgcgctaatggcatcaccaatctggacgacatggtctatgatcacctgaaggctgctgaattcctggacgcaagcttttcgactatgaaccagaatcgcaagaaattccggatcatgacgcaggagatgctcagtcagttccgcagcgcgcctaagattccaattctcaaactgccggaagacgactcaccaagtcccgcacaaagccatgcagcgtctgaatcagaatatgagttccgtgaagtgccgatcatgccgccaaagcagaattggcagggcagcaatcccgttgacgcaaacagctcaaatttcacgtgtaactttgaccagaacgctcagtcagctaacgcgatgaacaatgccgttgtccagacaggcgctcaaaacgaccaatttgccgactatccggcagactggctgacgaaacggatcgccaacgaaaaaaatgcgccgcagtccaacgactctcagcagcgaatcgtggaacaggctattggacagaccgcggctgaatttatggacgcctatcctaaagccgcgccagatgacaagcatcgtttcgcatcgtcagcaaacactgagcagcagtcgcaaagttcaaagcatgagaaattccaatcgccattttcgcttaaggatttcaaaaagcagattttcggtttcaagcagagcggtctcaatccgggaatggcataggcaaaaatcggcaataaaattctcatcgggcgactagaccagttatactttttgttttcaaatgcgttcacaaaccttgatttcttggacgtatactaaaaatttgatgagaactccctcagaaccattgtaagcacatacaacccttgatagcatgaggaatggagccgtctttttggctcataatcgtactttaggggaggagtattccatgaaaaagacgtctaacgctgaatatgccgatgaccggctgattgatctgcgtcagttggatcatctgcagtttgatgacgtgcatgaggcctatcacctggactggagcagcatgcttctgctgatgcgctggcttcatgacggcgaggacagcacgatcgttattgaccgccgcggacgcttactgaacgtggagcgacggtattcggaactgatcagcgagctgtcccaggagtatcatgtctatcgcaacaccatgacgactttgtacaagaagaccaatgctcagtcggtggggtgcgtctcgggtcggcatcggctggtaccgctgacagggctgcgcaatcgtgccgtgatctttatctgtgctgacaatctttcgccccatggattcgacagttcgcgcaggggatgttccgtattgtcgtttgacggctatgatcaccagacgattcgcgtgatgatcaatgtcgctattgatacgatcaagcgcaatcttaacgcggctgccaaggttagtcacgcgctgatcgagcatctggaaatggtgcggaaaaactacgagggcgagcgctgctgtgagaggcatccggacttcaatcaccttgatgatctgcatcagcttgagaatcgggtccgctatgaggtgctgaaaaatgctctggacagcatcgccaataagctgtatggccaccccatggatgaggagttcaagcggctgcttaaaaaacagctgatcgctccttacgatggcaccaatcactgatcgcgtcttggaattctctagctgacctgccagactccaaacaaaaacagcatgccttgtttttcaagacatgctgggagagattcgaggtagtcaagtttttagggattatgcaagagactacgcgatgtttggcggcgcgctgtaaatggcccttgccttttggattacgcgcttttttacgtaggagacggcctgtggtgtggtctgccagtgctcagcaatctctttgttgttgaggccaagctcgatgacgcaccgcagatacgagttctctttttgagttagataaggccaaagccggcgccacagctgttgagcggcggctcgttcgatcagagcggcatcgcagtctgaatcaatgagccattcgctggcgttctcaccattcaatcctgcgtccagacaaagacactgatgattggcgcgaactttttggcgtttgaaacgatccttgaggtgccagtcgatccgttggaaagcataatgcgaaaatgatgactggtctttttcaggggaacctgggaagtcgcgataggcttccgcataccagcccattgcttgttgggcgaggtcatcgaaatcctgatgagatcgataaattccacgatattttaaagcgccgtagataaccaatagtcgctgcttgtcggccaccaagaagcgatagccatccgtaagggaccgttctgcttcggatatcaccttccatctgtaagtttgcaagaacctcaatcatgatagcgctttctgttggcggttggcgcggatcgagcgaatgagtacgatttgggatcgaattaccccaaatcagcgacgctcagcacgcgatgagagctgtctgattgacggtttttgattgctgtcaacacgcggctgtcctcatttgccgccgattcgttcgcgtcacgccggaaaacgcgtcaaatacttgcagaggggtaatagcatgaataatgatcttaaaggacgcattgaccgcatttcattggtttcgctcaacttggcctgggggttcatgaacaaaaagtatggtctgcccgagacgcggccacacaacccgtatcatgagactgagcagcatctgactatcgatcggaacggactggtgcgatttaactcgttctacatcgatggccaaaaagaaatggtcacgccgattcgcagacagcgcttcttgatgaaaccggagcagatcagtcggctgtttgcctatctgcatgagatctttgacggaggctatccgccatacacgatcacggatgggccaacctggcatctggccatcgccaatcagcagggccagatctatcagtacgagggaatgatggttcaggatgagtggctgctggggctcaatggcgttctgcatgagtgcgtcgatgagattgacggcttgtggggcgtggaatgctgaaacggattgttggcaaggcggtttgattgatgactgacggccaaaacgcggtgcttagattttgcagatatgaattgatcagcgtgcaggttctgatggcggcttgaattctcgattctttgccatgactgctgatttctgctttaattgtatttgatattttcaagagagtttgaggaaacatgatgagcgatgaattgagagaacagactaaaaatattgagtcgctgcgactgcgcgcggctgccaatctgtatattagtcagattgatgacctggatacgctggaccggctgcagcggctggtcgacaaaagaagacgcgaactcactgaggggatgacatcttgccaacagagcgcgaaaagcagattctagacctgattcggcaaaatccgatgatctcgcaaaaagagctggcggaaaagcttggcattaccaggccgggcgtggcttcgcacatctcgcggctgatcaaggaagggctgattctaggcaagggttacgtactgcctaaaaaagaatacgttacggtgattggtgccgtgaacatggacatctatagcatcgtcagcgactatccggtggtcttgaagggatccaataccggccacgtgacgacacagctgggcggtctgggcagaaacattgccgcgaacgccgccgcgctggggttggacaccaatctgatcacggttttcggcagcgatgactatggtacccgcttcaaggaggatgcctatcgccgcgggatcgacatctcgtattccaagcagctgccggatcgcaaaacatcggtctatctctacgtcaatcaaggcgatggcgaacggatcattggcgtggacgacatgcggatcaacgagtttatcacgcccaggtttctggagccgcggctggcgggcatcaatgccggcaaggccgcgatcatcgactccaatctgccggcagaaacgattcgctggctctatgacaacgtacgcgtgccgatgtatgccaaagccgtttcggtaaccaagacgccgcgcctgatgcaggacaatctcaatctcgagggtctggtcattaatggcgtggaaggatcgttcatggctagcgttaagatcatggacatcaatgacggcaaggaatgcgccgagaagctctatgacatcttcaagacccgaatctatctgtatctggatcaaatgggactggttatagccgatcgggatggcacgctctatcatggctacgagcctggtctgcacgttgagaacacgaatggcgtcggggcttccatgacggccgcgcttgcctatgctcagttgcgtcatgaatcgctggacgacacgcttgacctgatgatcagaatcggtggactgacgatggccactggcaaaagcgtcagcgatcgggtcgggacgctgctggaaaacgaatgaatcaaatatcagaatcgcgatgaatgctctcaatgactgtcgtgatgctaagggcgctaaaacggcgctcttttttcgtaccatcttgacagcgctttcgcaagaggatagaattggtttatcaacaaaggtttaaccaattaatcttatgtttaagaattagaaagaggtgtcatccgatgagcgagaaaccatacgtagcagtcattggcggcatgaacatggatatcttcggcattcctgatgagaaggtcattccgcgtgattcgaatatcggccagattggcatggcggtcgggggcgttgggcagaacattgctcagaacctggcgcggctggaagtgccaacgtatctgattaccgtttacggcgatgatgtgaacggtatcgtcatggagcattcctgcgctcagcacggcattcggctggactacgctgaaaaactgactggccagcgctcatcgggatatctctatgtcactgacgaaaccggagacatgcttttggggatcaacgacatgaagatctgcgaaaacattacaccggtatttctggcaaagcggctcgactttatcaatcacgcgtccgtgtgcatgatcgatgccaacctgccggaagagtcgatcaagtggcttggtgagcacgtgacggcgccaatctttgttgatccggtgtcaatcgtcaagggcaagcgcgtcattccaattttagacaagatcgacacgctcaagcctaatcgaatcgaagccgagatgatgaccggcattaagatcacggactgcgagacggctcagatcgctgccgccaagctgctggaatacggtgtcaaaaacgtcttcatctcgctgggcaaggacggcatcatggccatgagcaatgaacaatcggcgcacgttccaacgatgaccgccaagatcgtcagtgcaaacggcgcgggggactgcagcacggctacgatcgtctggtgccgctaccggggaatcaagaatcttgaccgagtctgcgaatacacgcaggcagccgcaagcatcgcgctggaaagcgaaaagtcggtacctgacatcacgccggcaaaagtcgaggccaagctggcaggaaagcggcttaacgaacagctgcgctctaaggccgtgagaagctgaatcagcaatcagcgcgtaatctattgaaacgatgactaaacggcctgaaaacgacgctgagaggcaaattttgggctgaatgaaaccaaggaggaacctaagatgattaagcagctctactcaattattcaactggacgaggccattaaaaccatggaagccggtgccgacaatatcggcctggtaccaatgcagatgggcggcgtgcctgctcaccgcgtgccgctgtaccgtgttgaccagattcatgaggaatgtcgtttgcgcggggtcaagatggttctgatcatgctgacaaacgatcccgatgagatgatcgatttggccaagcgcctgcagccagagattctgcacgtggcaggggatggctacacggctgatgaggaattcgccaagcgcttgaaagaagtcgctcctgacactgaactgatgcaggcagtgctggttgacggcgagggagccattgagcgcgccaagaaggttgatccgttcgttgattacattctgctggattctggactggctcctgacacggggattggtgcttccggtcagacgcacgactggaacatcgatgctgaaatcgtcaagtcggtcaacgccaaggtaatcgaagctggcggactgggaccagacaacgtggcggacgcaatcaagaagattcgtccatacggcgtcgactcgctgaccaagacgagtatcaagtacgaccacggcaacatggaaaaagacattccaaaggtcaaggcgttctgcgaggccgctgacaaagccgccgcggagcttggtctgtagaattcaaaacgcgagacgatcaacgcgatccagagtcaggggaggctctgatcgtcatcaatcaagagaatgcgaggggcgtggaatatgaaaatcagaatgcagcagccggtcaaagtcatcgttgaacacgatctggccaaatcaatcatggagattctcaaacgggaggacaaacggcgcgtaatggtggtgcttgatcaatttttgatgggcgtaccagccgtacaggaaatgattgctgagattcagcgaaacagcatggaagtagcaatctacagcgaaatcgtgccagacccgcctgctagcgtcatcaacaagggcgcggaatcaatgaaaaactttggcgcggactgcgtgatcgcaatcggtggtgggagctgcctggacagtgccaagggaatcgacatcgtagccagcaatggcggcggccgcgatatcctcgactacgtaaaagacgaatcgcttatccgtgacttcaagtgcctgatcagcgtgcctaccacggccggtactgggagcgagatgtccaacgcgctcgtggttaccgatgagacgacccatgagaagaacgctatcttatcggaccgcattttgagcgattacgcgctgctgattcctgaactgacgctgagtctgccaaagcgccaaacgattgccagtgggctggacgtcttctcacacgccgcggaaggctacctgtctaatctgagcagtcccgtggccgatgcaatctcagaaaagaacatgttcctgtgtgccaactatctgccaggcgcggttaaagatggtcaaaacatcgagtatcgcgagcggatgatggtagctgccaacttggcgggctggattcttaatcagtctggaaccatcgtggcgcattcagaagctcacattctgggatccaagtatcatttcgtccatggcgaggcggttgcctatgctctgcctgccgtgctagagatgtcggcctctgtactgccgaagaaggtcaaagagattggcaagattctgggcgcggaatttactggggatgaaacgccagacgagattggcgcaatcaccaagcaggcctatctgaagttccgtgacgagcaggtcggactgcacccattttccgactatggcgtctcaaacgaagaattggttaagaacgctgatgaagtgcttcatgaacgatttgccggcaatacatcctttgagctgaccaaggaaaaggttaccgcgctcttgaaacatttcggttaggattgccgctaagttaaaacgagccaggccatgacgagttcatggcttggctttttcatttattttaggacgctcccccaggccggctcacgggtctcctctccggcgggccgcatgtgccatgcttaccgtcgcctcgagtgagccccatgttccgcttacgctccgccggcctgggggatgatgcatatacaccctctgtatatacaggacattctggtcatgtatgagtgcatgtagtcttgaataacatcggtaaatcctttttggtgtaaaaaattctaagactgaaagtgacgaatttggggtcatatctacgatggctagacgatactgattactgccatttataaacttctacaatgtaaatagtaaataatgaattgtaaatagtagattgtgcattgtgaattgtaaaatgtgaacgtaacataaaccgcaatataaaggactttaagtgataatgatataaactcatacaatgtaaatagtgaatagtagatagtggattgtaaataattaattgtgaataataaattatcatcaatgactgagattgataaaaggaggattagaggccatttcaaaatggttgattagggatgcttaatggatgcgaaaaatcttcagaatcttcctttacttttttgagcttgaatcgtttctataaatgtaagtcttaaaaccttaccaaattattcaaaggagatgttcaatcatggaacgtaatttcaagaactcaaaactgtcatttaagatggtcagcgagggtaatgaagatggtatctggcgtagctactcagatgccattgaaaaaccaactgacgatcagatcaacggctgcatcaaggtattgaccgacttgtccaacgaaacgtacttctacggtcgggtagtcaacacgatcgatttgatcaagatgtagtcagaaattatatttgaaaggagatctgaactatgaagacacttgaattgacttttaaaggcagtcttggtggcaagcacgtatttaaggtgcacaatgctaagcaagatctgaaggaagaaactattctgccagtaatgaagtctctggcagcactgaaactgttccagcactctgacgaattcctctacgaacagcctgtgtcagctaagtatgttgacgttcaagaaacggttgtatttgacaactcgccaaaggttaaagagctgccatattaattgattgaatcgggattggcaaaagccagttccgattttttaatgtcagaagacgatccgctgatcataacgggtcgtcttttttgatgaatgaagatcaggtttcgcttgtttttcgatatctttatcggcagacttttgctcatttaataaactccaacaatgtaaataatgaattgtaaatagtaaatagttgattgtgaattgtggaaagtagattgtttacgggtaagatatattgatatatgggtatttatattccattggataaaacttctacaatgtaaataatgaattgtaaatagtagattgtaaattgtgaattgtaaaaagtgaataatccacgataaaagattggttccgggttggttcaacttacactccgctgacttggtttatttgtcataatttcaaaaatttttagagcttttttcatacatagacgcttattgtccggaccggttgataaaatcaaaattgaggtgaagaattatgtatgactatcgaaaagatataattgatattattaagggcactaatcccagcattgaaggcatcgaggcagtccagtcgatcgtgaacctgctgcggcatcagtctggctatcagaatccaatgaacagcgggttgccaagcgaacccgaaagaaatgaagagacgattgagccgcttgaaacggcatccccgtcagacacggcaattgagcagcatgaagcaagcgaggccgttgaagatattcaagaaactgagatggctgaaaatgaagagagcggtcagactgagcaggatgaggcaccagtttctgacgaggataatactgaaaaccaggttgagaagcgcgacgccttaacgctggcccagtatgacgcgatccatatttttaagtcgattatggaaacgaccgccaacgagctgcgcagagtagtcaaggattcagaatatcagccatcgtttggcacgctgaagaagaatctcgaggactgccactataatctgggcgatgaagacaatgcaacgaccaacgcttactatctgatcgcgtcgcagcagctgaaataggcacggcaaacatatcaggacttgctgaacagccaaacgaacgccagtcagctgatcgagcgcctgatcgcgaccggcattgatctggccaataaagccgatgatgcttccaagctgaccgcctttcaagaagcaattgctgaagtgcggatgaaggggctgatcaaagaagaaacggctcaacgatttgacgcgttattaaaggaacagccaagcgcagcggaaaagcagaccgttgaaccagccgaaggacctaaagcggctgacacggtccagactgaagatgaacaggccgaagaacctaaagcggctgacatggtcaatgctgataatgaaccagttgaggagtctgccgagaacgaagctgatacggagcaggtttcgtcaacgcgttccgaaccggaaactgagccatcatttgccgaattgcttgatcaatcgtcagtgtttgatctgaatccaggcgaatacgttgtgcagcgtcgtctgactggggcccaactgttggatgcctatggtcagcaggcattcttcatcagtgagaagatggtccgaatgctgaatctgcaagatggcgatatcgttacggctgatggcgagccttaccagtcattatccaaggcgtatatcaaacgggtcactggccatctggatctggactatgatccgattgaggtattccgtcaagccgtagtcgaaagtaaggatggcgagctggtcgttacccataacatctatggcaagcggctgaaggtcaatggatccaaggttacctatcacgtcaaggatgaccgcattcagttcatggtgcaggagggtgatatcgtggatctggcatggtacgccaacgatgacaacgcccaggacagcatgacgattcgctgggtctacccgcttgaagacgataatcagccggcagaaaaggcaccaaagcagaaagttgcggaaaagaagcccgctaaaaaggaaaagatgcatctcgcgcttggtttaagcaagcagatctttggcagcatgcagcagggggctcaagacgccaagaagctaaaggtggatctgaaagggcaaaaagtcggtatcgcgatcggcaacggtcaaaacggcgagattctgaaagccacggttaaggcctgcaacggggatccccggctgatcaacgcgttcgccggcaagagcaagaagattgaaaaggcggtcaagaatcttgatatggtgatcatgatcaagtcctacgcgaaccatccatcgtcctggtcgcttgctaaggcctgcaagaagtatggcgtcaagtttgccgtaagcaataagatgtcgacgcaatcgttctgccgtgcgctgtatcgggctgaaaacaacctgccgtccgatgagcagagtggtcaggaaatcgagtacccaatgggatagaataagcgattagagaatagaatatttcaactattggaataaaaaattaacgggtgtgcgctatgcatatccgttttttgtatgggccagttgatgcgaacattttacataaggatggctacgtgaagctttattttttgttcaagacatatgtcctcaaaaacgaacaaaaaatccgttatttttatgaaaccgctatcattttaaggaccggtgtcatagaatcaataaatagatttacgtatcatattaagtaatgagagggctttcttaaaagttcctgctgccttgattttagtttccgcctttttatttccgtctttttttttttgttactgctccttccgcccttccgaacattccgagggaccaatgtcggggatgtaaatgaccttggaaaccgggcttgcccatgattaggacctggtaattggttcaaacaagaacacttggtgctttctttccctcccttctcttatagtctttgctttgtttatttctattatcagtccttctctattctggtatccattatctcgcttcattctcgctacctacctaaacaactcgactaaggagattgccgtcgaaaagataaggttgagagccttcttccgcgaactttgttttcccaaccccaacgcccggaacttactacctggccctatttggtaagttttgattatccatttcgcagtttgccatttcctccggctacacccctttacatctttacggcctacgtaaaggttaaagggcgcgcgtgccaaattatgtttcaatggtttcactttatcttgatgattactattacttttatgtcgctgactattctcgctcaccttttggctgataaactgaagatccggagataccggtaatcgtggcggggctgatcattgcgttaggggtacttatcccaaccttactaccaacgccagttgtgcttgcctactcgcgtgtcgttgccggatcgtttcgatgtatactccgttgaccatggccctgaacttgacgtttttgccaaacgagaagactgcgcacggatctaggtttgcttaacaggctcacagtgcggggcaaatctttggtccatcgtagcgcggcctctgccattaacatgggtggctatcttacatcttccctgccgcattcgccttgcggtgtctcggttcgatcctgattgctttattaaaggtattaagtagtttcattgcattcgcaatccaacaaattttaataacactctacaggctcaccaattgatctccttttttcggtaatttatggtgatattgttgggccttttatggtcggacttttaatatatggtagattgtaaaatttaactgaaacttgaaagctgataaccatgtcaaacagcgcggaggttatcagtttttctcgaaaaattaaaaagacaagccctttggaatatactttaaataaccaaaacaagtataaaggggtcttgcacagtgaaagtataactcaaatccaacatgaaccgatattgcggtatgacgtgtcgacctcgtatgtcagctgctcgcgcgaaatggccgtttttccttagccgaacgcattagctccagaacagatctgctgcatggctgagtacaggctgtagcgctccgtccgtttggtaagatgatagacctgttcggaaggtagctgatcatccggttggcaactgctgatcgttattcagccggaggccacgaatcccggttgtcgatctttagcgccgcaccggcgtgatattgatgatcgacgcgctgtaagggccttgttgatcaccacttcctgctcgccaagaacaatccctggccggcagacatccgcactaccgacttggccgtttgccgaatcccgatacaccttgacctcgaccaggcgaccagcagatacgtttcatcatatatattcgccctgccgcagattaaattcgccaatctcaaactcgacgaacgctcagcgctcaatgatttttaagtttgaaatgcgcgttggccatgactttatgaacggctgggtccgagttaatgagccgcgtatatttttcaatgctcatagttct

SEQ ID NO: 701 - DNA, 25052 bp, Unknown
  Metagenome-assembled genome
attgatccgataaagtcggcccgaattctgtggactgattggcaacgtaacccgacacgtgaaacaaggccggccgtaactcaagcccgccaattcccagaccaaagttaacgccaaaatcagcggtttgaagctaagatgcctttgcctgaatcccagtcgcacgttcggatggtgtcggcaatcataatcggagaccagacgatgataattgccgtttccaattgcgtaataaaggaacaccggcaaataaaaccagcagccatgtcccatacactcggcagcaatatcgcctgcccgttaaagcaatcaatatcccatggaacatttttttctcttactttgtgatcggttcagtcgaataaatcattaacacgccaattaacgccgccaaggcaagccatttgccccggaacaagaccttcacgccaagggtatacgtgaagataatggtcgtttgattcttagatagccgtgaccagccaatacataaagatcacaatcgacaggattaatccacggctggttgtgggctaactgttcaaaccaacttgacggttggtgggcaatgtgtggttggagaagcgtcaagcaagggcacgaaggttgagaatcaaaacagtggaaatgattccaacacgagaatcggttcccaggaaacccctctgctgagttgccgtggccgaatagccaaaccaaaggccagtgtgaaaaagtgcaccgatgagttggactgaatgccaagaactggcggataacccaagcagtgtcagctccggtattctgtgacatcgtcgcagaattgatgtgattgcagattaacgcggtgtataagcaccccagaccaagataggtcacgtaagcccaaatcattgtgccgccataggagaaattcgggtggacaaacgtcagaatcgcaaaggccagaaggcaccgaataccaaagaaagacggccgactcttaccaaattattgaatgggtgtggttcatcatgataccgatgatcaaactttcgacgacgtcagctaactaggcggaccacaaccaagatggcggaccgcactggttgtcaaactagacatcggttgtaaaaaaacagcaaatatcgtcatcatttgaaaactcaggttgtccgcgcatcgcttaacccatagcgatacgtttcaggccacctggttgaccattcagcactagacttcagattgtcacgcctttcgtagggattaaaaaaatctaactaatgtacgcacttcgcttttccaacaaaatcaaagcacgttaaaaattgaatgaagaaaaaaggggaaaagccctgctcgcctacaggactttctacagacgctgtccaaatctatgatttttgatatacttctatgtaaaaagggagtttaagctatgaaaaattacccagcaatattactcggcaaccatttgaataattcgaccagcttagaaaattttgcgtaaggcgaactaagcctcgaaaatatgacctctacgaggtcttctgtgcggtcctatatgtattgaaaaaccggttgccaatggagcagtccccggtggatttcccagaatggcggtcagctacaactattactaaaattgagtcaacaaagctgagcctacggctgattctttattgggaaccaagttttaaaaaaatggtcattggctcggcgaacttaccaagacgttcagctttaactcctttattatcgttgacgctcagagcgtcaaaaaacccgctactgctgaaaaccaaggtacgacgtggtaagaaatctcggggattaagagccatctggagttgatatcaaggctttccggggacattcacatgacgcgagagaaagtctctgatcgagacggggccagtgcaatggaaaaaaaatcgtttacatgccatgcatttacgccaggttcaaaatggctgtcctgatggtggtgattaaggaggttaatttcagctcgatggccagtaatgtaaacgcaaccgtgcaggttgcgcaagccgcaatgcgttgcatcgattcgaagtcatgcaccaacggggttagtcaacgattcttttagaaaaaaataaaattggctagagaattgtcggcgactttggaaaaatgtgaggtcaattaacaatcagtcatgcaaatggtcgtttttagcgtttagcactatactaagaagattttagacagcttcgtagcatcagaaatatggagctcatctgagcaatattagtttttttttttttttttcccaaaattcaaaggtaattaacaggggacatttaatgaactattgttctggaaaagtgataattcatatgttgaggaggaagagatttaatatgggaacattgcgaaaagaaacggtatttataattttgaattattatatccttttggctccggtgccatttattcgatttgtgcagtatgaaaaacttgcctaccgattgcaagcataaatccaaaaagcccggacagcagccggagaaggaacggcagattgtttggaccaacaaataaatctaccgtttcctcattttgatcttatatacgatttatatggtttctatccaaatcaattgaatcgagcatggcttcaatggaatgattgagtaaatgcataactagatcaatattataatagattgtgtacggaagcgataagtgcccgttttacggatcgtagagtccctaggttaatttattcctaacagagcgtgacttttctcgtgatttggtagaaactgtttttctgtgatatgggacgttctgggtttatgaaggaaggaagaagccattcagatgctagtttatgatcaagcgcattgacggtacaatagagctttgttgaaaggtttaaggtacaagggtattaggattatcctttcgatcggaatgaacgcattttgtaatagaaccgtctggattaaaatctcggtatttaagcgcataacattactcactctcaagatagagtaggccttaccaacttgaaaacatcgtatagttccgccggtgaagctttaaagttattggaaagtatcttgaacctctttaagaacgtttgaatctttgatgggtaagacaacttgttgtatgagtatggctcctttgatcttaaaattagtttgtgcgaaaaagccaaaaataaaaatataatgtaatactatagtaaaccaaatggagggattacgagagtactagtattataaaaaaaacagtatcaaccgcgtcaactgattcagtgaacgtgccaatctatttagcaaaacaaggattaactgtttctgagtatattccttatccttggttaaggcggctaacaatgaagttcgtttaatagttttttagattctccagaggcttgactgctaaaaagaaggaaaagtggtcaggtgaaaacattggctcactggccgactttgatgattggatcgataagttagatgcaaattaaacagaccaaatcttttgaacgtgaattaaaaaactagtcaaaaaacattttccataactgtctgaaaccttgtaaaagcaattatggaacaagataacttctttgaaacggatcaaagatcatgcgtaaagggtaaatgggcgtgctatcgtgaatttcaccctgctaggtatggaagccatggtaaaaaatatgatagctggattgttatttatcagctgatcataatgaattagttgttgttggtagccacttggtctcatgaaaagattgatcaatagctgaatttgggcgtctttttatttgaaataagcataaacaacccccgatatctaccatcatagatattgggggttattctttcaatgttttcgaggggttattgtatataaaccttcattattattgaaattcaaattctgtaattcgtcaataatttaagtgtttgaagtcttttataatcatggatagtaagatgtttaaatataggggagcatccgtttttctgatttagtattggttttcacttatattgccaatatctattcaatagctgattaccgtttaccatggatttgtacgctgattagaaatatttttaattataaagcctcataagttcagcccgaaaacaaacatattgttgacgctttgcataagggcatgcactatcattcaaagaaacatggtgttcctatatttcatgaagataataaatatactaaaaattatacttttttgttacagccgactgtaaggaaaaaagtaggtgtccttgctaaggaacatatttcaaatcgctttagttttttaaatgaaactgctgaaaaatatatgctgtatgcacgttgaactactctctttttttgaattacctaattagaataacaaggcgattgaaatgaaccaaaaaaattagccgtttatcctaattcttcggtgttataccgtaagtaattttcaatctgaggactaagtcctcaaaactagtaaaacgtgtttgaaaaataaattctcgtttaagtagcgaatggaaagcttcgagcggaccgttactatggataaaccttgtttggaatatgaatgctaatcaggtgccgctttaacaggccttcataagcaatactggtgattgtggaacccatatcagagtgcaaaaaggttggcttagaagccctgctcaaggcttgcaacaatgtcttaatatcagtttcgatgccatcttcctcgccaatgttgaaagcgatgatgtgtatagcttggtcaaagatggtacttagataagcccaagtgcctggtcttagttctaggtaggttagtccgcacgccaaatagttccaattggatggttcttaatcaagttaggccgttgagaataatctacatgagtgactggcttcttaaaacgccgcccatagtgatcgaatgcctaactcctgcattaatcggtagacacgattggggccaatgaatacaccaagtcttctcatggcaattgtgatccgaggtacccataggcttataaattatttttccaaatttcaaagatctggctttttaaaatcgtatttgttatcatgatgacttatctgataggtttccaatgataatacgtacttttagaaagccctaaggcgtttcaagattatcagaggcggtgtttacatattgttcgttgtataaagtctatggctttaactttgcctaatgcctcccagtaacaccgccggcttttaaaattcattttttctttaactggttttctttctgtagttgcttgaaggcttcaacacgtcaggtagtgtcaactaatttggcccgcttgatccaatgactgatggtggttggatgaaccccatattcattggctaaggattctttgaacgatttcattgtgataaagctaacgatgtgttttaaattcatctgataatatttcaaaaaagctcctattctgattttcatcatcatgacacaaaatctaatgattttggtaccaaattcagtataggagcagattgaatatatcagaacaattatcttgatcacaaaatgtaagatatatactgatggagttaattgttatggatcgatatctttactttgagaactttgtatatcatgtagacaatcaaaataatataattctattaggtataggtagaacggtaggccactataaaaatcaacaagattagaatgagtttgatactgtcttgccaatcaggaattggttcatgctctattcataaaaaatcatcagttcatcggttgaacctgtccataacagaaaataaacattttacagttagctcattaattaagtgaatacaaggaattgcgtgactttttagacagttgctaagtagagaaacgctaagttggctttaaattaggagatgggggattcatgagtcgatcaatacagagcttcagacaagtaaaaaagaccgcggcggttaaagctgcagatttgttaacagacgatatgattgtggccttggaagtggcctcaacggttacaatgctggtcgatgagttgggacgacaggttaggaagaaggcttgaaatttacgggcgtttccacgtcaatttcacagcgaagcaggctaaatcatgggaataaaaattgttgattggattcgattgacacaattgatttaaccattgatggtgccgaccagttgacagtgatttcaacggtattaaaggcggtggtggaaacctgctttgggaaaaaattgtggctgccaattctaaaaagcttgttggatcgtagacaatcccaagttgttgaccgaattggtgctttccactagctgtgacgtaggagcctttcggcgtcatcatgttttgaaaaattttccgatgccgggttcatccggttgtcaggactgataaggacggcaaggtctttaaaaacggattcaaataacatcattttggatctcacctgcatgaaattaacaatcccgataaactggccgataattaattaataccgtggcgtgtgaacatgggtgtttaaaagcggttaatgaagtggttgtaggcaaagaaggagccctcaaaatctgattattctaaagtccatccatcttatcaataaaatggtcacgtcttgattactcatattaaattagtcggttagaggagccatataactgtggttctgaccgttgtcaatcaaaatcctattaaactaatctttaagactggttcaataggattttgggttgcaataaatcacataataaaatggttataagaacaattatgagttgtagccatattattcgatgacgggacttgattatccgggcaacctcgatcgttatgataaaagtcgaaataataaaatgagattgacgacaactccgcaaatgagcagaatgaatccataaacagtgatcccattaagtttatgactcaaattcgcttttttacatagaagtgtgccctgtcaagagatcttagtgtttcaagatactaatggcattactattgtcaagcaaagcttgctttactttttcacttatagtgtttttgtgatctgttttttcagattccatgtaaatcaactcctggattgttacataataagccaattaacacaaaaacattgcgcctcgttatcaatttagtgttatacattaaaaagccaaatcttttcacctaacacataaatgagttcttagcttcttcggcacgatacttttcaatccgatataagttaccggtgcaatcccaacatccgcgcaatctgccgtttggttaattcctctccctgttcccgtcgctagcaaacgaccgcttctttaaataaagcgtttctgacgacggtgaatgtgggcatatcacgaacttaacatgatatttccctgccgttagcaatttcaatcccttgtagctgttcttacattgattgtcctcacgttctcttgggcatatattataaagctcaataatgatattggtaatcaagttacgtaaggttagggttttcaatacattaaaagctcggtaaatttaaaatgtttaaggtggccccctatggcgaatggcttcatatttctgttaaacggctgaatgcttgttaaaaaaaacctaaccgatctaacacttaagacacttaccttcatcatcgtcacgaatgataattcagctggcttgaagttgtgggcgggagcatttttttcagaaagtttctcttgaaaaatttttgttaatcagctgcttgtagttgtcaatttgccgggctagatttgctcaagagtactaacacgtgcgtaaaccaatttttgtcgttttcagaacgctccggaacacgtatatgtaataaataataatccaactttcgattgaaccaatagggtagggctagtaaacatcgtgctatcaacagacgcaaagggcccgctcataggtgtggtgatggcagccaaattacgcatattttacgagataaatttggtacacttagggtacgatgtatatataagcggcttggtttaatcaataaaatctattccgttgagaagagacttatcgtttaacaagattttcggcaaaagtagcttaattgacgttacctccttaagtttatcttggtaaataaaaaagcaaaaaatattttacgtagttttttggaggccttagctgattaactcagtgtattaacagaatggaggaatgttatggcataaactcatcatatccgaaaacagttattaacggcatcatggaataagaacattattttagtcttaaaagttatcaatggcgggttcgccatcacaaaaccatgggcgaaaaagaatcttgcgattggtcactagcttgggtagaagtgactgggccaggttaaaccgcgtttttgtggatcattaccgggattcacaagttaaccgggctgctgatcgccaagtcgcacggacaattaaagaccgtcagacgattacaactaactcagttaaagatttggacgccatcactcagaataaatttgagcaatactggccacccacccccagggagaccctttttcaaacctcagcaataaagcaatcgctaaaattatagctagtggagcaaggagtcattgctgactaatcatgtgatttcacatgaaaaaggactttttcttattgggaatgtatttgcacttgcgaagtataatgtaagcggatacaaaaagaaaatggaggcagcttattatggcagaaaaagtagcgttggtacagcgcgcgtcaaggggaattggtgaagcaattgcaacaaggttacacgaaggtggctttaagtagcagttgcggatttgaatatcgataatgcaaataaggtagccgctaaaatatcgccggatggcgtcaggccattggcgtttaaggtagatgttgcaagatcgtgattctgtctttctgctgttaatggaaaactgggattaaattggcggctttgactgattgtctaatgcaggcctttggacaccacacctttggataccattccaccggatcaatccgactcgtatacggcgtaacgggtggcgttcttggggtgctcaggccgctcaatcaatgccttcaagaaattaggacacggcggaagattatcaatgccaaaacttcacaagccgtgttgttgggaatcctaaacctggccctttattcaggaaccaattttgcagttcgtgggatcactcaagtgttgctcgtgatgtggggctgaagaaggtttacggccaatgcttagcaccaggtattgttacggacaccgatgctgtttgatattgcactccagttggtaagaatgccggtaaagacgatgagtgggggcatgcaacaattcgcaaagatattgctttgaaacggttctcaagcccgaagatgtggcccgctgccgtctcattactggctggtaaagattctaattatattaccggcacagacaatcattgttgaggcgaatgcagttcattaatgaactaaagggtttaaataataatttgtccatggcgtttgttaaggaccagaccgatgattatcggcctgggtcttttgtaatggagatttagcacataaaatggttattcgccatttagcagtgaacatataaagatatacttaaattggttaaacccgctgaaaaaactgtaaatttaccaataataagcaagaacgagttagtcggagagcgaaaatcttgtgtaaatgcataaaggatttatgaagtgtatagaaataggatgccttcccttagaagctgccaagatctatgatgtttgatattctatgttaaaaagcgagtttaaagccatgaaaaattatcccagcaatattacacaggcaaacaattgaatattcaaccagcattgaaaattttcgaagtgaacccagcctcgaaaatatgaccttaagagatcttctgtgcggtcttgtatgcctctgaaaaaccggttgcaaacgacgtaagtcccagtgatttccaggaatggcggtcagtttaacctattaccaaaattggtcaactaagcttagcccaaccgactgattctctatgggaacagtttaaaaaattgtcatgctcggcaaaacttaccaaggggacgttcagctttatctttgacgctctgagcgtcaaaaacaaccgcgactgctgaaagcaaaggtaagacgctgtaataaaaaactcggattaagcgccatctggcagttgatatcaatggcttttccataggccattcacaggacgcgaagcgaacgtctctgatcgagacggggccagtgcaatgaacgctttacataccatgcattacgccaggttccaaaagtcttagttgatggtggttattaggcgtaattcagctcgatgtagccagtatttaaacgcaaccgtgcaggtgcgaagcgcaatgagttgcatcgattcgaagtcatgccccaacgttgggtagtcgaaacgaactttagttggcagagaattgtcggcgactttggaaaaattgtgagcgtcaattaaccaccgtctgcagaaggcgttttagcgtttttagcacattacttaagagattgtagacagcttcttagagtgacggttctcatgttcagaaaattatgtgtagcatacaaatgttttgatatttatgcgataaagagggagaaagaaagggggacaaaagggggagggggggtagcactgccgcccacacggcgggagccttctcccccctatctttcaccctcctctcctcttctccacgcgtaatgtaaatactgtgatcataataaactttgtgcagacatgatttaaatatggcgccatcttgaatgcacctaccatggtcggcttactgtgtaggaatgaccgaaagcactaaaactaaactataaactgaacgaatcgtatctgaaggaggacatgttcagatgaaaaagtattctcgttgtcgatgatgaaaacaccaatactgatattgtaaaattgaacctaactaaaggaaggtacgaagtggtcgtcgccaggatggtgaagaagcacttaaacaagttgaagaagttaatccagatttgatattctagattaatgttacctaagacgatgggctggacgtttgcccgtcaggtacggatgaagctgctatgccaatcattatggttaactgcaaagaatctgagttagataaggttttgggattggaactttggtggatgactatgtcactaagccatttcaaaccgggttaacatggtgctaggtttaaggcggaatttgagtcgaaaaactaccggtaagcagctcagctgaagaggagaaaataagatatcgaatggcgatctggtaatcatccggatgctttcggtgacaaaacgtggtcaaaaattgaattaactcaccgtgaatttgaggtaatgcatttattagcacagcctattggccaagtaatgactcgtgaaacacttacttcgtacggtgtggggttacgattattttggtgatgtgcgaacagtcgatggtactgtgcgtcgacacgtgaaaaggatgaacgatagtccaggcacacccaacttggttagttactcgttggggttggttattattacgaaaatactgaaagtgagtagggtcaggcgaatattacgcgggcaaggcgtttaaggggtaaacggtagcgtgaaaacgaaaaaataaatggtatcattcgatacaattcaaaaatcagttcgtattcgcgatgagctcatgattacatggaaattgtcggcgccgtttttgtacagcagtggaaacgcagaatttgcgggcaattaagagccaaatttcactgagcgctacgtcagtacgaactaacgacccagctgtcacgatcaaatacaaacgcttctacaggacagattcgcattcttccggtctgatgcaaaaattcctaggcacggcgaatgacaaaatccttttattgataataaaggcaccattcgggaacaaatgaggccaatacatcaaaccgatcgtgggcaaaaacgacggaagacaccgttaaaaggtcatttataaataacagtgccggaagtgaaacaacgacgttttgattcgtcggacaaattcaatatattacactaaggtcacaccactgatgaacaaagcagcggaagcagtgacttccgttggcgttgtgtacattcggcaaacatgggcaaggtctaggacagtattagtaagttactgccatataccttgttgcgcagtaattgcgagtatctgggacttgtttatcaatcgtattcccggggcaattttaccagtagcaacaaggtatatggcagtaactttactaatactgtcatagacacttgccaggtttgcacgaatgtacacaacgccaacggaagtactgctgccgcttgctttgttcctaaacgcagggccatgtcgatgctagggacgtggtgtgaccttagtgtaataatatgatttgtcgacgaatccaaaaaacgtcgttgtttccacttccggcactgttatttataaaagaccttttttaacggtgtcgtccgtcgttttttgcccaacgattctgttgctttatggcctcattgttccccgaatggtgcctttattatcaatacaagatttgtgcattcgcaccgtgctaggaattttgcatcagacagaagaatgcgactctgtctgttagaagcgtttgtatttgatcgtgacagcgggtcgttaagttcgtacggagtagcgctgccagtgaaaatttggctcttaaattgccgcaaaagtatgcgtttccagctgccatgtacaaaaacggcgccgacaattttccaatgtgtaataatgagcatcatcgcgaatacgaaacgcgattttgaattgtatcgaatgataccatttaattttcgttttcacgctacgttaccccttaaacgcctgcacgcgtaatctacgcctgacccgactcactttcagtatttcgaaataataaaccaaccccacgacgaggaaactaacaaagttggggtgatggactatcttcaatctttcacgtagtgccgcacagtaacatcgatctgttagcacatcaccaaaataatcgaaccccaccaccgtctgaacgtaagtgtgtcacgagtcattactgcgcccaatatgctgggctaaggaatgcagtaactcaaattccacgggaggtaattcaatatttttgaccacgtttgtcaccgagaaatagcatccggatgaagttaccagctcgccaatcgatatacttatttcttcctcttcaggcggagctgcgttaacggtatattttgtcgacgcaattgcccttaactctagcaaacagttcacggttgaaaatggcttaggaaatagtcatccgcaccaagttccagcccaaaaccttatcaactcagattcttgcagttacataatgattggcatatcatgctgcatccgtacctgacgggcaacttccagcccatcgatttaggtaacattaaatctagaatgatcaaatctggattaactcttcaacttgtttaagtgcttttcaccatcatgggggacgaccacttcgtatctccttctttagttaggttaaatttttcaatatcagtaattggtttttcatatcgacaacgagaataacttttttcatctgaacatgcctcccttcagataaaacgatcgttcaaagtattatagttttagttaggtgctttcggtcattcctacactagtagcacgagccaatgtaggggcattcaagtagtggcagcctatttaaatcatgtcgcacaaagtttatttatatcacagtattttcactacatacgcgaaatggtgaaaactgggatgtagcagcattgatcgcataattaaatagcaaacatttgtatgcacaagtaatttcttgaattgaagatactctcactctacgaagctgtctaaaatctcttaaagtaatagtgctaaaaacgctttataaaacgaccatttgcagactggtggattaatttgtacgctcacaatttttcaaagcggccgacaattatctatccccaactaaaagatcggtcgactaccaacgttggggctgattgaatcgattgcaaaactcattgaggctttcgcaccgcccggttggttttaaatttacctggctacacgagctgaaaataaacgcctgaataaccaccatcaactaagacattttgaacctggccgtaaagcatggtatgtaaagcgattcattgcactggccacgtctcgatcagagacgtcgctcggtcatgtgacggcctatggaaagccattgatatccaactgccagatggcgcttaatccccgagattttcttaccgctcgtaaacctttgctttcagcagtagcggtgtttttatgacgctcagagcgtcaaagataagtgaacgtcctgaagtttggccgagcaatgacaatttttttaaaactgttcccctagagaatcaagcggtgtgggcttcgctttagtgaccaaattttgtaataggtgtaaaatgaccgcaattctgggaaaatcaaactgggacttaacggtcgtttggacaacggttcaaggagacaagacagcacagaagatctcgtctaaaggtcatattttcgaggctgggttcacttgcgaaatttctaatgctggttgataattcaatattgttgacgggttaatattgctgggcataatttttcaatggcttaaactcgctttttttacatagaagtatatcaaaaatcatagatcttgggacagcttctaagggaaggcatttcctatttctatacaatcaggaaacctttatgcatttacacagaattttacgctctccgaactaactcgtcttggcgttattattggctaaatttacagttttttcagcgggtttttaaaacaaatttaagataatctttatatgttaactggctaaaatggcgaagaaagaaaccatgttcgggctaaatctcagaagtacaaaaggacccaggccgataatcatcggtctgggcttccttaacaaacgccatgacaaattatgatttaaaaacccttagttaattttaatggaacgctgccgccatcaacaatgatgtatggccgggaagataattagaatctttacagccaggaatagacggcaagcggccacatcgtcggctctgataccgttcaaagcaatatcttttgcgaattgttgcatgccccactcatccgtctgaccggaattcttaccaattgatgtgcaatatcaaacatcatcggtagtgtcttaacaatactggttcataaagcttggccgtaattaccttcttcagccaaatcacgagcacagcacttgagtgatcccacgaactgcaaaatttggtttcctgaataaaggggccaggtaggattccaacaacacaggcttgtgaagggcattgagaatctaccgcggtctaatcttgaaggctatgatgagcggcctgagcaccacagagaaacgcaccaacgttaacgccgtatacgagtcggaattgatccgggtaatggtatccaaaggttttgtggttggtccaggccttgcattagtgacaatcacgtcaaagccgcccaatttatccacagtttcatattaaaagcgaaagaccagaatcacgatctgacaacatctaccttaacgccaatgcctcttgactgccatcagggcgataatttagcggctaccttattgcatatcggatattcaaatccgcaactgcccgtacacctctaaaagccatcttcgtgtaaacgtgttgcaattggtcaccaattcatggaccgcgcctgtaaccaacgctatttttctgccataataaggcctaatttttctttgttgtatcgcttacattataattcgcaagcaaataattcacccaataagaaaaaggcctttcatgtgatcacatttgatatagtcagcaagctttcccttgctcaacagctaatattgttagcgattgcttagtgcttgaggtgatacaaagggtctccctggggtgtgggtggccaaacgtattgctcaaagtttattctgagtgatgctgtccaacatctttaagctgatggtagtttgatgtcgtcttgccggtctttttaattgtgtgcgacttggcggatcagcagcctcggtaacttgtgaatcccggtaatgatcactaaaaccggtttaaacctgggcagtcacttctacccaagctaattgacaatcgcaagattctttttcccatggttttgtgatggcgaacccgccttgaacttaacgacttagaataatgattcttattcacatgatgccgttaataaccgtttagatatgatgaggttgatgccattaaaaattcctccattctgttaattaaaccaacttagagttaatagctaaggccttctaaaaaactacgaaaatatttttgcttttttatttaccaagaaaaacttaaggaggtaaggacttcaattaaggactttgccgaaaatattgttaacggattaaagagtctcttccaacggaagagattgtattgattaaccaggccgctatattatacatcgtacacctaagtgttacaaaattatcatcggtaaaatatgcgtattggctgcccatcaccctatgagagggccctttgcgtcgttgatagccaagatgttttttaactaggccccctaccctattgtattcaatcgaaagtggattattatgaagttacatatacgtgtccggaggggaggcgttctgaagaaaacgacaaaaatttggtaccgccactgtgagtactcgtgagcaaaatctagcccgggcaaattgaacaaataagcagctggagtaacaaaattttttcaagcgaaactttctggaaaaaatgcttgcccgccccaaaaacttcaagccatgatagaattatcttcatggacgatgatagggaatgttaagtttagatcggttaggtaagaaattcagccgatttaacggaatctatggaagccatcgccataagggggccacttaaaaacattttaaatttacgagcgttaatgtattgaaaaccctaaactagtaactgaacaatatcagtatgagctttataaatatatggcccaagaagaaacgtgagacaatcaaggtaagggacagcgacaaagggattgaaatgctaaacggcagggacaaatcataatggtaaagttcgtgaatatggaccacattcaccgaacgtcagaaaacgcttattataaagaagcctgtcgtttgataacgcggacgggaaaacagggaggaggaattaaccaaacggcaatgcgcggatgtgggaattgcaccggtaactttatatcggattgaaaagatcgtggccgaagaaagctagaactcatttatgttgttagtgtgaaagagtttggcttttaatgtaatacaactaaattgataacgaggcgcaatgtttgtgtgttaaattagcttattatgtaacaatacaggagttgctttcatggaatctgagaaaaaaacaagattaaacaaaaaaaacactataagtgaaaagtaaagcaagctttgctggacaatagtaagccattagaatcttgaaaacgggactaagattctttgacagggcaaactcatgtaaaaaagcgaatttgagtcataaaaaattaatgggtatcaactgattatggattcagttctgctcatttgcggagttgtcgttccaatatcatttttaattatttctacttttattataacgatcgagggtgcccggataatttcaagtcccgttgcatcgaaataatatgggctaaactcaatacttgatctataacacatttattaggtgattattgccaccaaaaatcctattgaaccagtcttaaagctttagtttaatagattttatgattgaacggtcaagaaacacacagttatatggctcctcaacgactaatttaatatgagtaatcaagaacgtgacattttattgataagatggatggacttagaattaatcagaatttgaggcgctccttctttgcctaccaaaaaccttcattaacgcatttaaaacaagccattgttcaaccacgccaaacgggttattaattaatgtatcggccagtttatcgggattgttaatttcatgcaggtgaagatccaaatgatttttttttttttttttgggttttttttttatttgaatccgttttaagaccttgccgccttctcagtcctgacaaccggattgaaccggcacgggaaattttcaaaacatgattgaatgccgaaaggctctacgttcaacagctagtggaaaggcaccaattcggtcacaacgtggattgtctacgattccaaacaagcttttagaattggcaggccacaaattttgtcccaaagcaggtttccaccacaagcctttataccgtgaaatcactgtcacctggtcggcaccatcatatgttaaataaatgtgtcaatcgaatccaaaatcacaattttattcccaatgatttagcctgcttcgctgtgaaattgacgtggaaaagctccgtaaatttcaaaccttcttcctgaacctgtcgccccccaaatcctcgaccagcattgtaaccgttgagccgacttccaaggcaaacaatcaatcgtctaaacattaatctgcagctttaaccgccgcggttctttttaacttgtctgaagctctgtatgatcgtactcctgaagctcccatctccttaatttttaaagccaacttagcgtttctctacttagcaactgtctaaaaggcacggcaattccttgtattacttaattaatgagctctaactgtaaaataagttatttatgttgatggaccggttcaaccgatgaatgatgatttttgatgaataagcatgaaccaattcctgattggcaaggacagtatcaaaatcagtctaatcttgtgattttttatgtggatacccgttctacctatacctaataggaatttatatgattttgagtgtatacagatatacaaagttattcaaagtaaaagatatcgataaataacaattaactccaatcagtattatatcttacacttttgtatcaagataagtgttctgatatattcaatctgtcctatactgaaaagttggtaccaaatcattagattttgtgtcattgctgatgaaaatcagaaatcggagcctgtttatggaaatattattcagagaatttaaaaaaaaacaaatcgtaagctttcgcaccaatgcaaatcgttcaaaagaacatacttagccaatgaatatgggggtttcaccaaccaccatcagtaattggaatcaagcgggccaaaattagttgaaaactaccatgacagtgttgaacttcaagcacacagaacgaaaacagcagttaacaaaagaagaaatgaattttaaagcagcggcggtgttactgggaaggcattaggcaaagtttaaagcatagactttcaacgaacaattatgtaaaaaccaccctctggtaatcttgaagccttagggactttctaaaaagtagtattatcattggaaaaactatcagacgataagtcatcaggataaacaagatacgattttaaaaagccagatcttttgaaaatttggaaaaaataatataaagcctatgggtaccctcggatcacaatggccatgagagacttgggtttttgtagtcattggcccccaatcggttttaccgatgatgccggagttaggtattcgatcactaatggggcgggtcgttttaaggaagcagtcacgcatgtagattatttctcaacggcctaacttgataagaaccatccaattggaatatttggcgtgctgcgtgctgaccacacaacctactagaactaagccaggcacttgggcttatctaagtacatctttgaccaagctagtaagcaaatcatcgctttcaacattggcgaggagatggcatcgaaatgattattaagacattgttgcaagccttgagcagggcttcaagccaaacctttttgaacttgatatgggttcacaatacacagtattgcttctgaaggctgtttttaagttaaagctggccacctgataggcacattcatattccaaacaaggttatccattgataaacggtcgctcgaagctttccatcgcttcgctacttaaacgagaatttatttttcaaacacgttttactagttttgaggacttagtcctcagagttgaaaattacattaactggtataacaccgaaagaattaggataaacggctaatttttttggttcatttcaatcgcctttgttattctaaattaggtaaattcagaaaaagagagtagttcaacgtgcatacagcatatatttttcagcagttcatttaaaaaactagaagcggatttgaaattatgttccttagcaaggacacctaacttttttccttacagtcggctgtaacaaaaaagtataatttttagtatatttattatcttcatgaaatataggaacaaccaatgtttctttgaatgatagtgcatgctccttatgcaaagcgtcaacaatatgtttgttttcgggctgaacttatgaggctttataattaaaaatatttctaatcaagcgtacaaatacatggtaaacggtaaatcagctattgaatagattattggcaatattaagtgaaaaccaatactaaatcagaaaaaacggatgctcctaactatattttaaacatcttactatccatgattatagtaagacttcaaacacttaaattaattgacgaattaacagaatttgaatttcaataataattgaagggttataatatacaaataacccctcgaaaacattgaaagaataacccccaatatctatgatgtagatatcgggggttgtttatgcttatttcaaataaaaagacgcccaaattcagctattgattcaatatttcatgagacccagtggctaccaacaacaaaactaattcattatgatctagctgataaataacaatccagctatcatattttttaccatggcttccatacctagcagggtgaaattcacgatagccacgccatttaccctttaacgcatgatctttgatccgtttcaaaagaagtgtatcttgttccataattgcttttaaacaaggtttcaagacagttattggaaaatgttttttgactagtttttttaattcacgttcaaaagatttggtctgtttaatttgcatctaacttatcgatccaatcatcaaagtcggccagtgagccaatgtttttcacctgaccagtttctgcttcttttttagcagtcaaagcctctggagaatctaaaaagctaattaaacgaacttcattgttagccgccttaaccaaggataagcgaatatactcagaaacagttaatccttgttttgctaaattagatttggcacgttcactgatatcagaagtgacgcgtgttgatactgttttatttttaataatactagtactcatcgtaatccctccaatttggtttactatagtattacattatattttatttttggctttttcgcaacaaactaattttaagataaaggagcctataactcatacaacaagttgtcttacccatcaaagattcaaacgttcttaaagaggttcaagatactttactcaataactttaaagctgaccggcgtaactatacgatttttcaagttggtaaggctactctactgagagtgagtaatgttatgcgcttaaaacagaccgatatttttaatccagacggttctattaaacaaaatgcgttcattcacgatcgaaaaacggataagcctaataccttgtaccttaaacctgttcaaacaaagctcttattgtaccgtcaatggctgcttgatcataaactagcatctgaatggctctttccttccattcagaacccagaacgtcatatcacagaaaaacagttctacaaaatcacgagaaaagtcgacgctctgttaggaataaattacctagggactcatacgatccgtaaaacgggcacttatcgcgtccgtacacaatctaattataatattgatctagttatgcatttactcaatcattccagtgaagccatgctcgatcaaattgattttggatagaaaaccatataaatcgtatataagatcaaaatagaaggaacggtagattatttgttgtccaaacaatctgccgttccttcttccggctgctgccggagctttttggattgagcttgcaattcggtaggcaatgttttttcattaactgccaaaatagaaataaatggcaccgagagccaaaaggataataataattcctaaaattataaataacgtttctttccaatgttccatattaaatctctcctctcaacatatgattatcagcttttccaagaacaatagttcattaaatgtcccctgtgtaattaccttgaatggaaaaactaatattgctcagatgagctccatattttctgatgctaagaagctgtctaaaatctcttaagtaatagtgctaaaaacgctaaaacgaccatttgcagactgatggttaattgacgctcacaatttttccaaagtcgccgacaattctctagccaactaaaagatcgttcgactacccaacgttggggcatgacttcgaatcgatgcaacttgttcaatggtttgttttttttgtttggttggggccgcgtcggcaacctgcccggcttgcgtttaaattaactcttttttttaggggaaaaaggggggaagggtgggatataattgagaggggggggggggggggggggaagaaaaggaggggggggatggggggagggggggggggggggaggggggaaaaaaactgtaataataaaaagttatttttgtaatgttgtataataatggctccatcgagctgaaaattaacgcctgaataaccaccatcaactaagacattttgaacctggcgtaaatgcatggcatgtaaagcgatcattgcactggcccgtctcgatcagagacgttcgctcgcgtcatgtgaatggccgcggaaagccattgatatcaactgccagatggcgcttaatcccgagattttctaccagcgtcgtaacctttgttttcagcagtagcggtgttttgacgctctgagcgtcaacgataataaaggaagttaaagctgaacgtccttggtaagttcgccgagcaatgacaatttttttaaaacttgttccaataaagaatcagccgtaggctcagctttagtgaccaaatttgtaatagttgtaaactggaccgccattctggggaaatcaccggggacttgacgcattggcaaccggttttcaagacatataggacccgcacagagacctcgtagaggtcatattttcgaggcttagttcgcttacgaaaattttctaaagctggtcgaattaattcaaattgttgccgagtaatattgctgggataatttttcatagcttaaactccctttttacatagaagtatatcaaaaatcatagatcttggacagcttcttagaaagtcctgtatgcgagcagggctttctttttgtcttcattcaaatttttaacgtgcatttgattgttgggaaaagcgaagttgcgtacaattagtttagatgttttaattcctaacgaaaggcggtgacaatcttgaagtcgagtgctgaatggtcaaccaggtggcctgaacggatcagctatgggttaagcgatgccgctgacaacctgatttttcaaatgatgacgacttatttgctgtttttttacaccgatgtctatggtttgacacccagtgcggtcgccatcttgtttgtggtcgcccgagtagctgacgtcgtcgaaagttttatcatcggtatcatgattgaccacacccattcaagatttggtaagagtcggccgttctttctgtggtattcggtgccttacgtggcctttgcgattctgacgtttgtcacaccgaatttctcctatggcggcaaaatgatttgggcttacgtgacctatcttggtctggggttcttatacaccgccgttaatctgccaatcacatcaattctgccgacgatgtcacagaatactcgtgagctgacactgcttggggttatccgccagttctttggcagttcagtccaaatcatcgtggcagttttcacactgcctttggtttggctattcggccacggcaaccagcagaaggggtttctgggaacgattatcgtgtttggaatcatttcactgtttttgattctcaacaccttcgtgcacgtgcgtgaacgcttctccaatccacacattgcccaccaaccggtcaaggttgttttgaacatgttagcccacaaccagccgtggattatcatgtcgattgtgatctttatgtattggctggtcacggcgattaagaatcagacgaccatctattacttcaagtatacccttggcgatgaaggtctggttccctgggcaaatggctttaccttggcggctttaattggcgtgttaatgattattcgactgaccgatcaccaaagtaagaagaaaacaatgttacatgggatattgattgctttaaccgggcaggcgattattgctgccggagtgtatggtaaatggctgctggttttatttgccggtgtctttattaactcaattggaaacggcattatcatcggtctggtctcgattatgattgccgacaccatccgatacggtgccagcatggggattcaggcagaaggcatcttagcttcaaccgatgattttggcgttaactttggtctgggaattggcggcttgattacggccggcttgtttcacgtgtcgggttacgttgccaatcagtcacagaatgcggcgactttatcgatgatcaattggaactatgtttggattcatcaataattcgctgtttcatataaattcaacaccagatacatcccggcatagatcaccatgggaatcc

SEQ ID NO: 702 - DNA, 5647 bp, Unknown
  Metagenome-assembled genome
ggtgtgtcgcgtggagtgtcatttgaccctcggtggatccgcttcaggagacttctcgttataaacattaaaactggagaaaccaggaagcgatccagtgaatcttccgtggaaattgttcttgtggtgagttgtgcggttgagatgcttattaaagttctcaatcagggttagtggaggtagtagtgattgccggatagctggtggaaagtccatgaaagtgagtaaattctgcattttaagcagatctttgatgtacatttgggaaatataagtctgatgccagtggttggcgaactcttcagtttcagttcggctcgttcacggttggcgggcccgatgaactgtttaaagtcactgatctacggccttgcggtcttttacgcgaaatttgttcatcagattccgcccaacatgaaccaggcaacgtgtcgttggctggaaatgcgttcaagactgcatgcaaaacaactaaccccccaaacaaacagcacatctttaacgccctgcttgatcaagggtcccagcagttcagtccagattccagtcgattccgttggcgacttggtagttcagcacttctttcgtaccatctggacgaatgccaatcgcaatatgaacggcttcttttgaacggtatcccgctttaacggcaagtaagtggcattaagaaagatggccgcatattgtgaagccagtcgacgttgctggaaagcttgaaccgttcattgacggctttagtcatgttggaaaaccgtggctttggagtagggagcaccgtacattttctcaatgagtcggcaatttcagcagtggtaattcccttggtatacaactgaatgaccgttgttctaaattatcactgtggccgaccgtaggctgggcaggtatgattttcaaaccggccattgcgatctcgaggaatgtggttaagttaagttgtgccgtacttcgtatcaaacgaggcgtcataactgcgcgttgcggttattaccagtgttaaacagcgtatgagtagcgttcgtaacccaaaaactctgccaattcggtttgaagcagctggttaatcgcaatttcgagggggtgacgaaaaagcttcgtccaaatgcctttgggctatgacagcggataatttcatgtggtagttcattcatggggaatgcctcctgtgatgttttctgtggttactaaatatcataagggaaggcattccctatttctatacaattcagaaatcttttatgcatttacacaagatattttacgctctcttgccgatgaaacgcaattacatttataattaactattactaggaaaattattcaaataatgttcaaaaaagggcacctgtttaaaaaatgagttgtagtaaactccattttttaaatcaggtgcccttccctagtattaacttatttagagtaggaaaaacactttcgatagtagctacagtttaaagcggcaatatcaaaatcattgtggtagtgctcataacgtcccgtattatcaacacataatccataaattaagctatccaatatgatctcctttatacttaaaaccagttttgattacttcaccgcttgtaaaggtttgaaatgttccatctatccttttaatggttataccaccattatcttcaatcttctgagcaactccctgaacaacttctgacccagtatttaaagaaaccacttttcctaaaacaatcgattttttccggtactccgccaatagttgggggttcgtatagtctaaaaatccgtttataattgcttggattatttcggcaattaattgattgcggttaactgaattgtcattatcgatagcttgggctttgattgccaactcttttggaaacttgacagttgttaaatttattcccacaccaacaatgaaagctgaggccgcccccagttcaagatcaaaaatggactccgtaataattccgcccaccttatgataatttagatagatgtcatttacccatttaaactgaaattctttatttggataaaacttttcaagcacatgggtgatgctcacggcaatcccagttgttagtagtccgggttgaataacagtttgttgttggttaggcagaataatactgagataaaggcctgtagtcggtggtgaataaaaagagcgacctcgtcttccataaccgttagtctgcttatcggcaacaaaaacggttggcctggtaatacagtgcttactagaaaattgctttgctaaatcttgggttgatgtaacttctttaaagacatgcagattatctgttaattgcttatggctgtaaatattaattaagtcggcttctaaatacggtgctgtatgaagcatgtacccacgtttcttacgactaacaattggataatctcgtttgttttttaaattattaatagccttccagatggtttcacgactgacttgaaactttttagctagatagtcaccagatacccacgtatctaaattagtcaaaagttctaacaccactttttcttgggttgatttatttttcatcaaaccacctcctaattaaatagcgataaacaataactaaaataagcttaaatgcattgcttttctaatacggcgaacaataataactgctaaagcacttttaataagatctcctggtataaatgctaagtttgaaataagagcggcaatcagcgtaatgtgagactggtaagagagccatatagcacccaccaaatcaataaaaatcactccggctaataataaaatgagcagttcaaatatccaagacttattgtaaatctgaaaacgattaattaatagaccaattagtaatggcgtaaataaccaagctataagatagccgccagttggtccaataaagacagccatgccaccattaccaccagaaagtatgggcataccgatgaaggctaataataaaaatagacatactgagatggtcccatacctaggtcccaacaactcaccactcatcatcactcccatgttttgtaaaacgataggtactggaataaatcccaacggaataccagggaagaggcctaatataattaagattgctaccatcattgcagataacgttaataatcttgtggtgttactacgtttcaatatgatcactccaagtatggatttttcaaaaacagtgttattatagctattagtaacccattagtcaaataaagggttactaaaattcgaataatggaagggagactgctaattttgattagtttgaaaacaggcgatctgttacttgttaaaaaagcacaaaataaactgtcagagatgatcattagaggcacaaaacaaacgtttttagatcgaccactagcttattaccatatcgggatagtagaaaaagaaggcactgacttttttgttctccatgcaaccaaagaccatggttgcattcgtcaaccgttagatcaatttatttccgaagaaggattgattgacgtttatcggaagagtagccctttaataaatcccctcaaaatactaaaacgagccaagtccatgttagaagcaccatacaatccgagcttcagattagatcagccaggatattactgttcggactacgtggttaatgcatttaaagatgaaaatatatttcatctatccccaatggtatttggccctaacggctctgttttgcctgaatggcaacagtattatgaaaatttagacttgccggtacctaatggtcagttagggagtagtccgaactcactaattagccaaggccatctcaaatttataggagctatcaacagctgacttttaatacagacaattatttggccatttaggtaaacgattacgtgagtttaaaacacgatcttgctggatatcccatatccctgatatcaaaaagactacaatctagatagctggttaatacggctatctggatgtaaatagtttgccttataatcttggaaaaactatgttttatttttatctcagtgctcaataatcgagtctacaaggtaaataggagagcgtaaaatatcaacgacatcataaccggttcccatgattccgatatacttcaatcgtgatgttttgctgctccatttcttgggtagggtaaagtcctcgccttgcttgggtttcacaatgtaaaacttttgtttatttatgacagttacttgtggtgtttctaagaacacctcggcaactttttgcgcttgctgttggtgattgatttgttgcttaatggctgcactgccagttaattgtgttgggacatcagcgatcaatttcactacgaacttcttaatttggctcaaaaagttatccggggtgcgttcttcggtactgatttgctgtaacgcttgctcccatttagccgtcatttctggactagttagcaagggttcgagttcgaccgctttacataatgttatcccggcttcactgacgtgcagcttatttttttcagtgacgagatagccgcgtttttttaatatttccagtacatttgcccgggtcgcacttgttccaatgccttgcacgtctttgagaatcgcctgggctgcttcatcatcaagcgttttaccggccgtcttcatggccgtaatcagggtaccttcggtaaatggtaccggcggggtcgtttctttttgcggcgtttgcagatttgcttggacttgatcgccttggtgaacgagcggtaaagttgctgcttcttgctggtcggctttgtgatcatcaaataaagcttgccaaccttgcttagttgggaccttaccggttgctttaaaattggcgtcaccaacttgggtaataatggtggtttcctcgtactcgtacggatcagcaaacatggctaatgtggttcttaaaaccaagtcatagacttgttgctgtaatttaggcaagctggctagtttctctttcgttggcacgactttagtcataataatggcatagtgttcttcaacttttttcccatcaacatagcgtttgttcggagtggtattggttaaagcgactggcttagagaccaaacccagatacttcgtcagattagccactaaataatcaaattcttcatcagtgatataagcacaatcggtgcggggataactgagcagtttgtcttcgtataagctttgaatagccgctaaggtttggctggcgctggcgtgataacgtttattcatggcactttggagactggatagcgagaatagttggggactagcacgcttcttgccttgcttttggacgttcttgattaaaccggcctgtgagcttttctgaacgcgtttagcttgcatgaatgttattagccctgcttcgtctttaaatcgctgataggggtctaattttgcgacgaatttttgctgattagcaagaatttcagcatttagttcaaaatagggtttcggcttaaaggttttgtttacctggtctctttgatagaccatacacaaggctggcagctatacgtaactaatcgagcacgctctacgtaccaaatttttctcaataggcaaattacaagtttaatccgaacaagcccggaatctttcaatggcagtctgttgatgatgtatttttaatggtcgttgattaattagttcaagtgctgctaggatctcatcagtcgttact

SEQ ID NO: 703 - DNA, 179421 bp, Unknown
  Metagenome-assembled genome
taacgactgatgagatcctagcagcacttgaactaattaatcaacgaccattaaaaatacatcatcaacagactgccattgaaagattccgggcttgttcggattaaacttgtaatttgccgtacttaatcacacatcactaatagatacaagtaagaaacgtcataattaccttgtaaatgctcatatgcactatcctgatgttttccctactgacaaggctaaaccgtatcagacaagcaatttgaccctcttgatttgattgccagtctataaataaataaacaaataaacaaaaaagaagcatccagagaccgcggttctcttggatgcttcttttttattaactagttgttagtcttaacaacctgacgaccatcatagaagccgcagttagggcaaacaacgtgtgatttacgtaattcaccacagtttgggcaagcactcaaattaggtacttgcaacttaatgtttcctcgacgcatacgtttcttcgtcttagaagtcttacgtgctggtacagccaatggaaacacctccttaaatttaaaattatccactagtgaaagatttttaagtcctactgttcatcgtctttcgacgaatcatcaaagaagttttttaacttagcaagacgtggatcaacagttttagaatctgattcttcggcttcaccttcaatggttacctgccagtcttgaccttcgggtaattcatcttcagactgttcagccttcgtcagtacttgcatcggaatctgtagtaacagattgtcagcgattgctttgtctacatcaatcacatcatcctctaccacaagaaccacgtcggttttttcgtaacgggttaaagctgcctgagaggcaacgtaaaactcggtaacgtcaaaatccatgggtaactcaactggtgtaagtgaacgtgtcgacggtaccgtcaatgtagccgaaacgtgagtataaaacagcacgtccccaccatcttcaacactaaccatcccattgatgtgaactggtgttacgtcaagcacttcatcaggataacgatccatcagatctgctttcaaatccagggcttcatcgaatttgagtggttcatgccggtactctttttgtaactcggataacgacaacttcaattcagtatcctcctaacgcaactttattattataactatgggttgtgacgatgtcaagggaatttacatgacacgttgaaaacaacttcaaagtcatcataaaaagttgaacttattcaaaacggacagggcaactatacaataacagcatgctgcaagcgatcttgatcaacttcagtcagcatttgacgcatcagacccgcctgataatcaagtcggtacggaccattgatccaatcatccgtcacacgcgatattaagggcagtttagagcgtttttttacctgttttaggtactgctgccccaagcgatcaaaacccagtacgtgcgcatatctgacttctgttggcagctccacccgattgacctgtaacaaaatgtatacacataaacgttgcagtcgcgcataagtaaaccgtttggtcttcgccgcacgcaaaaattcatcaaaattagtgctggttaacgcggcctgctttagccgatactcaataccttcgctcatttggtaaacctcatgcagatcagccagcgaagttgaaagtaactggtaacgtaaatacggccaataatcattccacgtcacctgctgatttttttgaagtgccgataacgtctcagctggaaccatacgagcaactgacggccagctaccagattgaaccgcacttcgaatcgctgctccactagcaaccgttgcctctgaatcaagttgcgtctcctggtgggaacttccccgtctttgaatcggcaagatttccaacggccgttctaattgacgattagcagcaacgtaactaaaccctaagatatcgtttgaagcgcgcagattcatacccgtctgtgcctgcaagtaatcattaaacaaggtgggataagtttcattaaattgcttaaaatggctactagcattcgttggctgattagccaccaaggtctcaaaatctaagtccgggtgttcagcaccgaaagcaagcgtcgtacaccctaacgctgacagcagctggatagcaccctgagcaaataaatgagcgggctggacgacaaactgaaagggcaattcgataaccaaatcaacaccaccaagaagcgccagtctagttcgctgccacttgtctattaaagcgggttcaccgcgttgcatccagttaccactcattacaaccaccgtcacatcggcttgcgactgctgcttagcctgtcgcaattggtaggcatgaccgttatgaaacggattatattctgcaacaatgcccaaaacagttgccatcatgccacctccgtaggatcaagcttaattttacttactgcaaacgaagaaccaacgcgttgtatcagcctgaatatcagacttaccaaaatcagcactcaccttaacctgcttaaaaccagcagtcttcagtaaccgttgatacgtcgatagctcataggttcgttcatgatgtaactcagccacctcatcataagcatctttagcttcattataggtaaagaacgtcagatcatggtcaactgaatgcggttcttcccctgtctcgctagaccagagaaaggcacgatcagcatcacgatagttgtacatatagccaggataaactcgatctgtttgatatggtgaaatcacgtcaaacaaaaattgcccatcatcatccagatgacgtgcaacttgttcaaatgtcgttgacagtgattcttcgttgggtaaataacacagcgaatcagcgaaacaagtcaccgtgtggtacgtttccaaatcactcaaatcaagcatattgccctcgattaagggtaacgtcacgtctgcttctcgcgcatgctgatcagctaaacttagcatctcatccgaaaggtcaaaaccactcacattatagccgtcttgcgctaacaatacggctaatcggccagcaccacaggccagttccaacagcggttgctgcttatcagtgacctgttgctcaacaaaggaccgccattcaagatacaattcactgtcaaacagttcatcgtacaatttggcgaaagtttgataaatcatgcttctacccagtcatcaacgttaactaagggtgcttctgaccacaatttttccaaattatagtgagcccgttcgtccttctggaaaacgtgcaccatgacatcaccaaggtcgattaaaacccagcgagctgcgtcacgaccctcaattcgtttaactggaatatcagccttttcacatgcttcttgaatgttatcagtaatcgcttgtacttgacggccagaggtggcgtcggtgatcatgaaatagtccgtaatcaaactaacattctgcatgtctagggcgacggtatcttccgcccgcttatctgaagcagctttaacagcaacttctaaaatatctttactattcattaagtacctccattaatctttcaatccgctttggggaacccaagcgttatacgtttcaatcgttttcgggtaaactcgttgattattttccaacaagtatagcaaggtgtgtttggtttggtaagccaccgccagttcgaggctttgtgaagtgagcaaccgtgctttttccaccccatcaaaatcacgcgctggttcaatgtagtctgccatgtaaataatttgcgctaatttagtcatataccggttaccagtcgtatgataacgaacagcattcaaaatgtcttcatcatcgatacccagctcggccttgatgagttcggccccaactaccccatgccaaatggcgttgttccaattaaccaaatcaggatctagctgatagtggtgaatggcggcaataaagtcctcatcaggtcgttgcttggcgtaatcgtgaactaaaccagcaatcgaagccttttcaacctcgacgccatactgttttgccagttgaatagcagttttctccacccgttgcacgtgggcaaaacgagccggttttaactgctctgaaattttggccaataactggtcacgactatcagtagtgtaacggccagtatacgatacttcttcattcatgatataactgtcgctccttaatatacttcgctactggatccttcacaaagtatctgattgactgtccctgtctgactcgactgcgaatcattgaagaactaatatcaatcgaggggatatcgacccagagaactggatacttagaggttactggatagtcttcacgacgaacaccaacaaactgcaccagtttaattaaatcgtcgatccgataccattttggcaggtaatcaaccatatcggcaccaacaataaaataatattcattctcagggtgcttgcgtttcaattccaacatcgtgtcgtaggtataactgataccaccccgctgaacctcagccagttcgataccgaaattgggattgtccgcaatactgtccgctaccatcttaacgcgatcagcagcatcaatggctactttccggtcaacgtgtggtggattggcatccggcatgaacaaaacgcgatcaagccctaactgtgtcataacttgatccgccatgatcaaatgcccaatgtggggtggattgaacgttccgccgagaataccaattctttttttcttgatagtggctgccagctgttcaacaacctgtgtcttcgtctgttcaactaccttaaccatcgtgatttccccttatttcaaaatgattatgctaattttgctacttgtaatgaaagatcctgatatttttcttcagatgctggctggaataaaaccagtacccgaccaatggtttggacaacctgaatctgagtgttgtcttcaatgtaagcttgaacttcgtcaaccgtttcgtcagcactttgctgaagattgattttgatgagttcacgcttttgaagcgcaccatctaattgagctaaccaagtttggttaagcccatttttaccaaccgaaaagattgggttcaaatgatgtgcttgagcacgtaaaaaccgtttttgtttaccttttaaattcaaattaatttctccttatatcattgctcgacgaaccacaacaccaacacctttaggcgcatagccggcaacgactacaccagcaggtacggtgatccaaccaagcccttcaaacactaaatcacttttgtcagtaatcttaaattcgtgtctttctaaaggcggcagatcattgtctgggctttcaggtggtgtcaacaaatcgccaacgtgtttactgtaaaagttatccgcattttccagcttagtccgatgcaacggtaagttgttttcaacgtacaccgtaaaaccatgtttagggccagaaacataatcaaaacgcgcaacaccagctaagaaaatggtttgctgatcatttaactgataaacttttggcttgatttgcttttgcggtgtcacaatctttaattctttacccgataagtaatgggccatctgtgacggatggataattcctggcgtatccactaacacgtgatcgtcatccaatggaatctcgatcttgtctaacgtagtacctggaaaacgggacgtggtgatcacgtccttagccccagtactgcgacgaataatttgattgatcagtgttgacttcccaacattggtaacaccaacgatgtagacatcgcggttatcacggtgtttttcaactttatccaaaaattggtcaactgattgattcgtcttagctgataataaagaaacatcgattgggcgaattccctgttcattagcgcgttgacgtaaccaatcacgcagttttgaacgtcgcagagaacttggcagcaaatcttctttattacccactaacatcacgggattatcaccaacaaagcggtgcagtcctggaataatcgagccgttgaaatcaaaaatatcaacaacgtagacgatcaacgcatttgcatcacgaatttgagtcagcagacgcagaaaatcatcatccgtcagaccaaccggtacgatttcattgtagtgtcgcagtctaaagcaacgctgacagtataattcacccgtttccaaccctttatctagggccgattgcggcgtgtaaccaggcttgtttttatccgtggtctgaatctgtgcaccacagccaatacaaaacacggcttcaccgtcaactaatacttcatctttatttgtttcgctcattgattaagtcctttcgaaacttgagttctggatgtcttttacggattgcgtgcatcacaaatcgttcgaaaaaccgattgattttggtgttccacgcatcgctttcaataattggtttgactaagatactagagatgccactgaagtttgctgcagccacatccgtcaataactgatcaccaaccatcacaacttcatttttaccaacatggtattgacgcatcgcccgccgaataccacccgaaaatggtttaagcgcgcgtgaaataaagggaagctgcaaagtcgccaccgcctttttaacccgccggtgagaattgttcgacacaaccaccaactggatgttctcacgttctagtgacatcatccagtccctgagttcttccgtcccataaggattattccatgcaatgagggtattatcaagatccgtcaaaacaactttgatccccaaccgttttaattgttcggggttaatatcataagttgcatcgatcatccaagttggtgtaaattgcgctaacatttactaactcctttatcctatactgaggttatattatacgagattttagccaacattactatgattatggcgtatctctactgaatcaaacaaaaacgaggttggaagtcttcatccagcctcgtttaggtttaaattataatgccttttttgcttcgtcagctaatgccttgaaagcatcagcatcattaacagctaagtcagccagcatcttacggttaacttcaacgttagcttgcttcaagccaaacatcatcttgctgtagcttaaaccgtttaaacgggctgcagcgttgatccgtgcgatccaaagacgacggaagttacgcttgttggccttacgatcacgataggcgtattcgcggcccttcattacttggtccttagcaaccttaaacaaacggtgctttgaaccacggtaacctttagctaatttaagaatctttttgtgacgtgcgcgtgttactgttccaccttttactcgtggcatattgaattcctcctactaatacttacggttatcatcgttttaacagattaatttttgaaacggcttagcgaattacttttgcagtaattgacgataagttttcttaatcgtgtttgatttcatcattgaagtcccacgtaattgacgacgttgcttcttagtcttaccgtggaaacggtgactcgtgtaagcattcgcactcttaatgccgcccttagcagttactttgaaacgcttggcactggcgcggtttgtcttcatctttggcataatcgaaaatcctcctcaaatactaaacaactagtcttctttttttggtgcaagcatcaaaaacatgctccgtccgtccatcttaggacgttgttcaacggtcgcaaaatcgcttgtttcttcagccatccggttcaaaacttggcggccaatatctttatgagtaattgcccgacccttgaaccgaattgaaacccgaactttttcgcccttgcttaagaacttcttagcgttcttaagtttcgtattgaaatcgttcgtatcaattgatggacttaagcgaacttccttaacgctaacgaccttttgcttcttacgagcttcacgctgcttcttttgcatctcgaaccgatacttcccgtaatccatgatccgggcaaccggtggcttcgctttcgctgccaccaaaacaagatccaagtccgcatcttcagccagttgaagcgcatctcgcttactcttaatgcccagttgttcgccattattaccgatcaaccgtacttcacgagcgcggattccttcgttaaccatcatatcgtttgctatggtcattcacctccgagtgattttgaaaacaatgaaacgtaagtcttacccaaacaaataacgggcacgcaatgcgcacccgttaaatatccaaaccttctcaggctcggtttatttacgtatcggccaggcagcgttaaccacgaggcgagaagcgggtgcttctacttacattttttcaactccactaatataccatgacacgatacattagtcaaatcacttggctttaagctcacgaataataagtatagtctatttaattcatgtgtcaagccacttttaacaatctagttattactgtaattagcaatatccttcaaaatttcggtttcgaaattatcggcactcatagattgactgtcttgttcaccgtacttacgaacactgacggccttatcagcgacttcttgatcaccaacaactaacgtatatggaatcttgtgagtttgagcatcacggatcaagtagttcatcttttcaccacggtgatcaacttcggcacgaacgccagcagccaacaattgcttgcttaaactctcagcatattcaccatgcttatcatcactaactgggatgattttaacttgctttggcgccaaccaagttgggaaagcacccttgtagatttcagtcaagtaagcgataaaccgttccatagtaccaacgatcccacggtgaatcataactggacggtgatcttcaccatctgcaccgacgtacttcaaatcgaagcggtctggcaacatgaagtctaattgaatggttgacatcgtttcgtcgttacctaaagcagtcttagtttggatatccaacttaggaccatagaaagcagcttcaccttcagcttcgtagtagtcaagaccaaggtcatccatggcacccttcaacatggtttggctacggttccacatttcgtcatcatcgaagtacttttcagtattctcaggatcacgatatgaaagacggaagctgtaatcattaatgttaaagtccttgtaaacatccatgatcaaccgcaagatcttcttgaattcgtcttgaacttgatccaaggcaacgaaggtgtgaccatcgttcaaagtcatttcacgaacacgttgcaaacctgataaggcacctgatttttcgtaacggtgcatcatccctaattcagcgatccgtaatggcaattcacggtatgaacgaatgtggtggttataaatttgaatatggcttgggcaattcattggccgtaattcaagcatttcgccatcacccatgtccattggtgggaacatgtcttcgcggtagtgagcccagtggcctgaagtcttgtaaaggtcgaggttagcaagaaccggtgtgtaaacgtgcttgtagccgtcagcaacttccttgtcgatgatgtaacgttcgatggtacgacgaatggtagcaccgtttggcatccagtatggtaaaccggcaccaactttaggatcaacgaagaacaagtccagatcgttaccaatcacacggtgatcatgttcgcgggcttcttgacgagcttgtagatcagcatcaagatcagcttgcttgtagaatgcggtaccgtagatccgttgcagcattgggttagatgacttaccttcaaagtaagcaccggcaactgataacagacggaagaacttgatgtcaccagtattagcgaaactaacaccactggctaagacagaaacgccatcaatttcgtaaaatggaaattcttcttcatcgctgtcttcaacaagcttggcttcgtatgaagtaccttcaagcttcttcaaggcatctgccttgcttaagcgaacgtgcttaatcgccaatttttggttgatgaatgcttgtactttgtcagaaatagctggtaatgaatcaacactgacctgaccgtcttccttatcggtatcaacgtaaaagccgttttcatcgccgacttcttcaccaaattgaattgatgggaagctttcctttaaagcaaccttagttagtaaggcgacggattgacgtaatacagccaaaccatcttcgctgtcctttgtgacgatttcaatcttgccatcgtgcttcaaaggtgcgtttaaatcaatcaatttaccgtctaacttacctgcaacagcctttttagctaaactaatagcgatggactgtgcgacgtctttggtagttgcttcggcatcaaactgtttctttttaccatctgggaattcaatcgtaatatctgccattctactcttctccttatatattcattactttaaacattgaaagccaccgaaccgtgaaactaaaaaatcccggcatgcacattactgtacataccgggacgtctctacgcggttccacccgaaattcatctgattcacactgcgaaccaaaccttcattcagtgataacgggacagccgatgcgatattatccatcgcacattcgagaaagtggtaacttaatatcgctcacaaagcacttccagaagtggtgcttctctcttggagagttcaattaaatcttgtctttcaaacatttaaaattctttgaatttgattacaattcacattaaaccactttgaaaaataagtgtcaacactatttttgccgacggttctcaccaatcatctcaatttcttgagccaagaagcgaatccgctccatcaggcgcttagcctttaaaggctctacatcacccttttgcgtctctgctaaatgctcagtttctaactgctgcatcgagaaattagacgaaaagaaagttggtaattcattttgcatccgatattccaaaatcacgccgagaatatcatcgcgtacccaagcggacatcgcatccgcaccaatatcatcgatcatcaagatctgcgcctgcttaacatcgtctagacgaccagcaacttgattactagcaatggcatttttcatttccaccgcaaaactcggaaaatgcactagggttgttttcacgcccatatcagctagttgattggcaatagccccaagtaaataagtcttacccacgccaaaactaccatacaggtagagtccctggtgaaaatgcttcgaatctttcgaatacgcctcaataaacgccactgcagcttgtagtgcctgcgctcgatcggggtcgttgataaaatgatcaaacgtcgcattcttaatcagtttcggcatcataatggcattgactcttcgtttcaaagcagcctgcttcagctttgctttttgagcatcggttggctgatatgacacttccaccaagtggtcatttaagaccagtttaggttcatatcctggggcaaatgttgtttcgccagccgccaatttattgcgttcgttaacgtattcgtataatttggccgatgaacggtcaatctgttcggcgtttaactgatcagcattggcctttaaaaatgcctgaacatcagcatcttgatacacactgttcatcagtttttggtaattagcattaagttggtgttggtccatataacgtttcatagactcactgatattttccatactaatcacctccatcccgcagttttttaagtttatttaattgttcgttaaattgatcctggtcagacttggataacgtttttttcttctttggttgataatcacttttcgcccaatccggtaatgtttctttgatattcttagtgccgccacgccgccgagtcgttttgggtttcgcccggtctgctttaaatttacgaatacttgctagcgcatcttctggcgttttgacaccatcttgcgcccagcgattggcgatagtatcggtgagtcgctgagtaatcgttgaattattcagatcaatcaaaacctcgtaaatcagcatattaatcacagaactggaaaagatctgtttattagcaatttgctcaacaatacgttgctcgccactagcgacataaccaccctgctgttgacgaatctgggctaagaaagccattggttcatactgtttagcagtagcaatcaaggctgcttcttcctgactctcactggctttttgagcagtgaccgttttttgagccgataccaccggtgttgtttcaccctgataggcagcagcgattgcacgtttaaactgattggcatctaacttattcgtggctaaattagtggcatcacctatgtagcgtgccatttccgtttcatcaataccgtacaataaatgttcgttaataatcaactgacgatattgtcgcaaatcgttcaagtcaatgtatgaccgcttcagcagttcagaaagcaaaccaaaatcaaagtcaggcgccgtaggttgttcatgttctacagtggtttcttcctgattaaaagctgctttggttgcctcgatcaatttaggtggtgccgcaatcagtcggttatccagtgaaaaaacgtctaaaaacgacttggaaatttcgtgccacctatcccgtttaagttgccgtggcaagaaggcttgccgcagtcgttcaaactgccgctcacctactacttccagtaacagcaagcttaacaggtcatctttaaagaacatttcaccactaacgggttgctgtaattcatagatcaattctggtaatcgatcaggctgattttcaaaagtccgtagtagtcccgcagcctccagccgttgtcttgagtcttgaagcgtcaccatactaatattgagcagtgccaatagatcagtatgggtcacttcgacttttaaatcagctgtcaaagatacttgtcgccacatcactgtcgctagactgtaggctgatacgcctaaaatcggttggtaaagcaagtccaacacccgtcgccgctcttcttgaagccgcgttgcagtgacaattgcgacagatgttttaggcatcaatggttgctttgactccgccatgatcaagccccgtttcatttctttttatcagaggaagccccttttttcttatccttattcatcacatctttgagttcttccaaaaagacactcatatccttgaactgacggtaaacactggcgaaacgaatataggaaatctcatcgatatctgctaagcgcttcatcacgtattcaccaatcaattggctggaaacttcattttcacccagtgaacggacttcattttcaacctcatcaaccagtttggtcatgacatccataccaactggccgtttttccgctgagcgaataattccccgtaagattttctcacgattgaattcttcacgagtaccgttcttcttgatgactaataatggtgttgcttcgatgcgttcaaacgttgtgaaccgaaagccgcaattttcacattcacggcgccgtctaataacccgaccctcatctgttggccgactatcaacaactcgtgaaccattatggtgacagtgtggacaatgcatagtttcacctcttatccttatcaaacattttactttttaacctaattagatttatctgttattaatgagccaaatccggcttcattcagccatcttaccacttgcgcttttgttttatcaactgaatcactattatcaatcaccacatcagcccgttttaccttttcagctaatggcatctgcgcgttgattcgctccaacgcttcttttttaggcaagtggtcacgtgccattaatcgctgcaactgtacttgatccggtacgttgacgaccataatttcgttcatgccggctgcgccatgggcttcaaaaagcgtgggcgcatcgtagatcaccagcggcacttgacgccttcggtaaccccgtaatttgcgcactacggcctttttaattaatggcccggtaataccgtttaactgtgctaacttctcgggttggctgaacaccaaggtaccaagtgcatggcgatccaaagtaccgtccggctgaatcatctgccaaccaaaagtggtttgaatttctttcagccccttggttcccggttcaacaacttctcgggcaactttatcagcatcaatcaccggaatctgataggctttgaaaaattcgctcacagttgattttcctgtagcaataccacctgttagtcctagcaccatggtcaccccagggtccttacgcaagacctgacagtctgggcaaaagtgcgtaccacgttgagcaaccttagttttttcaattggtgtatcacaccgaaaacaaggttcacccttacgaccatataccattaaatgattctgaaattcaccagcttcgccataagcagtagagaaggaatgcaccgtcgtaccgtgcccttcaattgcgcgcttaatttccgcaataatattctcacgcagctgacgaatctgaaattccggaatcgtgttggtgggttgttccggatgaatccggcttaaccacagcgtttcatcaacgtaaatattacccaagccggcaatattgctttgatctaataaaaatggcttgatggcctttttactcttgctaaaaatctgcttcatatattccacagtcagcgtttctggcgtgggttccggccccatctttttcaaaccggaaaccagcttcgtctcgtcacccgtctttaacaagtgcatccggccaaacttccgggtatcggtatatcttaagtcacggttatcatcgaggtgaaacactacatgcgtatgcttagtaatcggattaccagctggttgcacgtcgtacttaccttccatccttaaatgggacaccatggtcaaatcatcatcgaatctgaataacagatattttcctcgccggtcgatccgttcaatcgttttgccagcgagcatttttttaaattgatcagcctctggtgagaccattttttcatagtaaacatcaacggacgtaattttagcattgccgactaagcgcgtcaggccacgccgaaccgtttcaacttcgggtaattcaggcatccttagtgcctccttgtatcattactttgcttcgtaccaggtattgccgtaatgagattccactttcagcggaatttccagtttcacggctgaatccatgacacttggcactaatttttccagtgttgggatctcttcagcgggtgcctcaaagatcaattcatcatgaacttgcaacagcatcgtagcctgcaagtctttaatagcatcttccattttgatcatggcaatcttaatgatatcagcggcactgccttggattggcgtgttcatcgctgttcgttcagcaaatgatcgttgattaaagttccgggcgttgatatctggcaaataacggcgacgatgtgcaatcgtttcaacgtaccccttgtccttagcggaagcaacgatatcagtcatgtactgcttaacgccgggatattcctcgaagtaggtatcaatgaactgacgtgcttgcttgcgagtaattccaatattttgggacaaaccgaaatcactgatcccgtacacgataccaaagttcaccgccttggcttgacgtcgcatattcggatcaatttcagcatctggacctaaatggaaaatccgacgagcggttgacgcatgaatatcatcgccctctttaaaggcttcctgcaaattcttatcatgagtgatatgagccaacacccgcaattcaatttgtgaataatcagaagaaaaaatctgccagcccttatgactagggataaatgcctgacgaatccgccggccttcctcggtcctaataggaatattttgcaagttagggtctactgaagacaagcgtccagtttgcgtcaaagtttgcaaataacgggtatggaccttttgatccgtgctgtgaaccacttttaataagccttcaacataggtggattgaatctttgaaatttgacgatacttcaaaatgttttcaacgattggtgcttcagctgccaatttttcaagcacgtcaactgaggtagaataaccggtcttagtttttttgattggggttaaccctaatttttcaaacaaaatatgctgtaattgtttgggtgagccaatattgaactcttcgccagcttcttgaaaaatggtctgctgagtctgagccaataactcagtgaactcactctgcattgctgacaaacggtccgtatccaccataattcccgcaatttccatgtgtgccaatacataagccatcggcaactctaagtcgcggtacagcttggtctgctcgttttcatccagttgcttaaataacgatttctttaacgattcaatggtaatcccttttcgagttaagtgttcaaaaaagagttgatcatcatctgggatcgcccgtttggcacccttaccatagacctcctcatcagattgaatctgatggtaaccgtgctgaaaagctaaacggccgaggtcgttactgttttcattggtatccagtaaatacgaagccaacaacaaatcaaaatcaacgttacttaggtgaatgtccagtcgatttaagccaacgtaagtccgcttcaagtcgaaaacatctttttgaaccttatcactggttaataaatcttttactggagcctgctttagtaattccacgtcacgactaacaaaccacttatcaccctcgccaatcacaaacccagcaaaagttgacgtgtgatagtttgcgtctggcatttcaagataaaaggaaacgtgatctttaaactgggatagctcacttaaattatcggcagttaaaacggtgaattcgacgggttttaagccaagaacgtcctcgtcacccgcatccgtattcattttatttaaatatgattggaagttcatttcctgatagaacttaactagttcgtcttgctgatctcccttgtaagtcaagtcgcttagcttgatttcaatcggggcatcccgacgaatggtcgccaaatcacgagattgaaaagctgaatctttgtcttcaatcaaatgttccttcatttttttagcggtaatcttatccatgttttcgtatacaccatcaatggtgccatacttctgaatcagtgaaacggcggttttaggccccacaccggttactcccggataattatctgaagtgtccccttgcagccccttgatttcaatgatctggtccggccgaaccccaagtttttcctcaacgtgttcgggggtgtaggtttccacttcagtaacgcccttttttgacacggcaacactggtcttgtcagacgtcaactgagttaaatcacgatccccggtaaaaatggtcgtttcgtaaccagcagtttcagcctgcttagccatcgtgccaatgatatcatcagcttcgtaattctttaattcataagatttaatgcctcgtgcagctaataattgacggatcactggcatctgttcagaaagttctggtggtgtctttgaacgaccacccttgtaatcagcatatttcttggttcgaaaagtcactttaccggcatcaaaagccactaatgcgtccgtcggcttaacatcttctaacataatatccagcatccggttaaagccaaaaatagcattggtgtgcaagccgtctgcgtttgtcatactattcaatgccgtgtacagcgcgaagaaagcccgaaaggccacactgttgccatcgataagtaataatcgttttgattcagtcattgataagcctccgcaatttgtattacctctagtttaacagagaatttagacaattaaaaatcagtttaatagtaaatgcggcaggcgctcacgtcgttagttattgctccaaaaataatttcctgcaaaacaaaaaagcactgcacagcagcgcctttttgattcacaaactactattctcctgtgccacaaccttagccgcaagcatattagccatactgattgcatccactaaattcatcccgctcgcgagcccagctaagaaaccaccgcaatgggtatcccctgcaccaatggtattcacaacctcgacgtgatgactgggaacgatgtcagaacgtttaccatcgtaataaaaggttcccttagcacccagtgtcactaacactgggctctgggtttcctcaaaaattgattttgcaatctcatccatcgattctccagatttgccgaaataaccgatttcatcttcattgcagtgaataatcacgtgtttgtgcaggagctgccgcaccgttttgtcggttaaatggctcattcgcggggaggcatcaaatagcacataagcatccgcattgcgttgcgttaatctgcccagaatctgatcagcaatgtgttcattctcgatttgatagccgctcacgtaaaaataacgataatccgctaaattaatacgatcaaaccagtcatcctgccaaatctgatcaatgccaggaatcgttaaaaaacttcgctcaccagaaggttccaccatagaaatgtcccagccgttgtccgcttccgtcactggtaataattctgggatttgccggcgttgcaattctgcgcgcacaatatccgcgtactggcctttgcccactggtacaaacaggtctgcatcagcgtgagcggcatgcatggcaccataaacattgaaggctgatccgccaacaatgtcatctttcaaatctcctgtgacatcgccacctgaaaatggtagccgcgggacattaatgatcacatcgacgtatgccgcacccaaaatcaaggttttgttcattacgccaccttctcacgttgaccgcccttaatcagtttgacaacaaacatgcagataatggccaaaatagcggatataaagacccctaaactattgttagcaaaaattccgtgtgcaaaaggccccgtccaaaccacgttattagtgaagagaaaaccggtgatcgtggcaatcagccaggaaataattcctccccagttatagtgggtgctagattgcggatcgactaacttggtatcataaccatttttccgaaacatcacactgtcacacaggaagatagccacccagctcgctaggcaaattcccaggaagttaaggaaaatctcaaaattactgagaaagttaccggagataaacaaaacatacaccggaattaaaataacgattaaaccgtgaatagtcaatgaagtccgctgcgatacattaataccaattgttgacaagttgattcgtgccgaacgcagtgaaacgatacattgaggaatgatgccaccagctgccaccaagaaataaatcacaccgatccagcttggcaaagcgctgtacatcacatcaaaaggattacccgtagtagcaagtttgggttcaatggtactcaacaaaacaccaccagccatcagcacaaatagtgggacagcacctcccatcgtggtgttccaaaaagtagcagctggttttgtattaggtttaacgtatgctccccaatcagctgcagccatggaccaggaaattccggacccagctgctacgatactgacagcgggcaaaaagccggtgatccagctaccgcttggcaaatctaaggcttcctgccaatttgctttcatcaggaaaatcactagaatgacagccgttaaaacaccaaagatccaactcaaccaagtttgaatcttcgccaaagttgcttctttcagcagtccagaaagtaagaccagtcccccaaagataattaaagcaatggcagtcgtcaatgtgtttttctgaacgtgaatcactctaaataaggaagtcagtaacaacgttccggtaataatgttaactgccagccaacccaccatgttgaaccaggcaatggcgttgggaatcttattgccgtatgtcccatatgcagcccggctcagcttgaaggtggtaataccctctcgttgaccgaccatagccacccagccaggaaccagaaaggataatgtgccgactaaggaagccgcaatggcttgcataaaagataaatgatagctcacaataatggcgccgtacacaaaacccatgattccgatgttagctgcaaaccagttatagaataacttaccaggtgttaatgtcttatccgcctcaggaactttaataatcttatcgtccataatgttataccgtcctattttttgcttgtccgaaactgcaacatttgctcagcatattcttcaaaatggtgctgtggattcttagtatcaattaaattaatccatgattggtcaattgatgaagccccattcttggcaccacaaattgccgttgccatagcaccaatcgtatcggtatccccgcctaaattggcacaaatcaatgctgatttatggaccgttttggcgtaataggcaatggaaagagctgccggaatactttcagaaatcatggttcctgtaccaatcacgttataaatagcctggctgaaacgaacctcatcgcttggataacggtttgccagctcaatacccaattttagccgctcatgagtcttggcagcccaagttggagcacccattttgaacccttgatcattacaattcagcgcgaagtcaataatttcatcccacgagtagtcagccacggcggccgtcaccgcccccgcaatcatggaagccccgctcattgccacgtcgctggaatgcgtcactcgggtaacttcgtaaaccattttgatcagcccactcagttcctgcgggccaaacagtgcaccgatgggagcaattcgcatgccggcaccgttagtcaatgccttgtcggttaccggacgcggattctcaccttttttaatagcggtcaacgccgctttactgctgggtcccagaatgttattctcccaggcacccacttcatcggcccacttcataatgtgctgaaccagattttcctgattcggctgccaatcagtttcaatcaatgaatctaaaatggctaacgcctgattggtatcatccgtatattcacccttagtaaaattcacagcgatatcattatttgacggtccgtctaaaaacgtcgtgatccgaccgttaaattgctgccgaatctgctgcaccggccatagctctgacggcatacccatagcatccccgatagcttgaccgtacaatgttcctaaaattttatctttaatggtcattcaaatgagctcctcctaaaaagttattcaacacttaaccgcatattagtaattaatctagtcccctctcctcattcaaaagttaatgccattaacgatatttttaaagttaaaaatacttataaagcaaaagaataagccgcttttcaaacgtattgtctaacttcgtcgctaaaacacttaaaaagatggtaaaacattggcatagccacgtcaaggccttagagcaatatatgtaaaatacacttattttttgctgtaacttcaggcttttcatttatctaataaaaacgaaattcgtacccaaaataaaagagtctgattaacagtcaaaatagtacgactgttaatcagactcaaatttaatcatttttatatgtcaaaattatcttttttaatgattgattttagccactttaatccctgtcacccatgccaccaaaaatctgcagtaataaaataaacaggtttacgaagtctaggtaaagctgcatcgcaccgatgatggctaaaccagtggaactggttgcactaccatcactttgcaaatacaagcgtttcatcttttggctatctgatgctgttaaagcagtgaagataaccactccaataatagaaaagacaaacgcaatcattgaactcttcaaccagatattaatcaagaaggcaacgattaacgcaatcaaagcagcagttgcttgtgcacccactcgtgacaaatcacgtttcgttgcaatcccataaacggccatggcaatgaaaatcgttgcgctagaagcaaacgcactcaccatggttgttcccgtgtacaccaaagcgtacattgacataatgccacccgttaacaacccataagccattaacagcacaaaactaaccgatggccgtttcattgcttgaccactaaccaggaatggaaagacaaaccatacaatgattggtacgattcgatatgaacccgtaaaaagtgacatcaaagctggcgtggttgaaacgtagaacgctgcaaaggctgataacaacacggctactgccatccaaccatacattttggttaaaaatttgttcaaaccaacatccgcattgattacgcgtcgtggctgttcatcgtaattgttcattaaggttcctcctttttatatccctcattaagaatacattttaacaaccttagtggaaaaagcaatgaaaagcgatttcttacggctcgaataagttaccttttagaaaatattaataattagttatcttttaatgacaaatggctcaatagctcttcgtaagcacgttcgtacttttgaacgtcacccgcacccatgaagaccacaacggcatcatgatagtccaacaatggtgacatgttgtctagcttcagaatttcgccgcccttgttaatcttcttagcaaggtcttcactggaaaccttaccattcgattcacgagctgaactgaaaatatcagtcagataaaccacatccgcgttgtttaaagccttcgcgaaatcatccattaacgcaatcacacgggtaaacgtatgtggctggaaaacggcaatcacttttttgtcaggatatttttgacgagcagcatctagggttgctcgaatttctgatggatgatgagcataatcatcaatgatggtcatatcagccactttacgttcagcaaaccgacgcttaacacccttaaagctcaataattcatctttgatggcatccagatcaacgtcttcaaagtaagctacagcaatcacagccaaactgtttaagacattgtgctcaccaaacagcggcacatggtagttacctaaaaattcatcatgatagtaaacatcgaactgagaacccttggtcgtccgcttaatgttacgtgcctgaaaatcgtcccggtcactggtaccatagtaataaattgggacatcagtctttaaccgacgtaagttctcatcgtcgccccaagcaaagataccctttgtcacttggttagcaaacgtttggaaagcactaaacacatcattgatatccttgtagtaatcaggatggtcaaaatcaatgttggtcataatcgcgtagtcaggtttagtggctaagaaatgacgacggtactcatcagcttcatagacgaagaaccgcgcatttggtgtacccttaccagttccatcaccaatgaggtaactagttggtgcgatgccggacaacacgtgtgagagtaagccagtggtactggtcttaccatgggcaccggcaaccccaatactggtatagccttcgattaacttacctaaaaattcatggtaacggtaaacgggtaagcccatttcccgtgcttttttgatttctggatgatcgtcggtgaaggaattcccagcaatgaccgttaagccttcgtgaatattcgcttcgtcgaatggataaaccgggatcttagcctgttcaaggccacgttgcgtaaacgtgtactgtgtaatgtctgatcctgctaccttaaagcccttgtcatgaagaatgagtgcaagtgagctcatccctgatcctttgattccaacaaaataataagtggttgtgttgtccatcaaaatcctcttttcatcgtttcaatgatttaatttaggccgactattgctggttaatcagccatcattggtccatatcaatattttagcagagcgaacacatcttgaacagtgcattttctgcactgtaacatgagtggttttcaccttttaatcggttctgggtgctcgcatttctgcgagttgtttttcagtgagaaaaacgtcccggggtttggaaccattttggccagaaatatattgcttgttttcaagagtatcgatcaagtttgctgcccgattgtagccaattgaaaagacccgttgcagtttcgacgtagagaccgtcttttcctgcacaatatagtccaaaacctccggcatcaattcatcctgactttcttgaacctgctgtttttctaacaggccatccggatcaaaggcatagtgcggcttaccctgagtccgtacaaaatcagtcacccgatcgacttctttatcaacgaaagttccttgtaatcgaagcggctgtgaggcaccgttgcctaagaacagcatatcgcccttccctagcaaacgttccgcaccagacgtatcaataatcgtccgggagtctacctgtgaagacaccatgaaggctactcgagttggaatattatttttaatggttccagtaacgatgtctacgcttggccgttgggtagcaatcagcagatggatcccggctgcacgtgctttttgcgtaattcggacgatgtagtcttgaacctcgctggaagccatcatcattaaatcagctaattcatcgatcacgatcacaatgtatggcagtttttgcgcgtaatcgccagttaattcggcacggtcgttatattgttcaatgttccgtacgccagcagccgccaatcgatcataccgatcgtccatttctttgaccgcccatttgagtgcggcagcagcggcctggggatcagaaatcacgggtgaaagtaagtgtggcaacccatcgtaaggcgctaattcaactgctttaggatcaatcagcaataatctcagctgagctggtgtcgctttgtaaagcaacgaaatcagcagactgttaataaagactgatttaccggaacccgtagccccagcaatcaacccatgaggcattttccgaagatcagtcactcttggttggccgaacaagtccaccccaagtgcaaccgtcaacggcgaagtgctgtctttaaaggcttttgattccaacacttctgataacattactggacgcgtcttgggattaggaatctctatccccaccgtagtcttgccaggaatgggtgcttcaatccggatatccttagccgccaacgccagctttaaatcatctgtcagattagtaattttatttactttaactcccagtgctaaatgaacttggaactgagtgacggttggaccaactgtccagtccaccacgtgtgcgtccacgtggaaagcctgcaaagtttcatccaaaacttcaccttgatgttcgatccattcatccaaggcgttttcatccgtaacaacgggtggtgtcagcaaagaagttgccggaaattgataaccacgattatcttgagcgttctcatttactggcttagcagttggcttatcctgaaacagcgccagtttattcatttgtgaactggtattttcctcctgcaggatatcgccaagagaatggcccaacccatgtccaggttcaggctttgtttctggctctgacgaatgctcgatactgtcttgcttttcatcatcagtcgagtcaacggcattatctgccggcattgtatccgcaggtgccatggtaacatccgcctgatcgtcagtagacttaacatctgcttcgtcctgtgacgttgccggattagtctcaaccccttgcacttcagactgttgttcagtaactgaaacaggttgctttgtatctcccgtctgctcaagcagttgcggcttattctcagattcgtctgttgtaagacttgaacctgtcagatcaccgtcatgtgattctgactgatcagatactgacggtgtttcaacaacactcgtttcggaatcttcaagcggttcttgaaccgtctcagtttgctgttcgctatcaggatcaggctgattggatacttctgtgtcgtcctgagtcgattgcggtgcctgtgttgactgattcaactcaggctggtcagcgactgtttccgtatccgtactgttatccgtttcaaacgctaaccgtggttgctctgccattgccgaatcagtggtcacttgggtgccatcgtcaaagaccagcacatcacaatcatctttttgaaagtattgtttcataagagcggtgtaatcaattttgggttggtggatcacccttctattaagttgtttaggtacctgtgttggtcgaaaaggcgttgaggaacgccagtcattgctaaccgtttgcttaggttctggctctggccgcgtttcaggtcgtctgttgatctcacgccgtggagtctcttcgtggcgtggttcttttcgttgaaaaattgcgggttcttcatccgcctgttttgactgtttaccaggcactttaaactgtggcgaaactggctctttagccgatttctccggtcggcgatatctccggtaaaaagctggtccatcatagtgattcatatttagtcatccattcagtattcaagttagtttagtttgattattttatggccgagggcaaaataaaaaggagccgaggcccctttcacgtcgttcatctaactgaataaagtctgtgccttgttaaagtcaaatggcgttccaacttcgtaatcatcaggtaaaatcaacgcgcccggccgatcgggtgccccaggaatctttaattctcttcctgatgaaatcataccatcactttcaacgccacgcaatttaccaggccaaataatcaggccatctggcatcattgcaccaacttcggccacaaccactttgatatccgcctgcatgttaggcgaaccagatacgatttgcagcgttttgccatcttgaacccgcgtcttggtcaccaataagtgattagaatctgggtgcggctctgctgattcaacataacccacaatgaatttcggcgttaaatcggcctttaactctggctcaaaaccagcatctgacagtgcctgattcaaagtcgatacctgttcttccgttaaaaagacctgaccattttgattaatgggtcccaggatatctgacacgtgagccacgttgtagcccagcgtggtatcagtttctggatcaaaaatacgggtaaaatcacccttagtaacaacggattgttctttgacatctggtgccacgtagataatcatcacgtcgccaagtgccttttgattataactagaaattaacatggagcatcctttcaaaagcagaagaactacagtgcattaataaattcttctacttgttgttttgttttgcggtctttgtttacgaagcgaccgatttcttcaccattattatacgcaataaagctaggaatgcctaatacgtttaattctacagcaagatcaatgttttcatcacggtcaacgttgatgaacttaaagtctgggtattcggcttcaatagccggcattgaaggcttaatgaacgcgcagtcagtgcaccacgttgctgagaaaaacagcatgtaacgaccatttttaattttttcaagtaattgatcctttgtcatttgaggtaatttttccattactatcgctccttacttacttttattcagtagattgattataccctgttttcagaaaaagtacattaatgtggtatcaaagagagatttgagctaacataatactaaatagcgtaggaggaaaacgcgtatggaactaaacatcaaagattatcaacaactcagtctactatccctattaagtattttatttggtttcctgatgggtaaatcagcatttaaccgtcaatatatgacgcccaatgatattttaaacagtgttaaacaagccttcagaaaagaatcaaccattgagggtgcctggatcaatgagcatccgtacaagcacgcacaatttgccattcacactatggtttattccggtggtctttcccgcatggaagacaataagctcgtatcatatgagtttattgcagatgctaagaccggtagtattctaaaaatgaaccgcctgtaaaaaaatcgttaaaaatatatctaacccgtgtcccgattgcaagttaatcgggatttttttgtgccggattgctatcaaagtgagctactaacttataaattggtcctttagcactaaacttctcttcatactcagtctgaacgttgccttcgttgccttcactgttgtgcagatctagccgaacttcgtcaaaaaccatgccaaagttgttaaaactcgttaatgagtattcaaacaaaccacggttatcagttttgaactggatccggccgtcttctttgagcactttttgatagtgagttaagaaattaggtgaagtcagccgacgcttagcgtgtcgcttcttaggccatggatccgaaaagttaaggtacagcttatcgatttcgccttcagcaaacaaggtatctacaaacgcaccgtcagtttccaccaactggacgttaggcagctcactttctactaatttacgaagtgctgtggcaatcactgattcttgaatttcaattcctaaaaagttgatctctggattctgccgagccatttcgataatgaactgacctttcccaatcccaatttcaacttgaataggctggcggctaggaaaacgttcctgccaatgacctaactgtgattcaggctccgtcacgattaaatccgaatgattcttaatgtactgtgctgcccacggcttcttacgtacccgcatgttgttcctccgatttccattataaaacgacgaacttgatacaagcccgtcgtttaagattactgttcattttaggcaaacaaaccaattgagtcaactggtttttactacttcttctttcttagacgtaacggcaaataatattgaaccatcaaaaccacttcgatgagttcaaccgcaaacgcaaccagtccaaccgtcaagtcttgattagcaacacagaccattaccaagaacagaactgcggtgatgccaattaatgaaaacatcaggcgtctaaagctgttcacccgttgtttttcctcaacagggtatagatgcgtaaagacaatatcatcaaactgccaataaaacggaatcagctggaaaccaatcagatagaggaatagcgcagccaacgccactggcagccacgtcccacgaacgaagtagagcaaaaccattcccagaatcgtcaaccgggagtacaagccgctgaactccccactacgaacgatgccacggctgtaaagatagagatacgtgttctttggcgtaatcttgacaatgttcaataaccagtctaaataacggcgccgtttagccacccctttgagcatgggaacgttagtgaataagttaaagaatcggtagacgcccatcatccgattattctccaacgtaatggcttgccaccagtcaaacggtacggcattataacgtttgtccgctacccgtaaacatactgccaaaacaagcgccagcaacgtgccaaccatcggcatcccatacacactggctactaaaataatcaacggtaccacccatttaaaccagactgattcttttaaccaagctgatttaacctgaaaccgtctgacgattgctaaactgaacaaactatcttttaaaagtagttgtgcaaccgcaatcaaagctaactcaaacactggcatagcatccgtcacctgaatgaacgggagcaaaacaaacataccgaacaactcgtagacaactgccaaactttcgctgtatgtacgggcgccactcaaatactgacgaacttcagcttctttgggcaacaggaataccacatcagcgtcctgaaacagcgtcgcaaatcgtcctaactgcagcaccagcagcaacacgataacgattaccggcttggcccaccaaagattcggttgcaattccttcagcccattggagtacgcatatcccaaaccaccgataaaaatcagcaacgcaaaaacaaagtggtcgttgaataccagtcgcaggtatttaaacatttcttttaaatgactagacaaacgctgtcggtataaattattcatgctgatccgccctcgtcattgacatgtagatatcgtccaaggattcacccgcatccggcagagcttggcgtaactctggtaaggtcccttccgttttaactgtgccatcatgcagcaacacaaaccggtcgcagtacttttcagcggtgtccaaaacgtgagttgacatcaacacactggcacccttggccttttgttcgtcaatcaaatttaacaggtcatgtaccgccaatggatccaaccctaagaacggttcgtcaatgatgaataatggtgcttccgtaataaaggcacacacgatcatcaccttttgcttcatccccttagaaaagttagctggaaaccagtctagcttattatctagtcggaaaatgctcagcaaatgattggccttttgccaagctttatcacggtcaaggctgtacgccatcatggtcatttccaaatgttcttttagcgttaattcttgataaaggatcggtgtttctggaatataagcaatttgttttttatagccatttttatcttcgtttaaggtaagtccgttaatcttgatttcacccttaaagggcgttaacagcccaataatgtgattgatcgtggttgatttacccgcaccattcagtccaattaagcccacaagctcgccatcttgaacatcaaatgtcacttcttttaagacgggtatttgtgaataaccgccgacaactttggtcacctgaagcgtcatgaacatcccttcatttctctgtaattttggtcaattgttttcattatatcatacgccggggtgtatggaattttggaataatgcgttatacttaacgtaacttttatgatttttaaaggaggatttaaaatggttcataactatgatgatgattgtattttctgcaaaattattaagggtgaagttccaagttacaccgtctatgaagacgatgatgttaaagcctttttggatatttcacagggtacccctggccatactttagttgtacccaagactcacgttgcggatatctttgcctatgacgctgatttggcagccactgttttcagtaaaattcccgcaattgctcgagccgtgaagaactctaatcctgagattaaaggtcttaacattttgaacaataacggtaaagtggcttaccagtccgtctttcattctcatattcacctcatccctcgctacaccgaccacgatgatttcgggatgacctttaaggataattccagcaaatatgatgaaaaagcttatacggatattcaaaatgccatcaagtcacaattttaatttgaggtgatgatatgaaacgatttttaaccagtgccttattcacggctggtgcttcgttagctgttcacctttaccgtaaacagcagtcgcccatggcttttgttcaggaaacggttgatcatgtccgggctcgtaagacagcgctaaataacgttagacaacaggccgcggtagttcaatcacgtttggcagatctacaaactgaactcaaaaaggcacagccagccattgatagtatcgaatcggcagtggatcagtttcagttcaaaattcaaccacatctggatgcgatcaatcagcgtgcagccggtctagagagcaccgactcaaataaatagaagtattcaatttttattaagttccctttacagctgaaaattattttgagtttatgttatattaagtaagatgtcccaacgggatgaaactaatctaaagaaatggatgtgttttcagatatgaaaaaatggttcgttgctcttgcaggtgtcatgttaagcttgacccttgcagcatgtggtagcaaaacagttgccaccacttcaggcggtaaaattacggaaagtcaattttacagcagcttgaagaacacttctagcggtaagcaagtcttacagcaaatgattttgaacaaagtgcttgataagcaatttggcagcaaggtaaaagattcagacgttaccaaagaatacaatagttacaagaagcaatatggttcatcattcaactctgttcttcagcaaagcggtatgactgcttctcaattgaaacagcaaatcaaaagcaacttacttttgaaggaagctgttaaggctgataccaaagttaccgatgcccaacttaaagatcaatttaagagttaccaaccaaaggtcactgtttctcacatcttagtctctaaaaaatcaactgctgaaaatgttatcaagcagctgaaccaaggtaagagcttcgcttcattagctaagaagtactctactgacagtgctactaagaacaagggtggtaagttagatccattcgataacaccgatactcaattggattcaacctttaagaaggctgccttcaagttgaagactaaccaatacaccaagacacctgttaagacttcttatggctatcacgtcattaagatggacaacaatcctggtaagggcacttacaagcaacacgaaactgaattgaagaaccaaatctatgacaagcgtatgaacgatagcgcaaccttgaagagcgttgtatctaaggtgctcaagaagggtaatgtttcaattaaggacagtcaattacaaaacgttcttgctgactacttgacttcaagcagttcatcaaagagcagtaagtaattctgctttaaccaaagtattaaaaaggattgaaattcctgacgaaaatcaggaatttcaatcctttttgttttgagttatttttgattctcttgaccgccaacttgtggctgattcggccgataaaatgaacggccatccatggcaaataaccgttcaccgaattcgcctggcgttgtcttttctactgcattagttaccatcatgattgaagcatccagttcatccaattggtgtaaaatttcggcttctaatagacgtggccgaactggcgaaccatactccaacaagccgtgatgagctaaaatcatgtgtctaagtaaaacgacatcttcgttatttaaatcgaatttaagttcgttgcaggcagaaacaatctcaccatccacaatactaatgtggcccagcaaattcccctccaccgtgtattgagtagaaacggggccggacagctcaatcactttcccaagatcgtgcaatatggcgcccgcatacagcaacggtgcattgatcgatggatactgattaaccacgctgtgcgccaatcgcagaatcgacagcgtatggtatgccagcccaccttgaaacgcgtggtgattatgtttggcagccggatacgtaaagaaggcatcgcgatgcttagcgattaaatagcgaacaatacggttccagacctggttggtgatctcaaataccacctgatttaattcgtcttccatttcgctagctttcattggcgcatgaaccacgaactcattgggatcattgggttcatccgcgtttgccaatcttaaagaaccaatcttaacctgtggggaaccctggtaattctcccgtttaccggccagccgaaccacccgacccgctttataacgctcaatatcagcagtgctggcatcccaaaacttaccagtgatctcaccagactgatcttcaaatgtcagatcaaggtactgcttaccatttttagccacccgaacgttcacgtttttcaggagcgccatcagattcatctgttcaccaactgcgtaagccattaattgtttttctgccatggttaatcccccttatttacactaattctacagtttttcaaactgactttccagcatccaaacgatagacttcactcttatctacgaacccaagattatcgtggttcgccgttaaataaataacctgacttgtttgagctaattttcttagcattttcaacgccaactgtgtccgctgacgatcaaaattcacaaaagcatcatcaatgatgattggcatcgcgatcacatctgccatcactttagtgaacgcaaaccgtaacgcgacgtataactgttccgctgtaccactggataactcacccacgtcaaaggtcaaatcatcatgacgaataacttgaaccgtctgatcagtaaataccatttgcttataacgaccaccagttaattcttggaagaactgttcagcaaccttaatgatttgcggctgacgtccctgtgacgcgttaattagtgtttgatcgatccaattgatcagaagcttctttgttagccaatcatcagttaatgaaagaatttccgcctgtaaatcagcttgctgctggagtaaattctgatacttatcactggatgctaagcgttcaagttgatagtgttgctgactggactgatttaataagtcggtttgtttttgctgcttgagagtggtttgagtctggatactctggctgaattgctccaatgctgctaaagactcagtgtcatccagaatttctctgtcagcctgcgttaactgagcattcaggacactcaatcgctgatcctgttcagcagttgcctgatcttgctggtactggcgctcaaattcagcaaatgttgcaaggtggtactggaccaataattgacttaacgcggcctgctgctcatctaactgctgttgaagcttcgtttggcgttgtgtactagcggtcaatgactcgtttgcccaatgcagtttctgaccttcatcgcgcctctccgacaagaattgatgaatttgttgcaattgataagcctgactgcctcccaaactaataatttcaccggcaaattgccattgtgccaaaaaggtacggagattttgattaacctgattttgttgttcctgaagctgaatttgcttggatttagccgcttgaaacttaccaatatcagcttgtaaatcaagccaccgttctggtgcaaacccctgcagttgatgttcagcaccaaactgcgttacttgggcatcagcatcgatcagctgctgatctaggctggctagttgctggcgatcttgatctaactgagccgacaacagcgccatttgagaatcaatggcggattgctggtttcctgaaataatcggtttaaaaataccgtaacccgcaatcagcataccaaggatgccaccaatcgtccgtgccaaaccacttagggcaaacaaagcaaccaataccacacccacgccaccaatcaaccacttaagatccattccagaagtcgagtctttatctgcttgttgtcgtaactgctcaaacgttttttgatgttccagccgttgatcagcacgtgaatcccgttcgatacttaagtgttgctgctgatcgaacaatccttcaatttgctgctgttcactggttgttaacactctaaggttggccaatgaagccccatattgctggcttaatatttctagctgctgttttgcagccgtaagctgattttcattttgctggtgtcgctgttccagttgttccatggctgacatctgggcacccaactgatcaatctgctgttgatgactgatataaaattgctgtgcttcgctgggcatgtgtgcctgacgctgctgcttaatcgttgcttcttgagtagctaaatcttgtttcaattgtctgatagccgttgccagttgcgtagccttctgccagtcagtacgactgattaacatggttctttgaactggtgaactgttttttagttgctgatattgtgggtagagcttaattaaacgctgatattgattctgttgatccctgagcttttcaagttgctgttgaatttccgacagtattttagccgttctttgcgcgtcgacttgtaatgtctgatactgttggaactgagttttggccgtttcaattttatcagccatttcatcgtattcccgcaataatcgtactagtggctgaactcggccgcgaggtttatataactcccctgccgaagctgtcagctcctgcgttaatccaatccagttttcactgccaatggcgccaattcgctggattcgcttcactaaatcaaagcggttcaagttaaaaacggcctgcagttcccgttcgccaaagcaaaaaatttggtaaaataactccttatttaagggctgcaataactgtgtgagatcttccttagataaggacgtatcagtggttaaattacggaaggtcactttaccaccgtgagtaccatctactcgttttaaccaataatcattttgattatggttaaaataaagttcaccgccatattgcgacccttgcttaggctgatacatcgcgtaacggtgttttgcagtttcaaacccgaacaacatactggaaatgaaagcaactaaagtcgattttccagcctcattttcaccatacaggagtgaaaaacgcttcgacaggtcaatggttgtatcatgaaacttaccgaacccgtaaattttaatcgtcttgatctgcatcgttttcttcctccaaacgggattgggctaaaagttcgtttttggcccgatcagtcaaatgacccgtggtttctggattacgcaaatggtctgcaataaacgaatactgcatgagtttaccagcagtcatctccacgttatcttgcgtaaagactgttttctgggcatcttgccaatattcagcgtctagttttgcatactgtactggccgactagttggcaacacattaacttcatagacccaagcttgatattggcgataaccttttttctgagtttggtcaaaccgctcaagccaggtaccatcgtttaaccggctcagcatactagcagacaatttttcaatcccggttagtcttaaatcaattaattcgaacacagtcgcttttcgctgcatcaatgctgttcgtacggcttcaatcagactggtatccgttgtattctcatccactgccagagttagtgacgaccagcgaacttgatcaacgggcacaaattggctctgcagacgttttccttggctggccacgagctggtaaccatgttcaccggtttccagtttatgacgaccctgaatggtaccagcgtagactacagggggggtcttagttagtacgctgggtttatgtatatgacctaatgcccagtaatcgtaatgcgtcgccgacagttcactgaccgtaaatggtgcgtaatgatttgtgctaccttgcttaaccgccccatgcaacatgccgatttgaaagtcaacggatccgcgttctggaaactgcgggacaacgtcttgccccagccatcggtcagcataactaaagccgctgatagcaactcgggtgtgatctgcagctgtcagtgttttagtggtcacgtcactgccaaaaacagtgacaccatcaggcaaactaagctgctgatcccccgtcaaataatcgtgattaccaaatgaaacaaaaacagtgatgcctgcatctaccagacgctgcaattgttcatttaaaaatacctgagcttgaacactctgcgtttcacggtcaaataagtcacccactaataatacaaagtctactttttgcttgattgcatcgtttaccattgttttagtggcattgaacggtgcttcgtgaatttgttgccacaacgctttgggtaatcgctgcaaaccttcaaaaggactgtctaaatgtaaatctgctgcatgaataaatttcacagtcgtcaactcctaaaaaaacgccgaagaaaattcttcgacgtttttgatctattaaccaacgattaaacgcctgttttagttttcgtacagggcttggattggttttgtaatttcgctgtttaatttagccaataactggttgacgtctttttctttgtccatcaaatctttaatggcgtccttgtccctaacttttccggcaaggtcctgtgcctgcttcatctcatcttcatcaggctgttgtccttgcatttgtttttgctgtaacttcaactgcagtccctgaaattgtttgaataaatcataggcctctgcatcagccttcatcttgttataagaattttgtaaagctgtgaattcgtcagaactagctaactcatcgcgtaactcaccagcggtttttaaaatgtctgccataaaagcatcctcctgtcttcaatactttcatattgtatcatgaaatgatagagggggaaagaacgctgtgtgagtttgagggtgagttttttaacggttaaacatttccaacgtctatttatttttctctaaacgtgtgtcgtgcggcagagacctgcatatagtgaagccccatcacaaacccaagttcatggtttatggtgggggcttcactatactccggtctctaaacgccttactcccactctctattgtccaaacgtactctgccaccactttttaacggtgttcgcagcgttattggcaccttgttgaatctgatctccgacgcttcctgcgccctgttggacgttatcccagaaattattatctgatttcgaagccttcgccaacgttgacgcgtcctgcgtgtcaaatttggtttgtttagtatacggcaaaatttcttccatttcagtcttaaacagtggtccaactcccgtgccgcttaagttttccaaatggtgatccttgttcgtactgtcgaaaccttcccaggtggttaagacaacatcgggcgtgtaacccacgatccatttatcacgggtggcatcaccgtctcccgtatcatcagcttcagtactacccgttttaccggccactgaatacccatatggcttggcatcaacaccagttccactgttgaatactcccagcatcatactggtcatttgttttgcaacctttggcgtcatcactttatgcgttgagacttttggattatcaacgatgacgttgccggaagcatccacgatttttcgaatgtagtgtgtatccgttcgtgtcccattattggcaaaagcggtgtatgcacccgccagttcctgaggtgaaacccctttactcaagccacccagtgctaacgccagatttttgtccgacttcgtcactggaagaccaaactttttaacggaatcatagcctttattaacaccaatcttatttaaaagccaaactgctggtgcgttcacactattagccaatgcttcatacatgggcatcttaccggtataaacattgttataattctttggcgtgtactgattacttccgtatgaggtcttcttattttgcagctccgagtcgtagaaatagccattctcaagcgctggcgtataaactgccagtggtttaatggttgatcccggttgccgtttgacctgcgttgcccggttatagccacggaacacatgcttaccacgaccacctacaacggccattacaccgccattattcggattaatggccactgatgctgcttgaactttggtaccatcaacagcattttgagggaataaataatcactcttaaagtttgtttgcaagctggattgataattttgatccaaataagtgtaaattttataaccatgattcataatatctgattcggttaacccatatttggaaattgcttcgtcgatcaccgcatcaaagtaatatgggtaacggtacgaatccttatactgatacgtatccgctgtcgccaagggagtttgctgataacttgctgcttgtgatttggtgatggcccccgtctcagccattaacccaagcaccacgttgcgacgatcctttgatgcctgcggatgatcaattggattaaaaccacttggtgacgtcagcattcccgccaaaacagcagactggggaaccgttaaactcgcagcattcgttccaaagtatttatgggcagcatcctgaacaccccacacgccattgccaaagtaggcgttattcaaatacatggaaagaatatcctgcttggaatatacgttttcaacttcaatagccagaaaaatttcctttaattttcttgtcattgtttgttcctgcgtcaaaaaagcgttcttaaccagctgttgggtcagcgtactcccaccaccactaatatagtctcgatgaaggagtttatttttggctagtaagtaaaacgcccgcgcaatcccttttacggaaaaaccgtgttcgtggtaaaaattacggtcttctgttgaaatcaccgctttttgaacgttaggcgaaatcttactcaatggtacatacgttcctttttgagcgtacaatgaccccgctttatgattactcttatcgtaaatatacgttgttttttccaactgggcttttaaattaccgacattagccgttttagcctgaaaggtcaaagttgcactaacgacgaagaccaaggccaaaacaatgacaataagccatcgtgttaactgatagcgatgccaaaatttgccaaaatatcttttaaagctttgatagtatggtgataaccaagctctaaagccctgttttgatgaatttccccgattattattcattcgtttccctcaacaagtaaaagatttgcacttttaattctatcatattatataaagatggctaaaaaagccgtaaatttttaacggagcttaaaaaacaaaaaggctgtgccataagccgatattggtaagtatttcaatcaattgttagccataatagtgatgtttctatatgttaatatggcctaattacgcgccaaaactcagattccggccatttaacgcaaataatgcctaccccgcaaaattacggaataggcattattcacgttaaattctggaatctaccgagttttgtcacagcttgttgatttatacctacaaagcgttagtgaacaatgtcaggattcatatttttggcaatttcctcgttcaactgctgagcaacatcggcatttggactaatcaccaaaattgtatcatggccggccaatgttcccacaacttcaggtaattttaaatcatccaaaattgcggctaacaagttgccattacttggcagcgttttgatcacgttcataaactcaatctgtgtcaacccaatcacaacttcattaatggtctcacgcagatgttcttcttcagatttatttccgggtttgaaaattgtgtaacgcaagtgtccatggccatcctgggctttgacaacctgcatctcacgaatgtcacgtgagattgttgcttgcgtcgccttaatcccaatttcatttagatgacgcattaggtcttcttgtgtaccaatcggatactgattgatcaattgttcaatccgtgattgacgaatacttttcttcatcctaatgcagcccccttactgtataatacgtgattattataacaaaatgaaaaaagaaaagaaagctcaattttaaataactattcaaagtgagcataaattggaatataaattaaccatctgacattcaaaaattcgctaatagtgctaaaaccattactagcataattaatattaatgcaggaatcttctggatacaatcagtaaccaatcatttagaagttaatatttttttaatgttgcctgcacaccaattattttttaacacgaattataagcccatcctcaacgttcatcaagtcaccttcagaataaaaaaacgtctggaaattaatccagacgcctcatgattcataatctatggcttacatttcatccggtgcttgaacacccaataagcggagtgattccttcagcacagttgaaacactcttaaccagtgctaaacgagcaggcttttctgcgtcatcagccaaaatcttcgagtgagcgtaatacttgttaaatgatttagccaaacgaatagcgtatttagcaatatctgaaggttcgaattccttcagggcttcaaccactgtatcagggaagtcagccaaggccttcacagtctcccaagcttctggatcagagatctttgcaccatccgttggaatggtaacatcagctgccttccgcaagatactttcggcacgagcatgagcatactgaacgtaaggacccgtttccccttcaaactttaattgttcttcaaggttgaagtcaatactattcatccgttcgttcttcaaatcaccaaagatgatggcaccgacaccaacttgtttggcaacttcatctttattaggtaaatcagggttcttagccgcaatctgttttttagccatatcgatggcatcatccagcactgcatccaatagaataatccggccagaacgagttgaaagcttcttaccatccacagtaatcaagccgaatggaatatggtgcaagtccttagcggaaggtaagcccatttccatcagcacagcctttaattgtttgaagtaataggtttgttcagaaccaacaacgtaaaggttcatagctgggtgataagtgttctcccgataaacagcagtggcaatatcacgtgtaatgtaaagtgaggcgccatcactcttcaaaatcagggctggatttaaatcatacttttcaaggttaaccacttgggcaccttgagattctttcagcagacccttttcctttaaggtatcaataacagcttgcatcttgtcgttatagaaagcttcaccattataggtatcgaatttaacacccaacttgtcataaatcgcattgaacgcctttaatgattcgtcacggaaccatgaccaaagatgatgggcttcttcgtcaccattttccagttttctgaaccattcacgagcttcgtcatccaattctgggtgttccacgtcttctttatggaacttaacgtagtacttaaccaaattagtgattgggtccttcttaacgtcttcttcgttaccccacttcaggtaagcggtgatcaacttaccaaattgagttccccagtcgcccaagtgattatctttgattgggttataaccgttctttctcaaaatttcggcaattgaatttccaatcaccgttgaacgcaaatgacccattgaaattggtttagcaatgttaggtgatgacatgtcaatcggcacgttaccgttattaccagattggttttgaccataatcggcaccctgtgtcaaaacgtcattcaatacttgcgcactaaaagccgttttatccaggaagaagttcaggtaaggaccagcaacttcaactttttcaaatttgctggtatcaatcttttcgaccaagtcggcagcaatctgctgaggggcctttttgaacgtcttggctaacgtgaaggctggaaaagcataatcacctttactcgtgtccttaggccgttcgattttttgataaatatcctctgctgaaaggacgtctgttaatgctggtgctaacgtatcagcaacaaattgtttgtaatccatgaaattaactcctcacatattaaattctgactgctgttataaccgactactgtggatctttgggcaacaaaaaaagtccctctcctacaataaaaaatgtaagagacgagactacccgcggtaccactcttgttgatattactatccactcaacttataaaaatgttattctaaaaagcgcgcttcatcagatcggctgcttggcttccatcactccaaactcgctgtaaaccaactaactgactactcttcttttatcattgaactaggttaccgtggtaacctcactcattgcattctataacatctggatataaagcacaaggttaatagttattttttgatattcactcgtttgcaaaaatcattttattaaaacaattctcatttaaattcacttttcattaaagtttgatgtataataggatattatattcaattttttacattttattcattcacgaaaggagtttgaaaatgagtcagaaaaagagggcttccacacttttccttcgtaaagatatcaaaaccgatctttataagaaaacggggctcgaaaaatccttaacagcttttagtctaatcaccatgggcgttggcgcgattgttggagccggaatcttcattacacctggtatcattgcagcaaaatatgccggtcctggcgcgtttctttcatttgtcgtagccgctgtcgtttgttctctggctgcactatgctattctgaattctcttcgactattccactagctggtagtgcatatacatacatatatgctgttttcggggaatttatcgcctggatattaggctgggcattggtatcagaatatttattctccgtttcagcagttgcagcaagttggtcatcgtatttccaaaacattttagcgggtttccactggtacctgccggaagcgcttcgtgcagcctacggaactgctggaatgccacatgcgatttttgatttacctgcctttatcatcatcatgctgctttcgttcctactaatcggcggtgtacgcgaatcagcccaaattaacgccatcatggtaattttaaaaatcatcgtgattatcttatttattgttgtgggtgtattctacgttcgtccagagaactatcatcccttcttaccattcgggatgaaaggcatcgtttccggtgcagcggttgccttttacgcttatatcgggtttgatgccgtttcaactgcagcagaagaagttaagaatccgcagaaaaacgtgccacttgggatcattggttcgttggtcatcgccacggtgctttacatcgcattgtcgctggttttagtcggcatggtgaagtatacaaaccttaacgttgctgatcccgttgcctatgcgcttcacttcatccaccaaaactgggtctcagggattgtttcactgggcgccgtcattgggatgaccaccgtgttaatggtgttcttatatggtggtactcggctggtctttgcaatcagtcgtgatggtctgttgccacggacgttcagccgtctaagtccgaaaagccacgtaccagttactaatacttggatatttggtatcttaggcagtttctttgcctgtgtcattccaatcgacaagattaccgaactggtaaatattgggacactattcgcatttgcaatggtttccattggtattgttttcttacgtcgaaatcccgaatttaaagaacttgactcagcctttcgggtgcctttctatcccgttctaccgattgtttcatttattctttgtatcacgttaatgttggaattgaaatcattcacatggattgccttcttcatttggctggcaatcgggctagtattctacttcagctatggttaccgtcatagtgtggttcgaaatcgccacaacgctgaacaataatgggtcaaaaggttgtgctataagtctatattggtaagtattgcaatcaatttctcagtaaaaattagtgatgcccgcctttcggttcaatgcgtcaatattgcctaatcgtgctccaaaactcagattcctgccatttaacgcaaataaaacccatccccgacaaagatcgcccgggatgggtatttatttgcgttaaattctggaatctaccgagttttgtcacacactcttacaaaattcgaataaccattacaccaacgatcatgatcagcaacccaccaatttgcaacaacgtcaccgggttcttctcagaagctagccagccaaactgatcaatcaagaggctaccaatcattaaaccaatcaaaacaataatcaccgcaaaaccagttccaataataggtaccagatagacattgcctaagacaaataacgcacctagaataccaccaagccacatccaccacggtgtatgaccattatctcgctgaaattgtaatgtaggtcgcactactaatacgatcacaatcaacgtcagcgtaccgatcagaaatgacacgtacgctgcctgaattttagaacccaaaacttctcccagatggccattcacagcagtttgagttgcactgaggattcccgctaataccccaaacaaccgccataccatcaaatgagctgtcttcggtgtttcattactaaccgtttccagtccggcttggccagtaatgcgttccatccagctattaccagcaacggtaaccatcacaccgaaaagaaccagcaaggcacctaacccacgaactaacgtcagctgactaaccggcgaatagaatagacccaaatcatcaatcatgagaccagcaagaatttgccctagcactggaaaaataacggtttgaacacttcctagcttaggaaataaaataatattgccagtcagatagataacccctagtaagccacctaaccataaccaaaatggctgagcactgatcaaagaaccactgatcaataagccacgatgatcgatgagggtcatgacagctagaaagattgtgccgataccaaaagataccagcgaagctaaaaaaggtgagcctaacgctgctcttagccgtgaattaatactcgtctgcatcggtaaaccaatgccaatcactaatccaattaatatcgctatcaaatccatcaccccctaattaatgcgggtagtatgcccgttcatcaagttaaagtcaactaacttcacttctactgctctctccaattagccgatgcctgtcctatttcgtaaaacggtcaattggaactgccttaaagatcatcgaaatcaaaacactataaatgacaaacgaaattaattcttgcgggatccgggtcgcaaacagcacgttccaagtcatgccatacatgatatgaagccaaagactatttaatagtagattccaacccatggtcacaatgaaggatgctaataaaatgcgccataaaacaactggcttttgataaaataatttgccaagcgtataaccggttaaaccagcggtgatgagaaagccaaagaaaaaactaaatttaggaaacaacagcatcccaatcaaacttgacatggtagttgcagcagccgttaatttcggtggaaacaagcgcgccataatagccgttacaataaacgaaaacgtgattttcgtgattaaaaattgaatcgataagaaactgcctaaaaccacctgcatcgcaatcaaaacgctcatggcagccacaacgtacgcagaactaagtctcatctctttcaaactgaaccaacctcttctctcaaaattaataaccgtatgccaacagtcataatcatatttaactataattcaacgcacatgccaacggattttgagaattgggacaaaaaaagcggtttgcaccgctacgaggccgttaactgaatcacatatgggccatatttttcaatattcacaattttcacggggagttcaaaagcgttacttaacagttgttcatttagaatttcgtctgcaggccctgctttaactaattggcccgatttaacgagccaaatctggtcgctaactttcaacgcttgattgatatcatgtaaaatcatcaccaccgtcagttgctgctctgcattcagcttctgaatcagcgccattaactcattttggtaccgaatatccaaatacgtcgtgggttcgtctaaaaacaggtattgcggttcttgcgccaatgctgcggccaaccagacccgttgctgctgaccacctgaaagcgacgataatggtcgattcatggcagccgctaaatcaacgattcttaaaaatggccgaacttcatcatcagaaatggtagctagtaatgaatgaaacggtaatcgtcccgttttgacaacttctttaaccgtcatttcatcataaacttggtgttgctgagtgaccagtgcaatttttgctgctcgttgtcgcttcgacaacgtttcaatcaactgaccgtccaattcaaccgttccagtatcaggtgaaactgagcccatcagtaatttcagcaaagtcgattttccagcaccattttgaccaataatcgacaaaattttcccattgggtaccgtagccgtaaaatctttgattaatttttctgatactgggtagccataattaacgtgttttaattccatggaatccccctctttgaaccaaaataatcaagaacggaccgccaataattgccataatggtggcagccgagatttcactaggtaatattacgatgcgaccaatggtatccaccatgagcaataaccaagcaccgcttaacattgaaaacggcaaaattgtttgataatcatgaccaacaaaataccgggcaacgtttggcacgataataccaataaacggaatcgtccccacgtcggcagtaacgtcggcggacaaataaacgactaacgctagtaaacctagtcgcatagccgtaactggaacaccgactgaagataactgttcatctggcagtttgagatcatttgcccatggtgccatcagcaaaacggcgactaaccccacgaatccgttgattaatagcacgtaaaccgacgaccaagtaatgccgttaaatcctaacgaggtaccaacgttgatccctttggtaaataattgcgttaatgccataaacgtcaggttcagcgcaaccccaacaatgatcagctggtacggttgccgtaaggtttttcggttggctaataatgcgaaggcaaacaaaccacccatgagcgcaaacaactgtttttgaaaactaaagacaggtagcagcatcccgccaatcagcataaaaagttcaccggcactagtcacgcctaaaattgttggatcggccaatcgattacgaaaaaccgcctgactaattgcaccagccgatgccagcatcccgcctgccaccattgctgctaaaatcctgggcagacgaaaattgagtaccgtcgacaaaatctccggccgttcgcccatcaaagcttgccacagttgaaccaccgaaaaatcttgtgtacctagcattaaagcaaatatggcggtaatgataagcgccatacagattaaaatgtaagcgacacgttcctttatcatcttattgactccctggatacaaccactgcgacacttcacctaacgcttttgcagcatgcatgttagccgtagcatcaaagtcgggttcccgtaaatcgtatattcgctttgactgaactgctggtgtctgtcgccaaaacgattgcgttttaaaatcactattgaactgttcagtcaccattgcgggcatggcgtgttcgagacgcaaaataacttgtggctgcgccttttgaatcgcctcatcactaggttgaatatactcttgattcttggaagtaaagacgttctttccacctgctagctcaactaaattaccaacataagagcggttagtggcaatcatataaccggcaccgggcaatcccatcagcacaagcacccgtggcttttgccgatgattcgcacgttgtttggctttagaaatagcctgattaatttcttggttagcggccttagactcactcttgcggtcatattgattacccattgttgtcaccacgtgctgtaaatcactaacactttgtaaattcaaaaagtagggtttgatgtgttgctgcttaaatgatttgccaaactggtcctttagcgtcgttacgctgtaaactgctgtgggtttaactgaggcaattttttccgcactaggattcattggactcccaattttggtcacgtttttatatcttgcaggcattttattggccgtattcggcacaccgaccaaaggcaatttcaatttatcagcaatttggaccacggcataggttgtcgccacgattcgctggtgatgacgctgtttagccagttgatggttagcaaagtaaccaccaaatacccctgcaatcagcaacacgataacgacgattaaagctgttcgtcttggcgatttcaagattgcgccccctattccttctttttcatgacaattaagctaccaccaataaccacgaccacaatgacgcccacgccaacaatcaaaaacggcaagcgcgatgtggcattactgtgatcttttttatctgccgaagtggtttgaggcttagctgacgatactttagctgcactttcactagacgctttacttgatgcagaggacgaatcagcagctggtttttgactggttgcctttttttgactacttgggttatttggtttatgactgtctaactgattaatatccctgttttgagccgatttactgtcattggatggttgcccgattttagttgaggacacccctcctgtcacttttgctgtggcggcagtggcagctgccttaccttttaaacttggtagcccattcgtactgaacttaaacgaaatgagatgagtcgccttatataccttaggcacgttgattgccagtttagcattgattcgtttctttaaattagttgttgtaaatgaataatacaaatttgaatttccagcaccatcctttacccgacgaacatttttaggtgacccaccgttaactgagagcactttaacgggatacgaggtcagcttcttagccgttcgaatgtgcattgtcacaacatacttatggtgagagactgtgacgctggccggtttaacaaagtagccactagccatggaagtttggttggtattatattttagcgcttgataattcagcgattttgcttgcgctgttgcaccgctggccactaagccaagtccaaaagcagcgacagccaataatccaactaaccatttcactcgtttcatgattttccctacttcctacatctattttccttactaacagtcacaaagaccattccagtttaatctcacctgaatagtcttggactaaaatcattagactcgttttcttctgtaaattgcggtggtaacaatcataatcaaactaaggaaaccaacaactgcgatagtcgcgttttgaatttcgcttgtttgtggcaatttacttgatgccttttttgaagttgcagtcacagctttagcaggtgtttgagaactgctacttggtatttctgcggcagctgaactattggcgctagtcgttccggtgccatcagaagcagtcgcacccgtgaagcgatagtaaatatcaaaatcagaactaatatccatcgttggaactgagacgtgaatcgttcccttaactggtgccttcgtcaacgcatcgaggttaggtacagtaaaactaaaactggcagtatagtctttgtcagttgatccgtaagtcacatcagatacctttttgccatctacagttagcggaacaaaacctttagctgacatacccgaatttttaccatactgaacgtgcatggtgactttgtaggaaccgtcgcttaatttttcaatgttggcaacgtgagtatagtacttgtttgcttcagaaactgaactaccgtcagattgtaaaacggtatagctaagtttagaaacgtcagctaatggggtgcttggattacttgagttacctgagttacttcctgagttacttgatgaaccttgtgcaccatccggaacggttgcaacaacggtgccgttaatagtaatctgatatccagtgaccctaccctggggatttttgacttcagtagtcgttggagttgttccgttgtcaacggaatcaaccttgacaccatcgacgtaaatatcatagccactgccatcagtttgtggcttaaattcagggattttaccattagcaacatcaaaattaacggctgcttgatctgatggagcaagggtaatagtcgtactgattaccttacctgaagtatatgtgtgcgatattgtcgtgactttgggaagaacatttgcatcagttccgttatcggtcttgtcttgtaaatttgtactcgataccggcacttgtgaacttgaagtgtcagattgttcacttgttccagtagacttagcattctcccaatcaaatctttcataagctgaaggtgacatatctagcagtggtttaggattaccaggaatagttaatacaatgtggtagtcaacttgaacctggggtgtttcacctgacagcttaaaaattaaatttccaccacttaaaattgaagaaccagacatggaagcactttttaaaacattttgccctgaccccgaaattggtaccgaaaccgtatagataccattgcttacggtcacattaccagtattacccaaatatgcttgagaagcacttgtaccgccagtatccttgttaattgaactaactggtactgtatatgttccatcagccaaagcattagctctaacctgccccgcaacactgacactcaccaacgtcacaacaactaaaaagattcccccgaataatttcttaaaccagtttttcttcataaataattcctccgatactaaaacaatttattgatagccagaataagcaatacttcctgctccagttactcctccaagaacaaatagaacagttcacaaattagaaaatatataaagtgcctccacgttgagaattatacctcgaaattaatcataaataaaacaaaaaagcgtaaattcgtgtatcttttcactaatcaaatgataaatatatatatgcttatcagctgatagtaaagggttttaacggttttattggtacaatttggaaaatgttgttatcttcaactgaatgtaaaattttataaattacatcacagaatagtgctggaaaccatctaatatacattattggaaatttctaatattctgtttttatataaatagtgtaaataaaaagcccaccggagtgagctacttaagaatcatcctaatttaaatggtgttgaaattgtgacgttgatggcctgatgaccatttgccacacaggattgtgccacgtgactcaataaatgatgagattgaacataggctctaaactcagttaatttgggcacctgcaactgaagccggttagcggactgatcaacttcaatacggtctaactgacattcctgattaagtcgtaaaatgacggtttcaacaatttccaacacaaacttactattcgtcaggtagttaatgttggccgtttccaaattaaacttcatggaaccagttgttaaatctttatgctcaccatccaccgtagcccgataagtcaccacaatgtcgcgggtagtcaccttatttcgaatctttaatgtataagcaatcactctatcatcccctgtcaacagtctgacggacccatacttcatctaaacatcatcatcctaataaccggtcccaccaagataatactcctactgctggcttacatctattatgttactaatttcacagcttaattacaagcgtttatttatcgatacgattcgctattttgaatatatgtgatttcatcgaaagaaatacgctgctgtagtttttcagccagatcagcggaaatatcacctttggcaatagcgcgctgtacaagttcatactcagcatgaaacgcacgcataaagagttgataaaccatattaggatcgacatcaccaccgcgaattcgccggtgacgcgtacggtagaagcgacgaacaagattggtctcaaccccattttcaccgctgttttgttttaaataatccatgactgcctcaaacccagcattttcgattggcaaaatatcctcaccgtgtttttcgaactgttctcgccaataaacttcctctagtgcaattggagcggttaagaaagcttcctgcgccctatgcaaatctttataaagagtaccaatatgcaaactaaaccgaatcctcaaccaaacgttcttccaaactttttcatcagcggaaaagtgattcaattgcaaaaaacgattatagtaggtcatctcatcttttgtgatttgaccagcttcatacatttcccgaattttttgactttctactctatgcgtttgtcgtctaatttgacgttcaattcgcaaattaggtgtcgcatccaaaatcaattgctgctgaagggaatcaatgacaatttgagcttcgcccggatagtccttttcacccattaaatcactgatacccgcttgaatcattcgccggacccacttaaattttggctgagaggactcctgactcggtaataataatggtacgaaaatagttggcagaatcaaactggttaaaatcaccacggctgccagaaaaattaacggtccccgcagcaaaaacgggtgaccattcaccatcgtgggaattgaaaatgccagtgacaacgtaatcgtaccgttggcaccactcaaagccatgaccaaactgtcacgccaaacgtgatccgtttttgtcctacgcttgagtaaaaaacgcgtccacaaaagtcgaataattccctttagcgtataaagaaacagccccaacgccagtaatttaataatcgtaacttgcgcattggtatgggcgtttaaagcccgaataacatctggtaacgataaccctaagagtacaaacaccgttccggataaaacaccactaacaatttcccaaacgttactggtaactagctgcatccgtgacgaaatgagtcctaatttatcccgttctgatccttgaaccaaaccagcagcgacaactgccaaaatgcctgacaattccaatttttccgccagcaaatagaccaaaaatggcgttaataactgaatcaataccataatcaagggcgtatcgtcattatggcgaatgagaaataatcgcgtactaacaactatcacgccaatgatggcaccaaatagtaacccgcctaaaaactcccaagcaaacatgccaacagctgcttcaatggaaaattgacccgacatatatgctgccagtgccatgtcaaaaatcacgataccggcagcgtcattaaatagcgactcatgctgtaacgtctctgcttgttcttcagcaatggggttagcttcgaaaatcgagttaacagctgacgcatcggtaggcgccacaattgcaatcaaggcaaaactgagactcaacggtaaaactgcgtatagcgcatgaatactggttcccacaaccaacactgtcacaaccaccaaaccgacagctaacgacaggatattcgtaatcgatctgccaatccaaaaccgagaactattctgcgcttcattgaataacatcggtgcaataattgcgaacgcaaacgttgatggatccagatgaaaccctgaataggctggcaacagtgccagcaacaggcctaagataattagaaaaaatggtaacggaatagctgtaagatgtcgcgctagaatattggcaagtaccactactgccaaaataataattaataaaagtacttgatccataattttcccctcatcctcagacttatatgattagtatagcgatgaaggtgggttttgccacaaattttgtttgatatcccaaatactacagatatttagcgtcacgtttcggatcctgagaagtcaaaattttgggaccatctttggtaatgactaaggtatgttcaaattgtgctgatggtttgccgtcagctgtcacgtaatattcccaagaatgatctgcagtttccatagcacgaatctcgcgggtccctaagttgaccattggctcaatggtaatggtcattccttcacgtagacgtagccctttacctgcttcaccataagcgggcacatcaggttgttcatgcattgtcggctggataccgtgtccaatgagttcacggacatcacccatgtggttttcggtttccacgtactgctgaatagcagcaccaacatcaccaagtcggttaccaatcacagcttgatcaattccgcgatacaaagattctctagtaacatcaagcagacgttgattttcggctgaaatctcaccaacagcaaatgttcggcaagcatcacttaaaaaaccgtttaaattgacaactaggtccactgccacaacgtcgcccgcttttaaaatcagtgctttccttggcgtggcatgcgcaacttcatcgttaacgttaacgcaagtcgcgtacttatagccttcaaagcctttttcttccgcggtggcaccgtgatcttcaatataggtattggcaaatttttcaatttcccaggttgaaattcctggtttgataatctcttcaagaccatttaagacacctgctaatacagcaccagacaccttcatttgtgaaatctctcggggtgattttaacgtaatcattacttaacttccttattttatatttgattcatatttaacacttttgcgtttttctaatcaacagacaattcattataccttaccctcatagcaggtttaaaacgaatattattatttttggcttaccactccactatggtaaaacgacttgggccaccgatttaccctgacccgttggctgaacctgaatttggtacggaatggtctcctgcaatagtgtgacatggctaatgataccgatcatgcgattactgctttccacattctccaaagctttcatggctgtggataatgattcctgatccagtgaaccaaacccttcatcgataaacaacgcatcaatgctgataccaccggactcattttgaatggattcacccagggccagggccaggctcaatgcggcaataaagctttcaccaccagagagcgtatgaacactgcggacttgaccgacgttgtcatcgtaaacatcgatttccaaccccgtatttttttgatacgtaccggcttccaaatgcagctgcattgagtagcgaccagagcttaattgcttcaaatgctgattagcgattgcgaggatttcagctaattgcgcccttaagacataacgttccaagccaagcttgttgtcgccgccgccagcgacagtttccactagcaactgaagttcgttaagttcatccagctgagttgcgacttgctgagtggcagtctttatttgcgccagaatatcaccgttaactgtgacttgcttctgtttctcatcagtttgtttctgagcaccttccagttgtacattgagttggctcaactcagcctcactttgacccaaatcaacggtgtggtgatgatccactaactgctgataagcggcaacatctgctttggcagctgtaatcgcctgctgataagtctgaactgactctgttagcttagcgatttcacctaagtgacgagtcagttcaacaaactgatccatctgatttagtcctaattgctgggtaactgcttgcttcaaagacgtcgaaatagctgaaagttttgtttgcgtttcctgcagtgacgtttctgtgttgatcaagttagcctgaatggtggcagatgcttccctgttctgttgtaaagcttggttatttgtttgtacttgttgctggtgctcggtaaccttattttgttgtgctgctaagaactcatcaagtgctgctaaatctgcaaaatgatctggcaagcgtttttgagcttcttccaacttagtctgaattgttttctgtgctaactttgttgactgaacttgttcttttaacgtctgaatcttttgctgcaacttgtcagtctcaatgccgattctgtgttgttcatcaacggccttatcaaccttagccaattgctgagtaactgagcttacctgctgcctgatctgagcttcgtggttggtgatttgttcaaacagctcgtcaatcgaaacgtcgttctgaatgttaaagtgatcctgtaaatcagcctttaaattctcgatggtttgctcttgcgttttaaacgaatcctgaagatgacttaaatcactgttgactttagtctgctgatcttttagttttcgtaatgacttttctgctagtttcaaagtctgattatccactggttttgttttcgcggcagtatgcggtgctggatgttcaacgctaccacaaacgggacacggcgtacccggctttagttgactagcaaggacagaaatttgccccgccagccactgatttcttaaatcatcgtaatcattactttcttgatcaacttgttgattcagctcggccaacgctgactgggtcaccaatatggtttgtcgttgttttaaaagttgagcttgctggtcgcgcaattcattaacctgtttttttactaacgtctgctcattttgcgcggtcattaacttagcatgcgttttgagtaatgctggttgttggctgataaggtcattaagttgcttaagacgtgcttgactctgttcttcctcagactgaagttgaacaagctcatgattcgtattcgaagaggtcgtcatctgctggttcaactgatcagttaactggcgaacctgttcatacaatggtcgttgttgcaccaagatggcaatgtttgactgaattttcgcaacgttatcattagcgcttgcgagttgtttttgctgttcggttagctgagcagtggtttggttttgggtttttaggttgttagttaaggtaactttttgatgttccaaaagcgtttgcttctgacttaattcctgttgctgttcataatcatatttttgaccattcacccagttcaaagtcgccaaacgttgctgtacttgctcgatttgcggctgttttgctttaagttgctgctcctcttgtaacttctggctcaacttttgaatattctggttcattttttgatcagtttctatttgtgttgctaaatgattaacttgctgctgtaaatcttttacctcgctcttagcgtcgctcaattcagtctgatcaatcccatattgttcttcaagttgagccaaatcatgctcgccgtcttttcgagtccagcgtacccgtttcaacccgctatcaataatcgattgtgctgatttaattttgtcgcgctgctgattcaactgttgttttaacgccgttgcccaccgttggaataactgcgtaccaaacacttttcttaaaatagcttccttctcgctactatcagagaccaaaaagcgtctaaactccccttgcggtaacagaacgatttggacaaattgtttacgactaatctgcaagatgtcagtcaacttaatgttaatctcctgcatccgggtaatttcatccgttttcgtaccgtttttataaatcgttaatttcccactacttggatattcacgagtaccggtaccccgtttcttcgctaatgtttgcttgggttgacgcattacttcatactctagacccttatgttcaaatcgtaaggttacttcagtgggttcatagtcttccgcaaaatccgaccgtaaagctgcaggatcacgatcatcactagcactttcaccatacaatgcgaaagtcatagcatcaaaaagagtggttttaccactaccagtgggacccgcaatcagaaaaatcgacgcatcgtctaactgggtaaaatcaatcgtttgctgagcataaggtccaaaattagtcatggtaagctttaatggtttcatgcttgagtctcctcttcgtgtgctgctttcaaagccgtttttgcccatttttcctgttgcggactcaatggctccttagcaatcttttggtaaaaatcccctaacaacgccattggtgatttttgccgaatttgctggctggattcaccctgatagcgaacctgcgcttcaaaaccatctgctcgtcccagtgtgacgattcggggaaaaacatcgcgtaacctagccatgacgttaggaatcggctgcttatcggttaacgtgatgccaacgtaattttcatggtcaatgctttcatcatcagtggaagccatcagctcatcaaaactgccggtaacttgtttaacatcatgaatcggtgtaattggcttaaacgttaatgccactggagatttttccgtgtcaacgatccaaacgcccttttcttgattcgcctctgaaagcgaaaacttaacgggtgacccgctgtaacgaacagttggcgtttgcagagcgtctttaccgtgtaagtgacctaaggcaacataatcaaaatccgtcaataaatccgtggggactgctgccaaaccgccaacggtcaaattagtttctgaatcagtggttgagctgcctgccgcaaaaaaatgcgcaactaaaagatgcttttttgcaggatcaaactttttcttcatctctaacacaactcgcttaaaagcttggtccaaatgctgcagagaatcgtccttaaaatattgctgagcatcgaacggttcaaaataaggacataagaaaagctgagtatccgccaactcaactgggttaaaagcttgactcaactcggtatgcaggtataactgagtcgacttaaaccaaggtgtccccgtggctaacctggtggcactatcatgattccctgacaccgcataaatgggtaactgatccactaaatttagtttctgaagcatctcgtccaccatagcaactgaagcttccgatggtaaacgacggtcgtataagtcgccggcaataatcatgccatcgacctgttcagcttgtgcaatacgttcaatctgatcaaacgcgttttgctgttcatcagttaaatcaaagccgtgcagtcgccgaccaatatgccagtctgctgtatgtagtaatttcatttttgccaatccccgttcgtttaagttagtttttattttagcaaattaacaccacctgcggaagaggaaaagcgaacatattttcgatttatttttagtgactttagtgactttgacttgccaattagtcaaaattagcctaatctgcacataataacagaaaggaactgatgatatgttgcaaacaacttattcttcgccgcttggcaagctgatactactggcgaataccgacgctttgctgggcgtctggtatgtagatcaagcctatctgggtgccaaatatgatctagcaaaaatcgaccatggtggatcaccaatcttaacgcaaactatcgagtggctagacgactactttagcggtcgtcagccagccattaatcgattaccacttgcaccacagacaacgccttttcgtcaacaggtctatcaaatactcacaacgattccttacggggataccttgacttatcagcaaattacggaacagttgactcagttaaatcatcatcccacgggttcagcgagagccgtcggtggtgcagtcggccacaatccaatcagtatcatcattccctgtcacagagtcatcggcaaaaacggtagcttaactggttatgctggtggtttgaatcgtaaacggaaactgttagctttcgaacagcagaattaatcatttgttatacacattgttatatacataatgcttaataccaatcttccaggaggtagcaaacatgattcaaaaaatagctgtttattgtggtgcagctacgggtaattcaccagtatatgtcaaagcagccactgatttggggcaatatcttgcggatcaccggcttgagttagtttatggtggtggcagtgttggtttgatggccgtgttagccaatacagtcattgaagccggtggtaaagttcatggtgtcatgccccaaaagctggttaaccgcggtgctgcagccaccaatatcactgatttaacggtggttaataatatgtcgattcggaaacaaaccatgttagatatggctgacggctgtatcgccctacccggtggccccggaaccttagaagaaatcattgaagcctactcttgggctcgaatcggtgacaaccctaatccgtgcgcgctttataatgtgaaccattattacgatcccttaaaaacaatgtttgaccaaatggttcagcaaggtttcctaactgcggagcaccgcagtaaattactgtttgctgacaatttacccaaaatttttgacttcataaaccgctatacgccaccaactattagaacaaattatcacaactaacacagaaggcttgccaatgctgaattgacgagcctttttattttaaaagttaagagattttagttataatcatataaaaaataaaagtgctgtagaaaggggttgtctaccatgctttccaatgtgcattacttcacccaagtacaaacggacgtttctcaaggacttatttcgttagataaacaagccaaatgtcatgccagagcaaccggttcacaattagcctgcctcgttatttttctcgccgcaactatcggtgtcgttagtgttcagccactagcgtctatcagttatacgtccgttacgcttaaggaagttatggcagccccagctgaacagttatgctttagtttgatgatcggtgctttttgtatttcgtggattttctggctgcgtgatctcaaatacgaatcattagattcaaaatacaacgaaccttaccggcaacattcagaattaattaaaacttcagcgtcactgacagaactcaatgcccactaccatcacctcatgtcgattgccacccattttacgattactagtaatgttattttagtggcttacgctgcagggattattgtttaccatctccagggataacgtcagttggtgacatcaagccaattacttgattttgtctgatatctttgccatactcaccgtgaatttaatctttggaggtgggtaagaatgcaagttaaacgtgacgttacctatgatgagaatcggcatcttacactggatgcctaccatgatggtaccaaaccgtttttaggcctgattattgatattcatggcgggggctggttccgtggcgataaagccaaggatgaagactgggcaactcgtcttgctgaccttggctacatggttttagtaccaaattaccgaatgacacctgatgtatactatccagaacccttatcagacatggcttcactaatggaatggatctcccgaagtgagtataatcaaatgcccattggcgttgttggctcatctgctggcggtaacatggcagtagaaatggcgattagatatggtattccagccgtttctctttcaggaattttggatatcgatgattggctggcaaaccatcaagatgtagtcgcttctgaaggcgataccagtggattcaatcaacaagccagtgcaacaatcaaccaagatggtgctaatgacgccttttataagtggttcgtcatgaactactttgatcagcgaacggatgaattaacggctgccacccctgttcaccgtgtaacgagtcaaactggtccaatgtacttagccaattcgttaaacgaatttgtgcccaccagtggcatcctagcaatggcccatgctctaaccgatgctaacgtaccgtttgaacttaatatggtgcctggcactcggcacgcaaaaggttatttagatgacgtctttaacgaaacggttgattttttgaaacgtcacgttttggtggaacacgttgatatgctgtgaacaaagggtctgaaaactagtcaactgactaactttcaggccctttgtttgtgtttaatgatattaacctactttgccaaagcttcaacgatatctggttcaattttttctggtttggttactggcgcataccggtcaattaattgaccatcacgaccgattagaaacttagtgaagttccacttgatacgtccatgtccggccgtatcttttaaataggtaaataatggatcttcatcatcaccgttaacccgtacttgcttagtcatggggaacgttacaccgtagtgcatttggcaataagcctcagtttcttcgtcagaatccagttcttgatgaaactgatttgatggcaacccaataacttcaaagccctgatcattgtactgtttatacaatttctcaatgccttctagctgaggtgctaatccacacttgctggcagtattaacaatcattaaaactttaccgctgtagtcggctaaattgattggcttaccactcatttctgtttcttgaaaatcatagatactactcattctcaaaagcccccttctcaaactaattgtgtacaatcaatataccgctttcacgatatacttgcaagccgagacccaactaaaaaagactaatgccctcgtcaaaacaacgaagacactagtccttttattaatggaacaacattaactttgtgatgcaccggttgttgcgtccgtatcagtcgcttctggttcgggcttaacctctggctgcttggcaggtgctgaatcttccgttgcagtgtaatcagtggtcgtctcctcagaagcaccagttaaagcatccgtatcaacgggttcttctgcagctgcgggtgcagcctctgaacttgattcagaagcaccgctagtagcatcagtagccggtttttcgactggcttttcagctgatttagaagctgaagccccactggtggcatccgttgctggcgttgaatgagctgacgcaccagtaacagaatccaacccagtaattggtgacattggcacggcatcaggatccttaactaacttctgaccagtagctgccaagtagtatttcagaattggcatgatgtcaatcactaattcgttgacaccacgatagcgccggttttcatcacgcatagcacgatagtaatgcataacgtgttggttaggaccagtttgtgctggcatagaaaccacgtcactttcacctgtccgcaatgcataaagtacttgcttaacgtgttcaacgacacggtctgggtgaacagcacttaacggatcaccaacttgatcaggtgttctgcccgctaacatatgagcgccatcagcattgtgattgtagtaaatgaattggttattatcatcagcaaaggttaattcaccagccatggagttcaagaaataattcaactgatcaacggttaagaggccacgatcaagtttgacgtaatcaccaccactggcagcgtgagttttttcagcagccttttcaacccattctggatctgtcatgtcaacatcttgaacagttgtgttcactggatgcttcgaatccatatcttcctcatgagcattctttggatctggcgcatccatcatttcaatcaccttcataaatgtcaaaaacttcttcaatactgactcaaggaaactaactgttctggcatccttcagattgccatccgcatcaaaggcttctttagcattactcaacaaaaattcatttccgggcatcacgtaggcattaacccctggtgattccagaatttgcttcaagtgtaattgtgcccgcgaagaaccttgggtatgatacgaagcacccacgatccaaaccgctttaccgtcaagtggatgaacattgtttgatagccattcgatgatgttcttcatcgctgctggcactgtgtggttatgttctggtgtagctaagatcacaccattggctcccgaaatcttacgagctaattcatgaaccactggattgtcattatgatcttcatcttcattaaacattggaacatcattaatgtccaagatttcaatatcaactgtttttttgaaatggtcacgaataaattccaacaacatccgattatatgattgttcaccgattgaaccggcgattgcaactaatttaaccattatttatcatctcccgttgtgccgttgtcccaagtaaagtcagccgcttcttgttcatgtaacttcttcgaattatcgagctgctcagttaaagcaacaaattccaaaaagtcatcgaataaaccatctagcttctgtgactcagtggctgaaactaaatcgccattttcatcaaaagcctgcagtgagtgccctagtaaaaattcggaactaggtaaaacagtagcctttaattcaggagaatccaaaatctggcgtaactgggcttgggctctagaagctcccaaagtcccatatgacgttccaacaatcatcacaggtttatccattaatggatgaataccataagacagccaagctaacgcgctggataacagtgctggaatggaatgatcgtattctggcgtcccgataatcacaccatcagacgcatcgattttttcagcaatgtcgcgtgcttgttgcggaatgaaaacttcttcggtttttttaaaaatcggcaaacccttcagctcaacaacttcaatctcagcgtcttccgcgtaccgcttttgcatatacttcaataacttacgattagttgatttaacagtattggtaccaacaagtgccacaaactttttcatctgtttattcaccctttctaacggtctcagcaagattcattgagcaaataaaagtaatcatgattgcccgattgcaaggaccttttgtgaaacaatatacatacaaattcaaacctttacttgtctaatatgataacacgaatgggccaatattttaattaaaattctctttataaagaaatttttatatatttttggaatgattgtttattgcaatattaacaagtaattccttcaatgaaatattgttccacttaaaagtttttcttgcatcatatgtctatacgacctatactcgataagtcgctctgacctataggaggtattatgtacgaattactagtccttggcatgctcatgtcccgtgacatgtcgggttacaaactacgggatgtcttaggcagcgcgctggttccccggcgcaaactttcaaacggtgtcatgtatccgctgctttcaaaattggcagacgaaggcgagattatctatatcgtagaaccaaaggatccacgaaataagaaacttgcgcgtatcactgaagctggtaaaacgcatttctatgaattgatgcaacagccggtaccagataatgcccgtaacgagtctatttaccgatttaagttccgtggtttgtttgcggttgatacaaaagagcaacggcaaattttacaggattacgcgaataaagttcaggaagatctcaatatctataacgatgttcatcagcacttattacagttattaacagaagataaaagtaacaaagaagctattcatgctggtattcgttcaatcgagctgagtattaccatttgtcaggctaagcaaacctggatcactaaatatttagtagaaattcaaaataaggagtaaaaaaatgactcaaaaaactagtgtcaaacaatggatcgccctggcggccatggggcttggtgtcttcatgggattgctagacgtaacggtagtcaacgttgcattaccaaccatggttcgtgacttcaataccacttttaccgatttacaatgggttttaaacgcctataccctagtatatgctgtcaccctcatgatcatgtccaaactgggcgacatgtatggtagaaagaaaatcttcttaggttcattagtcttattcgtattagcttcagccgtcaacggtatggcttctagtctcttaattttggatattggtcgaggtgttcaagccatcggtggcgccggcatgatgtcattatcaatggcgctggtcgcttctaactttgagggtaaagatcgcgggttagcccttggcatcctcggatcaattatcggtgtctcatccgcctctggaccattgattggtggttacctagtagagcatttcagttggccagccattttctacgtgaacgtccccttcggcatccttgcggtaatcctgaccgtgatttacgtgaaggaaaccccgagttacggcaagaatcaaaaagtcgacctacttgggatgctgctctcagcagctgggttatttgctattatttacggattgatcgtcaaagaaggccatccacattggaactggacggatcttcgtgtcagcggctggctcgtcggtggtctcattgtgatgattatttttattatcgctgaagctaagatcaaggatccaatggtcaaccttagtatgtttaagaaaccccattttattggcgtggtaattgtcgccttcgctttaggctctggtatctacgcgtacaacaccttcttaaccgcactgatgcaaaattacatcggttattcagccacccaaactggtttgcggcaattaactattagtgtctggtcactgattctcggtccaatcgttggtattctaagtgcccgatattcgaagaagtggatgatcagtatcagccttttcattggcggtttaggcttttggctcatggcgcgcgcaatcagtccgacagtcagctttgttgatctctggcctggcatggtccttatgggaattactaacgggatggtcaacccgctactaaacacagctggtatggaagggattcaggcaaatgaaatgggcatggcttcgggcctgctaaacgtgttccgtcaactaggaactaccatcggcgtggttggtctagggttgattcaggataatcaatacgaaacttacttgaatggtcatctttcttcactaaacctccctgttcaggcactaagcggccttaaaaaagcactcatcgatgccggtccattttcagggcatgggattgccttttccagtcgagtaagtcacgcaccatttgcacatgatttccagcaaatcgtcatcaaagcttatgataacggtatgacggctgtagcaattggttctgcaattattgttgttattggtggtgttgctgcagctttgctcttacaacgtaatcctaagtcggcagatattacgattaaggaacaggattaaaaaaggtgtgacacaacttggtagattccagaatataacacgcaaaagcggcattccgatgtttcttgtcgggatgccgtttttgcgtgttatatggccggaatctgagttgtggaccagttaaggctacattcaagtagcggactaaagtaaattttagaatgtgttttagtcaagaaactggctaaatactcaccaatatagacttatggtacaaccttttttatttcttactcaacgctcgcacaatcaaatcctcaatggtttgcaaatcggcatcttcatcaactgtcatatcaggcagtacaatttgacgctgaagaaaataaatcatcagttgaccagcaatcgtccgtaaaacggctgccggcgtcaaaccggcttgtaaatcaccgctctttttaagagtgtcataaacataatcgataaacattgatgccgtttcactgataaaatgattaaacgttgttcttgtatcagagttggtcatcacctgcgtgaagaaaatcatgaccacctctttgttttgcttcaaaaaggcatatcgatcacggatgagaaaacgaacggtttgtcttaacgtcgtggtttcaggaatatcagccaagaaatcttcccgatattcaggcagcaagtttttgatcatgggttccaaaatagcttgtaatagatcatccttggttttgaaatacttaaaaatcgtcgcctggctgattcccgcacgttgggcaatcgccatggtagaagtgccatcgtaaccttgtttagagaacaattccaacgctgataacatcgctgaacgtttacccttaggcatatcttgtccgtttaaccagtcacggtaactggcagaaatttcttctttcaatctgattccccctatactttacgatagcgcttgagacctcttacatttaaaaaggttagcacaactaagaagataagcaatacaccaatgtcaagcccgaaggaaaacaggctcttaccttgcatcataatgccggtcacagcatcaccggaatacttgatcggaataatataggaaatatcttgaatccagctggccatggaatccatgggaatgataccggagaaaaagatttggggaatgatgaggattggaatgaactgcatcatctggaattcagagttggcaaaagtcgacaatagaattccaaatgccagcgcaaccaacgctaatattagattaatcacaataatactgatcacactgcccacaacttccactcccagcaaccaaatcgtggccatgacaatgagaatcgtttggaaaattgctaaaataccataactggccatgtagccaaagacaatttctgatcgtctaactgacgttgctaatagccgagatagtgtgccgctagtccgttcttttaagagtgccatacctgaaattaggaaaacgaagaagaaaacaaagaagcccattaaaactggtagcattttatcaaagaagccagtactggaatcaccgtaaacatagtgattggtaatttgcggagtagtcgcctttttttgagttggcatttgactctgtagctgtctttgagcctgaactggcaacgttgcttgcaacttaccaatggtcttttgagcaacacccaactgtgacttcatttgatcaatattagtttgcgttagcgctgatttaaacgccatttttacagccgaagtcttgctggaatcggtattggcgtacgtcaaactataatcattatcggttttatggataatagcatcgattttgtcatccttcattgctttcttagcgtttgcttcatttgtgtaatgatgaacggtgacatgcttaacttgatctaaattagtcgaaacactggaagtaacaccaacggttcctacttctacgtttgtagtggagttagcggtaaaaataacactcattaaccacaacactaggattggtgccagaaacatcaacgctaatgaccgtttatcacggatcatctcagttaaaacccgtttcataattgcaaatgttctcattgtaattcaccttccgcttttaagaacacgtcttcaatcgaatccactctatattgagttttaaggactactggttcatcaaaggcaatcactttgccgcccagtaataacgctaccttatcagtcagttctgcttcatccatcacgtgggtggtaatcaggatgctgcgaccttcatcacgaatactacccagttctcgccaaatttgacggcgtaaagctggatcaataccgacagttggttcatccaaaactaacagctcagggttccctaatagtgcaatcgacagtgacaatcgccgcatcatccccccagaatagccactcacccgtttgtccaggtcatcctgcaggtcaaccactttcgcgacgtgatcaattgaaatctttatttcagatttcttgatgcctttcatttgagcaaaaaatttaagattttctcgacccgacagcgaatcatatagtgcatccgtttgagccatatacccaatccgcgatagcagctttcggttaggcatcacctgaccaaagaccgttgcgctgccgccatccgcgacttccatgcccaacgctgttttgataaccgttgatttaccagcgcctgatgggccgattaaacccacgatttgtttgggcataaccgctaaattaacatccttcaaaacggtttgcttgccaaaccttttaactaagtgtttcaaatcaataattgcatccgccattttgattcctccgttcaaggtaagtgattgattactcaccagtgagtatacactcacttccaaaaaaagacaactaaaaaagttcgttgataatacacctttcctttggtcatgactcatcgactcaatcaaagcatctaagaagcacctctccgtggccaatcaaaggggaatcgcaagtacataagttgtccaacataaaagcagtgcatccggaattcctaccgaatgcactgcttgatgtaatcctgtaatgaaataatggttagcccttttagtttacaacgcacctaaagcgtacttattcctgacttgccccttatacaaccagttggaatattttataactaatgactccctttcattctaatttaactcaagcaccgtgtaatttttactacctgaatgaacagtactaataccaaccacctcatagttgttccaagtgacatcaaaaccgtcatcttttaaccataattgcagatttttagttgccgcttccttgttagtattatagaggtaacttccagctccccataattcttgatctagggatagacctaatttctttgctaaaattcctgcctgaaagtttttctgagacacaaagttacttggattttttgcaaatttattagcttcaggaactgcaattttactttggagattagcatcaacctttaacggcagttgcgcattcttcttacgaagagaattaatttcatttaacaagtcggcattatacttagcgacactaaatttttctttcggtgtaaactttttgaaataaccatgccaagcccaacccgtttttccatttgctgtttcaaatttgtaatataccgtctttttaccatttttggttatgtgtgcagcataataacctgtaaccactttaccaaatgacttcatggtcccttttttatgacttagtttgccattcgtatagaccgtcgctttttgattcactgtgtacgaagcatccttaatattcgaatatgaacgtaacttagtgctggcattcccgacagttggtgtgacagccaatgctgcaaataaagtggccacacctaatatcatcatacttactcgcttaaacaaatattttttcattaaaaacccaaccttcccaaatagatttattttacgtttataacggtatcactcacgtacaacaggtaatgtcgttttaagaacaatttatctgcataacaactcccacctttctaatactttatactaatagttatatcacttgtacctgacatctcgtgtcgttctggaaatagaaattctttttcattaattatttttattggtcaaaaaaagaacttcaattgatttgaagttcttcattctgttactttttcagccgcgaatcataagctcgcttagatttatacccagccttaaaaaccgtcttcatcacttcaacgtgccgagccttcgttgcttcggcttttgcaccgaaaataaaccgcgcccactcccgctgatacccaggcgttaagtcattgaaaaattgttgcagtgctggttctccagccaatatttctgctacggccggaatatctttttcgtaatccgctaatggtttttgtgtcattttgatttctcctccgttttaataatgatttcagtatatcattgttatgtctattcatagacgcattcaaattaaaaaagagcccaacgactggactctctagtatactcaattacctatctatcaatgactatcactaccactcactagtaccggtaccaccgtctctgattcaaagggtgatttaaataaacgatcccccacttgattcgtaatcagatctttgttggcagtacttgtagtaattgctggtgaattaataaagtactggtttgcaggaatactgtacagatctcgaacgttcttcacatcaaccggctggacgctgacataccgcgtcgatttatacatcacactttgtttactaggattatgtgctaaccccattgcgtgacctaactcatgttccgccacgttcactcgctggctagtggtatacccgttacttttcagtaaggtgtgaaccaagtgaagcttcacgctgacaattcgtttggtattatcatggtcaacgtaagccacgccgacaaaattttccttaatcaaagatgcttcgttactttgagctggaataatggtgatttgagcaggacctgaaacgattttaaatttaaacacttttttagcattccacgcattgatcgctcgtgtccaaacttgggaatagtacgtccccactttgatttggacggttgcttggttagtttcaaaacgccacggattcacgacagggagacgccccgagggcaaccctactgagacttagcatggtcagaatcagaacaatgctagtcataactatttttttgagcatcattttcactttctctctttgctggtcacaagaattcaatatacattactgaatacctctggcaaactatattttacttaatttaagtgaaatgtccaaaaaatagcttgaaaaaatcaagtgcttttgtttgcaggtaaaattaaaaattgataaaatgcaggcgtaatcaattcagtggattgattacttaaagacagtagtagcctgctacttctctttcattttactaatctgtgctactccccccatacagtgacctcttacgttgatactgtttctagcatggattggctagttgacgtttccaaactactgtcccagtttggagcattgactgaatcataatctttcagcattctcgctgagacgatatttaagcaactcgcctccctatccctaagacgagctgctttttatattcacaaatgatcctcttctaataaaataattaaatttttaatcaatttgccatttacttttaattttcactctgttatagtttcaatattctctaaagtcgaggtcgcctaattcttatcaactagccatccccgatttttttatggaaatctgcagaaaggaatcacaacacatattgtcaatgaattaatcacctaaatttaagaaactggagtgacatacatatggaaaatacaacaccagcgttaacaagtgctactagtaccactctcgaaagagatccagtaaaaaccgttattttagcgtcaatgattggtactgccattgaattctttgatttttacgcttatggcaccgctgcggcgacttactttccaaagattttcttcccagaagtaaccccaaccattgccatgattctgagtcttttaacctttggtgtggctttcgtcgctcgcccattgggttccctgattttcggccactttggtgataaattgggccgcaaacgttcactggtggtttcgctattattgatgggtgtttctaccgtcctcattggttttttgccaggatacgcctcacttggtatggcctccatcgttctactctgcctctgccgtttcatccaaggcattggtcttggtggtgaatggtcaggtgccgttttagttgcaactgaaaacgcacctaagaataagcgggccctcttcggtgccttcccagaattaggtgccccaatcggtttcttcttgtgcaacggcctctattacatccttgaaacggttctgacaccaactcagatggctgcctttggctggcgcgttcctttccttgcatccgctgttcttgtggttgttggtttgtgggttcgccgtcggatgcaagaaacacccctcttccggatggctcaggaaaaacaaactgttaccaaagcaccactggttcaagtattccgtaaaaactggcgtcaagttttgcaaggtactttgaccatgtccgtttcttacacctttttcttcctattatctacttggtcattaagctacgccactactgcattaggcttctctaacaaagaatggttattgctcttaatgggatccatcatcgtctttggtgcaatgatcctttactcatcaatcatggcggataaatttggtcgtaagaaagtgctgatgcttggtactggcctcatcgtggcctttgctattgccttcccattcttcttgaacggtcagcataacttattcggtagcttattcttcttagttgctggcttcctcgcaatgggcgttgtttacggccctgtggcagccttgttaccagaactcttcccaactgccactcgttattcaggtgccggcattgcttataacgcttctgctatcttaggcgctgccttcgcaccaacgattgcttcttggctggttggccaatggggcattcatgcggttggtgtttacctcgcattaatggcattcgtttcattcttagctttagcaactactaaggaaacaaaagaaatggattatacaaaatagtacactaatagccacggaacaactcttcaggttgcttcgtggctattttgatttcacgatcattcattaatatcattttattacaatgatgattacctgacagacttacggcaactcatcagcatcaaaatcagcagactaacaatgaagaaaactaaaacgatcaccgtcaccattggcggaaagaacaggctcaacagcgtcaaaacaccaaatagaaccaagcaataaccgattgaacgtaagtcactttggccatcaacctttccgggatgaaaaccgctctttttcacactttccaacggaactgttggcaaatagttaccgatgaaaataagaatggcagccaccatgatcaccgtccacagtcgaatatcaacggtcttgcctaatccataccggattgtaatggtgtaggccacgattgtgataactggaaaaatccaagcgacaacccgttccatccgtggtgctggccgtccctttgcactagcgtgataagttgcgccaactgccaccaaatgaatcagtaacatcaaacaaggcagtccaaagactaccatcggtcttgtcatccatccgttaggctgatcattgaatccccagtgcgtcaccatccgagctggtagctgattatagacgcttacaccatacaatattggggctagaataactaaactcgttaccaataaagacttccatttacttttcatcatcgtgacctccctttcctaaaccgtatatccacgtcagcacgtcttcaaaaacactggcattcaaatcgtagtaaatatagttcttctcttttcgttccgtaatcagccctgcttgtttaagcaactttaaatggtaggaaaccgttgcctgcttcaaatcaaaatgggctgcaatctcacccgcagcatacggtttcgtttttagcaactccaaaatctgtcgacgcaccggatccgaaattgctttcaacgtttcacttatcgccatgtacatcaatccaatctattttgattaatttctaaatagattataacatgttacaattacaaagtgttaaactatttagattaatttctaaatagaatgatatcaacctcttaattttcagcgtgatagaatataatcattcattaatatcttggaggtatttaagtggaaactcaaaaactgcaggctttcgtcaccgtagcagctacccgaagctatactgaagccgccgaacagctatataccacacaagcaaccgtttcgaaacaaatcttatcccttgaaaaagagtggggtgtcaccctcttctctagagcacatcatcaagttcaactgaccgtcatgggacaggagttactcccaaaagtgcaagccgttctggtcgctgcaaacgatcttagtgctaccattaccaaacaaaatgagtctcttaaactcatgacgattccctctatttcaggatatcgggcgttcaatcaaatcgctagttaccatcgtcttcatccggaagtgaacttgcaaatgaccgaaattgaaaacgatgccgtagaacgtgcgctaagcaatgacactgctgacattgtttttacccgattattcgctaaatcaactctaaacgttgaatcttgcgttagtgaaacggatgaattttacgtggttttacctaaatcatcacctctggccaatcaaacgactcttgaagcagctgaccttgctgacagtgatttactgctactgggcgagtctacctatacctatcaacccatccaacaactttttaatgaaactggaataacccccaaaatcacctataagggtcagcgaattgacttgattcttggcatgatcagccgcgggttcggcttatccatcatgatgaaaaagaccgttgaccttacagattatccggatttaaccgccattaaattaacgcctactgtcagttcccaactggcatttctacgtaaaactgggactcacagtcatgccagcgacagcttttggaccttcattcagcagaaataaacgggcgctcctttattattcaccgactattccaattcggcatactcagtcatctattctgaattgttccacctcttcactcctcatataatttaagtataaggaaacggaggaatgaacgatgtcagacaaatatgacttacgtaaagtgctagatgagatgaaatcaattccaggacaatatcatgaaaccaataaggaaattgaccctaacgccgatttagctggtgtttaccgctacattggcgctggtggtaccgttcagcgtccgactcaagaaggtccaaccatgatgttcaataacgtcaaaggttttcccaattctcgggtactgattggcctgcaagcttcccgaaaacgggttggccagattttgcatcatgactaccacactttgggtcaaatgctaaacgatgctgtgtctcatccggttaagccagtcgatgtgacacgtgaagaagcacccgctcaagaagtcgttcatttagccagtgaccctgatttcgatattcgtaaacttctggctgcgccaaccaacacgccagaagatgcgggtccctacatcaccatgggtgtcgtttatggtcacagtccagctggtgataaagaagacgtcacgattcaccggatggttctagaagaccgcgacaccattggtatgtacattatgcctggtggccgtcacattggtgcgttcttgaagcaatacgaagcagaaaacaaaccaatgccaatcaccatcaacattggtttggaccctgctattaccattggtgcgactttcgagccgccgaccacaccgcttggctacaacgaactgcaagttgctggtgcgttacgaaatcagtccgtggacgttgttcaaggcatcacggtggacgctaaagcgattgcccgctcagaatgggtcattgaagctgagatcttacccaatgaaaaaatgcaggaagatatcaatactaatactggctatgccatgccggaatttccaggttataatggcaccgccaatccagcggtgaacgtggttaaaatcaaagcggtcacccaccggaaggataacccaatcgttcaaacgaccattggcccgtcagaagaacacgtttcgatggctggcattccaactgaagcttccattttaagcttagttgaccgcgctattccaggaaaagtgaagaacgtttataatgcaccagctggtggtggcaagctcatgaccattatgcagattcataaagacgacgaagctgacgaaggcattcaacgtcaggccgcacttctggcattctcagcatttaaagaattaaaaaccgttattttagttgatgacgatgtggacattttcgattggaatgacgttatgtggacgatcaacacccgtttccaagcagatcgtgacattatggtgctcgaaggcatgcggaatcacccactagacccttctgaactgccagaatacgatcccgctcgtatccgggttcgtgggatgtcgtcaaaactggtcttggatggtaccgtgccatacaccatgaagcacgaattcaagcgagccggcttcaaagaaatgccaaattggcgagattatttaaagtaacatgagttttggttgatcaaggaggaatttagatgaagaaaattgttgttggcattactggcgcttctggaacaatctacggtatccgtttgctcgaggcactagcccaagatcctagtgtcgaaactcacttagtcatgagtcggtgggctaaggaaaacttagccgttgaaaatactggctacactgaaaaagaagttcgagagttagctgacgtggtctacgacgatcgtgatatgggcgcatcaattgccagtggcagttttcaacacgacggcatggtcatcgtcccggctagtatgaaaaccgtagctggtatcgcaaccgggttagctgataatttgattgctcgagcagctgacgtcaccctaaaggaacgccgaccactactgttggtgcctcgtgaatcccccttcaaccaaattcacctcgaaaacatgcttaaactttcgcggatgggagtggacattattccaccgattcccgccttctataacaatcctcaaacaattgacgatctaatcgatcacaatacgatgaaattgttagatcatttacacttgagcaacgattatagctctcgttggcaagggttaacggctgctaagaaagccaacagacaggtggaacatcatgcctgagaaagtattcaaggtagctcaagcaggttttgaaatgagtgcgaaactatcccgcgaaaatcaagatgtcctgttagaaattactggcggtgacgtcccacattatggtgttgtgaccattgttagcccccatcaaaccacacggacaattgcgttgccaagtcggccaggacaccatcaccaagaaggcgtcctcaccgaacggattgctaaaattatcgcaccggttttacagaacaacgcctttattattggcggcctgcacgttaatcgcattactccccaacaaatggccgcaacggctaacgtggcacaacaattaggtgaacagattcgtaattatctgagcagtcatccccgaaccaaaataaccgaagaattctcgtaatcaaaaaatgacttcaagttgccactaaggcaccttggagtcattttgttttagacgaacatgctattcattataatccatgcgaataattactgggtcagccgtcagaaagtcaccgaccccgctcaaaaatgcttgaaaatgcggtgtatcgttgtgaaaggctacggcatctgcatcctgccagtgctcaataatctcataatctgtatcactaccaagtttcttaaaatgatcataactcacattaccagcttcgttacgtgacccctgaaccaatttgtcaatgaaggcttcgtatgccgtctgctgtcccggtttaaccgctaattccacgttaatcactttcatgatgtgacctcatttctcatttaataaccttattattgaggatttaataccttatttcaatcaaaccgacttcttttaaagtaaatggctgtgagccccttgaagagatcacagccacttactgcttgataaattactatcaagattaatataccactaatttgcgaaggcacaacttttttaagtaaaaagtactttgagaaagctaatgtgcaaaatggctttaatcgttaacgattcgcttttttgacgtgagttggctttaactgaattgatcctcttttactatctaaagcgagtattttccatgtaaacagcaaccacagttaaaatacaaccattatcattaatttattgtgaaagatttattaaagattccattcgtcatgttcgtgaaaatcaaccgaaaacgttaatgtataagcctacaaacataaacttatttttcataagtgtttttaattactttaaatgtgctttatgatattatcaacaatggagggtaaaatattattaatttgttattgtaacgtgggattatacaaaaggagtaggggatttactatgtcaaaaaataatatgagatcaccatttattgataaaaagcatcacgtaaagctttataaaagaggtaaaagttgggtagctatgggtattactatggctacccttactggcgtttcattcgtaataacgaccaacgccaatgcggcagaaaaaacgattaatgaccctgcctccaccattagtcaaactaactcagccgaacaaccagctaacacagactctcaaaacggaacaaccactttgtcatccgataacacgggtaatcagtcgacaggtactcctgttgcagatcaaaatgtagaccagccagcacagccaaatgcaggtactttagctgttgacacgggcaaccaaccggttccacaagcagcacctgtgacggctccaacgccggcacctgttccgaaaccagaaacatccacacactctgtaggaccaaccgttaccaccaccgacaaatcgggtgcggcttcaacggatccacataatactggtagcagcaacgataccccaactgaagtttcaggtgaagacgttgctaagaactttgttgctggcggtagtaacgggaccactgtaccccaaatcaacggcaatactgcagatttaactaaccccaccgatcctacttacgttcaaaacggcgcgatcgtggctaaagacgcagttgacttcaatactgactttagcttaaatgccacggtaaacgttaagtgggatagcaccatgggcagctggctcggtggtgacggcatggccgttgcttttcaaccaatttcaactaacgatgcactaactaagggctcaaatggaagttcaatgggccttgtaacaagtgctgaaggaactatcagttacattatttcaactgacgcagttggttattcacctcatactgtggatggtaattcatttcctcaggcaactaactgggtaatttaccaatcaggtgcaaacagtagtcaagctaccggtggtgtttatgataccggaattgtcctgccaaagaaatcatcaagtggcagtttaaactatacatttgacgtcgcctacaaagcagatacaaaacagttagttactaacattgttgatggtaataaccgaatcgttaaaacttatagtcagaagattaatgacagtcaaatcgggaacaactttgtattgggcgttacagcagctaccatgtcttcaaaagccgcttatagcgtcacaatcaacaagtatacttacgttccagcggatgccaagctaaacattaccagtaatatgcccaatgttgctcagtcaggtatcaacggtactccaggacaagtgattgcgttctatcaagaaggtactaccaaaccaacaaccaataataagggcaatgccgtttctgctgcatataccgttcccgcagttaaaggctataccctctcacctcagttcatcaccttgactgctggtggcgaaaatacgatagcgctaaactatgttggcaatccagttacggcggccgtgacgattccttctaacttagggtaccagattgtgaataatattaggggccacgtaggagacgttctccatatagctgttcctacaattgccggctacactcctgataaaaatcaggtgactgcgactgttcaagcagatggcaacattaccgtaaattcgcccagcgcaaagactggcgatgccggttacgtcacttactctatgaatgagcaaggcgctacccaaaccatgatcgtcaaagttggcgacaagacttggaccaccactgggctttcaggtagcaatattacttatgacgcaaaggcaatcctagccttgattcctgataactatacgattaacactgataatggcagtacgaccatcgaacaactcttaaattcagcaccaaagcaatttgatagtgatacgaccaaagatcaaagctggacgttaaatgtttcacctgctgaagactttagtcacaccacaacaacgagaacaatccatttcgttgatagcactggtaagaccgtctcaccagacgttgttcaaaccgtgaactggattcggactaacgacgcaactactgatccagaaaatagtgcttattctccaatggattggtacaccagcgtgcctgctcccacaattgccgggtatacacctaataccagtaacattgccgaagactacccaatgattaccgatgcgccaacaaacgctgatgatatcaccgttacttacacagccgatacccaaacgatggttgtgaaggttggcgacaagacttggacgactactggtccttcagatagtgccatcagctatgatgcagatgcaatcattgcccttattcctaagggctacaccgttagtggttatgcatcgacaaaagacttcgccaatgccttgaaacaaggtggcctagttaatgctctggtgggtggtagtgcgccaaccaccttcgatcatgacaccgcaaaggatcaaacttggacgctgccaatttcacctgctgaaagcttaaaccataccactacgacgcggaccattcactttgttgatgaaaacggccagaccgtctcacctgacgtggtgcaaactgtcaattgggtgcaaaccgtcaacgctgctactggcgagccgacagatgcgtaccgaccaatagattggtatactagcgcgcctattcctaccattgatggttatacggctgatacgactaacattgccgaagactacccaatgattaccgacgcaccagcaaacgctaaggacatcaccgttacctacgaaactgatacgcaaaccatgattgtgaaggttggcaacaagacttggaccaccactggtaaatccaacaccgatatcaactacgatacccaggccattttagctttgattccagatggctacagtatcggtagcaaccaatcagcaactactatcgaagacgcgctcaaatcagcaccggctaaatttgataaggattccaaacatgatcaaacttggactttagaaatttcacctgctgaaagcttcaaccacactacaacaacgcggacaatccactttgttgatagcactggtaagaccgtctcaccagacgtggttcaaactgttaactgggttcagactgtaaacgctactacaggtgaaccaaccaatgcctatgccccagtagattggtataccagcgtgactgttccaacggttgcgggatataaaaccgaaacgactgacattgccgaagattatccaatgatcactgataatccggaaaatgccaacgatatcaccatcacctactcagccgagacgcaaaccatgatcgtaaaagttggcgacaagacgtggacaacgactggtgcttcaaatagtaagattgactatgacactaacgccatcttagctctgattcctaatggctacagtatcacttccaatacggttggtactaccattgaacaaatcttaagttcagcaccaaaacaatttgatactgacaccgcaaaggatcaaacctggacattgccaatctcacctgctgaaagtttcaaccatactactacaacgcggacgatccacttcgttgataaaaatggcaagaccgtttcaccagacgtggtccaaaccgttaactgggttcaaactgtgaatgctgctactggtaagccaactaatgcatataccccaatagattggtatacagccatgacagctccaaccatcacgggttatacaccagatcaaactagtgttgcagctgaatatccaatgattactgatgcaccaacaaacgccacggatattacgattgtctatactggcaaccaagttacggtcgatgttaccattccaagtaatcaagggcctcaaacggctaccaacgtcactggtaaagttggtgaaactgtcactgttcccgttccaacaatcgatggctatacagctgataagtctatggtgagtgcgacagttaacccggatggcacgattactatcaatggaccaaaggctaagcccggtgatgcaggctacgtcacctataccgcaaacagcaccaacggtgggaatactattcaacccggcgataccagtaaccctactaacacggataatcaatccccaacgattgatgaatcgacacagccgggtaccgtcccaacacagacgccaacaataactgagactgaaaccgaaacagctaccaatcaaaacgtaactgcaactaaacccgaagccagtcaaggtatcagccaatctgctggtcacagcactggggttactaagacaaacacacctgttgcgggttcaacaacagcagtaaccagcactcagttgtcgcattcagtagcaacttccggtgaaactacaaccggtcagcagaaggggcaatctgctaccggtcaattaccacaaaccaatgaacaatcagagcaagccagaactgctggagttcttggcttgatgatactgagtctattaagtctgtttggtctgaaaagaaaacaaaccgatgacaaataatcattagactggagatcaggccaggatagacatagcgaatttcgctattgccctcctctccagaatttaagagagaggctgtgacttaagtcgtaaatcatagctttcaaaaaaggtttatcgaagaaatcaaaatttgatttctcgataaacctttttttctgaataaaatcgggattttatcccctgattttaaccatattttaaccattttgtccatatttaaggccataagacgataccggtttccttagtaaccttcgctaaacctcggaccataaacttttgaaccctaaataagccttcattctaccgaagactggttctaacatctattttacgccgggcatacattttgtgccgtcgttcctgtggttaaccggtcccgctgctagctttaaaatattcccaactgggattgatactgatatatcgggtttgtccagacccgtcagggctgctggaataacctggtgatcctcgtcgaattttctgcccgatagattttgaaatcacgcgtgataccactcttgtcagtgccttagaataacgctggaagttaaatctaacgcccgttgatcaatataatagtcgtccatcagcgctgtaattccagttcatgattttacgatcatcagactgccactgacggctttgttcttttaacatcgttccgtacggatggcttgatggtgctcatagttatcttctattgtacggtaattgcttctgaaccataaaccgcatcagccacaaatattctcagccaacgtgttggtttttgctagtcctcagaaatggaaaacgtctcgtatcgttgggacgctggaataaaccgaaacctaaacgattgatttttttggcgatttgtaagttataggctggcttcaactgaccattcaacattggatcttctttgacgcgcatgaggtgctatctatgtcggttttagagtagctttgcggtcaccaaagttttccaattgatgctgatgttcaatcatttgcctttgcgttgagtgagctggcgcttgatcttcttgatttttcgacgatccttctagtggatggggcgataatttgggagattgtttgatctccttatccagtttatcgagccgatcctcaagtcgagtcaatcaccctcatcctcatttccagggttaaattcgtcccctcgggaacgaaagctgcaccgtaggcttgcttatatcagccagatcttttggattgcttcacgattcactgatcaaagcgcacggtattcttacgccagacaaaactatacttattgcatcagccaaaatcttggtaccataataaaaggtcacatcgtcaattaagttttgacgacgcaagtagtcaaccactgtctaacccatcatgatcaagtttctaactcatcggaaatccggaagcgacaaattgtccgatacgtgggcatctgttcctgggtacgccagcgagctgttagttctccaccgcaaaggtttcgattcggcgactactaaagaccccgcgagtgtaggcgaaagaaccagcttcatcatgcacccaaatctattctcgaggacgacccgaataggtagtgctccttaattgagagtgactcaccagttcagttcattaatatagtaagcaggattatctttttgaacgatatagtcggtagttagaggtaaaattgtttgatccatgttataatttgtcatgttggattgtcctttcgaggatgatttttgagtatctggtgtgaccggtactctttttttctgtcattatatcaaaaaagcaggtagttaaaaatccttggatttttaactacctgcttttgaattaagggacttatgtcacagcctccctttttgtcgttctaaaacaatataagatcagttacttaaacccacagccttcatactgaaattccaaagttcacgttgtgcctgtttatcataagataattttgacgatggcaccggcttgtcactgctgcggtcgtagtacttagcggttccgttagcaaatttttcagaacacactaggtccgtaatcatctttccagaccctttagcggtgcccatgatatttgcaaaccgtctaaagaccgccggattaaaatgtggtccgtgtttcatcagtccagtttctggcatcagtcctggattgacggtgttaacggtaatttttttaccagcagcttttaatctctgatccagttcataactgaacaaaatcagacatagtttggaaaacgagtagctttgacgatccacctgtcgattctttcctgggtatgccaaggcttctgcaccaggccaggccacaccctttaacggtgtatcatggcgttcgctactaacggtgacgattcgcccatcaggtgccattaatggcagtaacagttgtgttaacaaaaaatgacccagatagttggtttcaaaaatatggttgaagccatcatccgtttgatgaacgtttctactccccatcccagcattgcagatcaagctataaagcggtatatcgagttttttaaacgactcaacaaaggcgcgaactttgcccaatgaagaggtatctaattcaagacaaatgatattagcgtctggaacagcttgcaagatttgttggcgggccgctgtcgccttttgcatgttgcggcaggccatgataagttggtagtccgccccttttgctgcaatctgtttagttgtttcaaaccctaatccagaattggcaccggtaataatcacggttttagtcatgttttttctccttatcagatataaaagcccaatatttcagtaaatgtgacactgaaaatatcgagcttcaaaaatactttggtaaatttaagttttaagcgatgggtaatggtgccggcaactgtggtcccaacccgcgtcgagccaaaatccaatcgtcaccgctccacatctctgtcttttgacggttagttgaaaagtcccaatagctttcccgttcaaattcgatgacttgcccatttggtccaaaaccgacccattcataactacccgagtcgaccaggttggcgtacttggcccactccaacggaatcttgaccgtttttccggctgcattcacataggttcgttcctgacccgtcaataagtgtgactcttcaagctgttcccggtaatcagggtcaatctcttgccagacccgctctgctttagcgaaggcctgcttttcatttggcagcgccccacttaacggctgagtcagcgcgttataggaatagaggtaacccccgtcaccataaataacagtgacgtgttcgcggttcaacgcttcttggggtaaatcggcaggctgatatcgattcaaatgaacctgcttgccgtttcggggaactaacttatccacaaccacttgataatctgctggtatcattaaacttggatagatgtgcccttcaattattaatgctggcattagtagccttctttctttttgaattactcagcatccagttgtgcaatttgtttgaggatggcgacaaaatcagcttggcttacccgaccatccgttacagacaagcattgacttagtaccttttcctgctcatccagtgcagctttgattttgggatacaaggcttcaccagtcgctgtcagtttaagttcataccgtcggccatccgttgctgactgccgtttatccaccagccccattttagcgagcttcgcaatttcacgattaacattgctttgatgacggctgtcagagcgtaccagctgatcctgtgtaatgccaggatcgtcgtggagtttaaggatgaagaagaattgtgcctgattgacaccatacggttttaaccgtttttctaacactcgaatggccatattagaagctgtatgcagctgtttgctgattgtattatcgtttttatctgcaatcatgcaatcaccacctaagcattgacaacggcgaactgctgacggatatgtttaggcgtttcaatttcatctaacaaagcagcagcgaagtttgcgaaggatacttcttcttttccatcggcactagtaataacttcatcgttacctagcttatagctggtcttaggtccgtcagcaaattcagttgatggcgtaatcacggtccagtccacgtcttcaacccatttaataaagtcatattcgtgatcttgttgaatcataccatcaagccaaggttggccagcgtactttttaagtgtgtcagcaagtaacgtttcgccggtttcattgtgaagaatggaagcaccaacaacaaacgctaaacgagtgctgtcatcttccctaaagaaactgactaagcgagcggctaaatccaagtgtaaatatggtttggtcgaagcaaaagcgtcaacgacaacatcatagccagctaaatcatcgtgagttaatgtcatggcatctttttcaacaattgtgacgtcatttcccagtaagttcttagccttttcgccatcacgaacgagcgctgtaacttcatgtccccggttcatagcttctcgagtgacaacttgaccaacgttacctgtagcaccaataataccaattttcataataatcgttctcctttttagttaaaacttctatttaatttcaatcttccttacaactaatcaattctgattcaatctcgcttacaaattaaacaatttttcagcagtaccgtgagcgattgcttcccgttgctcgtccgtcacttcggcttgttcaagaaattcacgaaccgttttacctgactgaacgtatggaaagtcctctgaccacatgatgtgatcggcgcccatttcagttaaagcaagctgcatttgtggtgcagtgaacattcccgatggtgacaggtaaacctggcgtctgtagtaatccgaaaacttcagtggtaaatcagtaataatcgggctgaagccatcgatgcgttccacaaacattggcagaaattcaccccagtggccagtagctaacttaacgttgggatacttttctaacaaaccggccgtgataatccgcaatacctgaatgccagcttccatgtgccagccccacattgcaccagccatcatggttgcacctaatgctgagtaagccttgctgtcatataacatggccttttgatcgtttgaaatgacaccgggatgcagataaagcgtggtgccaagcttgtcggcagcggcgaaaatagcttcaaacttggaatcatccaagaactgtccgttgatactgccgctgatgataccgcccttcatccctaatttagtcacggcgtattctaattcttcagcagctttatctggcacgttagctggcaaagttgctaacccagcaaaccggtctggatacttgctgatgttttcagctaaggtttcgttttgatcatgggcgccagaaacggcgtattgatcaggcagcacctgtggtgaattaccagcatcggaaatcacttgcatgtcaatgccgttcttatccatgtatgcaatcttattgctgaaatctaccaggtcaggtcttaactgatcctgacgcgggttattatttttgacttctgagtacttgttgaactgactaatgttttgatccgtatcgtaatgttcttctactgtaataagtttcaagctaatcctcctgtaactgctcacctatttgtgagccaaacctttaagtgaaatgagtgtagcacatttatatgcacgtgcatagttttatttaaaattttttcagccaactacctgtcgactgttcatcttaaatcttaaaacaatgtcgtttaatttttgaaccaaaatgagtatagcataaatatatgcgtgtgcatagtttttctctcgactttttttaaatccgtaagtgtataccccctataaagcccataaacacggtatttttaccaaaaaaataatcaccaccccaataaagtgtgatgattatcgtcaaaatgagttttaatttttaaaactaaaaattaatctgattaccaggcaaccttaccggcttcttgggtaaaggtcccgttagcatcattcttagggtcactagccatttcgattcctcgacgggcaccatcagcaactgattgggcaccgtgttcctcgaaggctttcttattgagcaaatccgttgccgtcatgccggggtcgacagagttaacagttacactagtactctcaagctccttggcaaaggaaacggtgatccagttaacagcacccttcgaagcagagtaggcaaatgaattcaagtggtagaataaagaactcttatccatagcggcagtcaatgaacccatttcactggaaacgttcagaattttaccaaacggtgccttcttcaataatggtaaagctgtgcgaaccatcgctgtcgtaccaaaaaagttagtatcaaaaaccttccgcaaaaattcatctgaggtttcggatggtttcttcggtgcaccaccagaaataccggcattatttaacagaatatttaggtaaccaaacttcttgtcaatggcagccatggtgttgtcaatagtgctttgatccgtgatgtcacagtgaaccaggtcaacagcaattccttctgcactcagctcttcttgagtctttttaccggcatccatgtcataggcaccgatgaaaatgtgctgaccctttttacctaactgttcagcatattcgcggccaagccctttttctgcaccagtaaccaacgtaacgatcgtatctttcgacatcctctattcctccgtatcttctagattcacaaattgcatttagataagctaaatgctacattaaaatgtaattactaacatcgaaaagaagtgatccttttgcaagactctgtcaattatccagcaactactgcgctttggcggatgaccagtggctaccgagcattagtcaccaaacagttgcgtcaagtcggtatttatcctggccaagaaaatgttttggtcgaattattaaactacggcgagctgtcacaaaacgaccttgtcaaacggttggttgtgaatcattcaacgattgccaaaaccgtttcgcgactagtgtcatctggcttggtctcgacggtgaaatcagccgcagatggccgaattaccttggtctccttaacggatcagggtcaaataacggcccaacaagttaagcaaatcctcgatcacgcggaatcaaccttgttaaggggactttcccagaacgaccaggaggcctttgtttcaatggccaatcaaatcagctctaacctttcaactgaagctaatggtaaatagtcggtattagtcacttcggaatggttgccgaacatgctcacttaataacttgttacccgaaaaaaacttaattttgttcttgcggtttctggtccaaatctttatctattagcacttacaatttagagcttatcacgaaaatatgtggctggcaacacttttatgtagttggcaacatattttactgttaccattccaaatctactattggttcatcttcttcagcaatcgcacaaataattcaccggcaacacttaactgtcgataagcgtaaattgcggttaatttgggtgcgaccatgtctgtcttaatggtgactaattgccccgaatccagtgcatcttgcacacaaaacgttggtaaaaaggttacccctaatcccgagatagtggaattacgaattgtttcaatactccacagttccatctctggtcttaaacgaatccgcttttcggtcaaatattgatcaaataattctaaataccgcgcgtgtgggtcattcatcaaagcacacacgtccttatcctgatcaggagtaatgaagtcctcatcagccagttctggtgcggcgactaatgacaacgaataatctttaatcattcctgtatgaatggtggcgggataattgcgtacatcataatgaatcgcaatatcagctttgccatcaaccatttgtgaatagatatcgtagcagtttaacactcgaatcaccagttctacccccggtgcttgctgcttaaactgttttaaaacaccctgcatctggtaagtcagcaaagtctctggcactgctacaactaagcgacccactggttcatttgtatgatcagcaaaacgttcaagcacggcagcatccgccaccaattggttgatcaacggcatggccgcggtaccttgactagttaacaccattttgcgccctactttagcaaaaaggctgatgccaagctgcgtttcaacttgctgcacctggaaagtaaccgtggaaggcgcgtagtttagcaatgtcgcagctttttgaaaactacccgcagtctgaatcgcctggattgtttttaaatatttcagatccatattaaaacctctttattttaaatgtttacttcaatattattgaaataatggttcaatcatttcgactagactgaacaatcaatcaactatatactaacagacattagcagaaatcaggaggttttttatgcaaatcaaaccctttaaatctaatcctaacgttgtcgccgaattagtcgatttaatcttatactgtcaaaatacagaggctagcttgggtatcaccatggcagaacagcccgatgttttcgaaattcccaattattatcaaaaccgcggtggtcaattttgggtcagttttgatacagacggtcacgtggcagggtgtattggccttttacggatatccgataccacggccgttttgaagaaattctttgtttacccacaattcaggggccgtccagttagtttgggttggcaactctaccaaactctcctagaagaagccaaacgccgtgggttccaacgattagtactcgatacgccagagggcgagcaccgttcccatcgtttttacgaacgacaaggttttgttcaatgttcctatgaagacttaggtgtggaatacgccttcccaaatcgagatagtcggttttaccagttgacgctttgatttccaactaaagaaaataatagtgtgcttcgaaatattaaattacactattgtccgtatcaccgaatcgtgctataactatctttaatttcacaaacaaaattatccaaagaagagtaaccagtgccgctggcttaagagaatccggtcgatggaaaaggatgtcagtcatctggtgaagatgaactttgtcacgatatcaacctgttcacgcaggttgatcggtaggaaccgttagcttccctggtattgattctattggtaccgatgaggcattatttttgatagtgcgaaattgggtggcatcacggcgcattcgtcccttgtttatggggacgaatgctttttttgtgaaaaaattaaaaaggagtgttgtgttatgaaatttgtgattgatccaaaggtacttgaactaggcgtcactattcggggtgttgaaattaccggtgtgaataatcagcagtatcctacaccattaactgattatattcagactgaaatcaaccaggctctggaaggactcgaccgcgatcaaattaaaactgaccccatcattcaaggtttttgggatttgcacaaagctgttcatttaccaaaacgaaacaacacgccggcacccgcaacgttactcaaattaattttaaaacgtggtgccctcgcctcaatcaatccaatcgtagacctctataacttgatttccattcaaagccgacttgctttaggcgctcacgatattgatcacattgacggcaacgttaatttacgacttacggatggcactgaaaaatttgtaccgattggcgcagataatcaacctgaaccagtcaaagcaaacgaatacggctacattgacgacagtaacgagatcatttgccatctagaaacgcgccaagtggagaaaaccaaggtcacacctgataccaatcacgttttctacatcgttcaaggcaatcaaaataccacccaagactacgttgaccaaaccgctcaacgagtgattgatttgacaactaagtatttgggtggcgaaggccagtttcttaattaaaattcaaccacaactttgcctcgagttttgccatgggcaaccagctccaaggcattgttgatatggtcaatgtcaaaaacatgctcatcaattgtcggtacaatttggttttctgccactatttttgtgacctttttgagttgctgaccatcagagcgaacaaagataaaccggtaaaggctatcatgtttgcgagcaatctggtctaactttttgccagctaaactaaacaaaatggttttccaaaatggcaatcctcttgataccgcaaaatgtttattcggcccagcaaccaagcttaagattcggccacccggtttcaaaatggacacttctcgttcaatttcctgtgcgccacgagtatcaataatataatcaatgtcgctgagaactgtccaataatcttcctttctatagtctaggtattggtcagcccctaaagcaacaatgcgctctctggcatctgagttaccggaaacaatgacttttaaccccatttgcttagcaagtggcactgccatttggccaaaactgccggaaccccctgggataaagacagttttattcggttgggcttctaactcttccgttaacccttgataggcagttagcccagtcaacggtacagcagctgcctgttttaaggataagttttggggtatataccaaatagcatcttgatcaacggcaacatattccgcaaacccacctattttatcaagaggtaaacgtgaataaacttcatcacccactttaaaactcgtgacttgacttcctgtttcttcaatcacacctgaaatttcgttacccaacgttagtggcattcgataattttgaattaatctcacgctaccattgatattcatcaaatccacgggattaaccgcggcgtacttgactttgatcaagacctcatcgggagctggttggggctcgggaatgtcattgacttgaacattaagtgatttggaatatttattgatttgtgcgactttcatacttcggtttccttccatggtagtgattgtatcgtgtatttaatgacggaatcgactgtctgattatctattcgagattggactctgatgccaattaacgcattttgcaaggtagttgctaacgcggatacttcgacattgggtagcaactcggactgaaaacgacgcagaatttgagtcaaaacccttttctcagattcaaaatattggccgaccagtttcctaacctctgaatcaacggatcctaactcagtggctgagttcactattaggcaccctttgagagttgtgtccgtatgatgagcatacacgttaaaaatggttctaagggcatcctccagattagtcgttgaagtaagtttcgccttaatttcagctttcgtcatgtcgtagtaggcttgcagggccaaaaggaaaagacggtgcttatcaccaaatgtatcgtatatgctctgtcgattgattcccatttcattaaccagggtgctcatcgaggtaccatcgtacccttgtcgccaaaataagtagaccgcctgcttaatgacggtttcttgatcaaacgcttttgttctcattggaaattacctctttttggaatgctcgttccagtatagaataaataaaattcatttacaatcccaattcttgcgactactctaaagactaagtttcaaaagtgatgtaaaataagagccttgaaccaaataactcgaaaattactggtggcgtagacatgacagacaaacgaatcatcaaaacagaacgagacattaaacaaagtttcttaatcctactaaaaacaactccatttcaaaaaatcactgtcaatcagatttgcgaggctgcactggtttcacgatcaactttttacgaacattttcaggacaaatatgatttgctgggacaattggtaaatcaatatgccctactctatcagcaattaatcgaacaacgagccacccagattatcaaccaagacgaacacgtgctatcaatcccagaaattgccagaactttgcagaaacatcgcgatgcattgaacgtgctgctcaacattcacgaagaaaactatgatctgctcgtccattgggaacaaagtttaagcaaaacctggcaccggcttaaccatcactatggtgctaacaagaacgcacccgctgattttgtctctaatttagaatcatccattgtactcaattacattcgctggtcacttaaaaatggcatgaacgatgacgcagctgctttaagtgaacgtatgattcaaagtatttacagtgattcaaaaggtcaatcaacagcttctaagtaattaatttggggtcaatcgaccgttatcctacttttatacgcatattgtccgttatcggacggtgtgcgtttttttgcagattgaggcctcccttaaagtgattcatactaattgttgtaatgaaaacataggggaggaatttttatgaataaatggttcaaaaatccgtttgcttacttagcactgctcatacccgctttaatcggtgggttctttgttttaggaggcgtgccagggtttagtaaactaccaacgtcaaccgatcagctgagaatcacgattgtggatcaggataaaaccgcgattaccaaaagcattaggaatggtttaaaagataacgtgccctttaaacacgtcactatttccagcaatctatccgctgctaagtctcggctgtcagaccggaccgatgccatgactgttcagcttccagcgggctttacaaaggacgtcgaggctggtaaaaacccgaagcttaacttctacgtcagtgattctaacggattgttgcaaaataacgttacccgctcagtcatcagcgccgttcaaggtaaaattgccaccgaattgacaacggcaagaacaacgggtgccatggctaagcaaatggcaccacaaattgctaaacaagttgcagccaaggcacaggccaacgatgctaaacagcaggcatctgcagcaaaacaaggtgctcaaatgaatcccgctgcagcaaagcaaatgcaacagaagctgcagcaacaggttaaacaaaccgttgcaaagcagactcagttacaggcccaaaaggctgctcaaaaattgtccgcaacacctgatactcacaccacccatctgcacaaaattggcgggaattatcagtatcaaatgggaccaatgttcttgaacatgggtttctacttgggtctcatgatcatgagcatcattttaaccctgatgttcatgggcgctcgctatgccatgggtaaatggcccgctttcttaatggcacaaatcaacggtgttttagcaaccgtgattggtcccttggttaccgtttcattactaagatgcttcattcaatttaacggtggcactttcatgtctctgttaggaagtgaatggttgtttggactaggtgcctttgagctctccttctccttagccctgctattaggtggtctcccgtcatttttgattcaattaccactcatggtctcacagacgattgctggtggcgccattattccacgccaagccatgaactcattttatcagtggctgagttatcacacccccatgtatcaaggagtctacatgaccttcaactcgttgtacggtggtggcaacggcagtgcgtatagtacaacgctgtggttaatcgtagttgttggcttaatcatcactattctggcagcagcaattggctatcgtgggaaggaaccgcgtggcttttctagatggatcagttttaactagtttaacaatttaaataataggtattaaaaaaatcccgtttgacgacgggattttttgtttcattctctttgataagccattcaccaacaactaattctgttataatatttgtgaaagatgactggtcgctcatgacaaacattgagggtggttcttatgacttctaacaaatattttgctgctgatttcgtccaacaagttgctgtgctgaatttggtcatcacaaaccacattacagagatactagcgccatatgaagtcaatgcatctaattacttctacgtgatgaaaatcagtgaaaatcctggtattactaggagtgactttaatcaattagttcatttaaatcatagttccatcacccgagcagtaaatcacttgattgaaaagggattgatcaaacaatcaattaaccctagagacaagcgtggtactcaattattcttaactgataagggaatccaactaaaccgcgaaattacacaaaaaatcagcgagttaaatgcaaatctaatgacccgtctagaaccgcagcaacaaactatttttagcaatattgttaggttacgtcaatctattgaacgagattatccagaatagaaaaatcaatttaaccttcaacacatcactaccctaaccgcaataaatagcctactcagattcacccaattaatgaagtttgataagtgcatttgcacttaatttatgctactattttggtgagaattgtaggttgtttttaatgtgtttaaccaacgtttaccggtagtctattgtatatgatcaaaaaatgattatacgtacacgttaaacgtcatttttaagagaggaatttttgtatggccaacaaacgcataagaaaaaagaaattgaaaaaagcgattagtgaaggatcgccccaaactgttaaagatgccttaactgcatatgtggatccgcaaacatttgattcgaaaagtgatttcacaacgtatttgaattcattagtgactgattctaaataagtgaattgtttttaaggggtgttaagaatgccaaaccgatttaatctcgttcgctactaccatgaaacagctcgtgctgatattttgcgtaaaaccatgccctactaccagatcagttccgataaaatagcacagcaattaggtatcagtacgcagcaagtattagaattgctgtcccataagcgttgtctaacgactgaaatggctcgacgcattgaatcacgttcaggtttgtcagcagacttattactgaaactggatgctgattatcaaagaaatccttctaactaaggtcatgtctactagagacaaattaaaagaatgctaacatttcaaacgtcaaattccattattggcgtttttttcttttaaaataaagcattgcgagaacaatattattcaccgaattattttttcaatcaaaaaagccaatccattttggactgacttctgaagccactattatttgctaaaataaattgtgtacaattgcttgccaagttgctgcattgcgcctatttgtttactttcattgccatgctgtgaaagcacaacaaccacaaaggcctggttaccttttttaacgatagcagcatcattttgaaccccatagtctggaaattcaccagtcttgttgaagacagttgctttctggttgattaaagctggcagtttgctttgattagcgttatatctcagtaactgcaacatttctgcgtcatagggatcacccaatactgaatgttgctccaattttactagcagattaccaacatccttcacggaagtcatattatcttttccattcttcaaagactgatagtccagcatcttccgctgtagctgtgtgtcactgcaacccagccgtttgatttcattattaatcacgttcaaaccgcctaggcgatcaatcaaaacatttgtcgctgtattatcgctatttcggatcattaaagtcaacagccgaataagtgaaagctgattaacattttgatgagccaattcaccggtaccacccacctgatcagttttaggaattgaaacttcttgattgagcgttaatcgaccagattttatttgtcgaaaagcttcaaccatgatgaataacttaatgacactggcagacctctgcgaccgattatgcaccatgacaggttgtttgtttcttaaatcaacagcataaactgaggtctggccagaagctgacgcaatacatctttcttcacttaatcggatatcgtgttgaactaaatctgttctagaattagttttacgctcagcaaccgaatgtttcacctgattcgtactcggcttaacttggctggtcggctttgacgatgaagtttgatttgctggatggtttgtttttgagcaaccgctcattacagctaaccccaatagcaaggaaacagcaactctactgaacccaaacttcattaaccaaatcccctttgtaaggttttccatcagttaaaacagctccgccatcataagaagtatagccataataggtttcattttcgccgttactccaagtaacatcaatcttaacgttagcgttaattgatttggtatcattggtaccagaagttacatcatacgaaagaataccactctgattggttgaagaaatagttgcaacaccatgaaagctagtgccatcattattttcctgaacaaccgtaccatctgaatcaatgactaaatcactttgttgacgattggaatcataattataaaatgaatagtctccgacaaatttagaatagtctgaaaaactatcattggtattcaaactagttgacccgttatttgctgctgcttgattttgctttttcccctgctttaacagaaaagcatcattgctcttttgaatttgaaaatattcagatttaagtgaactaaacccctttttacttaagtcagtaatctggatgccattcaatgctttgttggaatcctgataatgaccatcttcgttcaaattacgagccgtcttgataattccttcatcttcagaaattttactttggtttttactagaactacttgcacttgaactcgcctgagaacttccgcaacccgctaatcctaacgttaccacagtaaataaactcaataaaactggaatttttttcatgactctgccccttagaatagctaatatatttataactcttactaatcttcattataagctagtaattttgttaagacaatttgatttatcaaattaatcatttcattttcgtcaccagtgatgttagttgaaacacggttctaatacgagccacccttgcacccacatcactaaaccattaaactatttcacgattgatcctcgtaaatccaaaccaaggtgaaataactcatgaataagccgcaactcgttcaactcaatgccgatattggcgattatctgaaactcggtgcatgtactgccgtaatgtcgcaacccattttgagctacgcgttaaccactcatcctagtgctggcgtccaacttggaattggcattttgtacaatttggttaaatacactgcgccagcctttatttttggcatcctctacacaacaactcgtacgaccattaataaccgtaatctgacatatcatcaatacctgaaaaacacctggcacgcactgttcataccgacaatttggtggacattgatttatttactggtcatgccacaaatgcagcaagttaatcactaccataatcttggcacttttctgtggcaattcatcaacggtaacgctgctcctcatctgtggtataacaccatgatgctgcaatttatcattttgatgccactattctggaccctcggacgctggtgcgggcagaatgcaaaacgtggcatattgacggctggcagtaccgtcatgattgccggtctgtggttatggttctacgacacgcaggtatttaacggtccccatgccactgactggtgccactgactggtgccactgactggtacttatttgaccgcttatttatcagttttttgctttatggtatcttcgggatgctcgcatggcaataccgccaagcgttcaaccgtttcatcacgaaatcgtggccagcaattatggttgttttcgtggtgacactctggtggactaatcatgaattattcagttatggcttcccaatcaaactaagtaatgccccctactacaaaccgtcaatgacgatctatgacctagcagtcattggtttattcgctgcactgtgtctgcatcaggtaaaatccaaccgccccttcacaaacttcgtgcatcaatttgctggttttgcctacaaggcatacttgtccaacgtcttttggtctgaatgtctgtggctattatttggtaaaactttgacaaccgtttctcccttaatgggcattctggttgtttatatgttaacttggtgcctgtcctttggctcagcgtttggtattcatgcgatttgggttcgactcaagaatcataattaaaaatagcgttgcggaagttctgaaatagagcatccgcaacgctattttgtacctaaaatctgacactgccatggcttctcaaaaagtcggccaacactttaagcaatgtataagatacataagattcagtcacaatgactggtgcgccaatagcttaagtgttaacttgatacagatcaaattttccgattacagttaccaatactaatggcatgtaagtcagaaaaagaccaaaatttcaaaaattgagttactaaaaaggtgatgtcatgctcaaacgctttccaaaattgctcagtctcgtctggatgattgtattattcattcttcctctcccgttagtactgactttggcagcaggtttaccaggtcaatttactagtggcggtctcgctatccaagctggttccatcgcttacgtttggttcttaatcgctatctatctggcaaccaggccacactggctagatcgtttgattggcctaccaagtgtctacatggtgcacggctgccttagtattttcgctattatcctggctttccttcataaaatgggaactcactccggtggtatggtcagaacgacaggcgacattgccctcatcttattcatcggcttgatgatgtactcattagtattcatggccggatggctcacagataaggtgcctgctttatcacatctcaaacattggctggagcataccttcaaacatgaattttcagtttggttgcaccgtctcaatctaattgcagtcgttctcgtgttcatccacgtgcagctcattggctatatcacggcaatccatccgtatatgtggtggtttgacggttacacagcagtagtcgcactagcttatctctacgctaagcttcgcgatacttggtggctatcacgtggtaagcttacttcaaaacgtgaactggcaccgaacttcttcgaatttacttttagtttaaagtcacgccatcaactaacggttaaacccggggattacgtctttattagcttccctgattatgcgggattacgtgaactgcatccgttctccgtggtcaatgctgttcttgataatcagttagtgctggccattcgtggtgacggtgactttacccaatctgtgcaaaccctgccactgaatgccgaagcacacctcactggcggttttggcctcttcaataccatgattgctaaacatccagcaaaaccattagtgctcgtagcaggtgggtcgggtgttgttcctatgctggcactagtccaggcttacccacaattaccaatcacactgtactattcagctcatcgccccactgatttgatctacgtaccacagctaaaggcactcgctgctcaacgctcaacgttgactatacacattcagaccggtcgcttcgatgttaccaaagcagtttcgtcgataacgccaatatctgcattgtacctactttctggtccagcacgcatggggcaagcttggcagcatgctttgacacaagcgggagtatcccacgaaaacatgtattacgaacaattcagttggtaaaccatacaaagactcctcactgtgatcattaatcacgatggggagtcttttatgtggtcatcaaaatgccgaaaagtacgccgttaccttgatacttctgacgttgatttagtcagatagccatctttcatttcgtacaaccgatccgccgaatcaaccaaacggccatcgtgagtcaccaccacgacagccttatggtgcttaacagcaaggtctttcaagagcttaccgataacagccactcgtgtgctatccaatgcagctgtcggttcatctgccaaaatgatcgctggatctgggtaaagtgcgcgcgcaatcgccactcgctgctgctgaccgcctgataattcactgggatatttgttcaaaagatcttttatccctaacgtttcaagaacatccgttaacgcttcacgagagagattaccctgaggcttgatcttatcgactaacttaaactggtcagccacagtgagatacggtaataaatgataagcttgcaacacaaacccaattgaatccagtcgtaaagcatcgcgttccttcttagagcgttcgttatagctgatgccatttacttctactgttcccgacgtgggcgttaataagccaccaacaattgatagaaacgtactcttaccggatcccgatggtcccataatcagacttaaagtaccaggttcagcctcaaagttgacatcatggagcacatggacctctgcggtacctgtcccaaaaatctgattaacgtttttaactgaaaatgaactcattcatttaacctccaataacggaaacgggatcaacactaacaacggatttgattggaatcaagccgccaatcatggccatgacgagtaaccccacaccaacgcctccaagcaccggtatgtcaaaagccatgggaacatttgctggaattatccaagcagtgataaccgtaaataatgtggctacgattaacccactcaccactagtaagacagattgtgagattgttgcaccaacaagcactttacttggcaccccttgagcacgcaaaacagcgtaattaggcagtttttgcatggtcaagatatataggaacaccgcaatgataatcagcgaaatgaccattaaaaaaccaatcatcaaaataaaggtactgttctgagcctggtaaccgggcagtttatcgacaacttgctgcttggtataagtctttgcaccgttagcattatttttataattcgcatccctagagacaaccgcagacccaactggtcctacggtaatcgcccgtaaactcttccaatcgttcatctgtccgtaaacaactggtgcaatatttaatttagcgtttttaatgaagccaacgatcatatatttatgattgtcaccattaagtttgaactgactaccaagtttgtagccctcttgcttaaacgccgtatcgacgactagctcatgactgttagtcacacgatgaccgtctacaagattgagattttgataaacgaattgattgttattcaagcctaaaaataccgctgaaagctgcttatgactcttagccttagcaaccaccgaggtttcaccaattaatgcttcttgcttgctcagatggccaacttgtttttttgtcagaaatgattgccgcatgtctacattggcatttgaatttaacgtgatctgcttggcatcccacgaattgatggcgtccgtattctgctgggccaagccaagagctaaactggttagaataaagatgaggtacccgattaacacaatcatggcaacaatcaaacctgaccggaacttttctttcttaatttctttaagggctaaaaacaaaatctttctccttcactatttaacgttttgtaaaacgacacgtaactgtttgatacgttcgtccatactctctggatccagcacaacatcacgcactgtttggtggtataaagccgtaatcgcccactcttttgcactatcagcatctgacggaattgtcgtgggccttctgccaagaaagccttcattgtattgatagtgcaacttgatcaattggcggtaacccgcctcgtcagcctctaagataaacttgcgaatagaattaacatattcatcaatattatctagcgttggtcgcttcggcatcgttcgatgaatttcaaccatggcaacaccaaataaatagcgataagcgtcagttaaatcatcgaaatacttgtaaaaagctcctcgcgcaatgttcgcgtctttcacgatacgtgctacctgggcatcagccagcgggtaatgtgaaaattcgttcaatagtgcctgacgaattcgactctgtttttctactggtaaatgttcaaacgttgctgaaaccatgatggattcctctctttccagaataagtgacaccgtgtcaccctcatcgactagattagtatagcagatagtgacacggtgtcaatatttttttagtcgatatccacttgttatggattcatttaaagaatttaacgacagcgcaaaatggtgtggatcaacacagtctcctgataggatttacatcatctttctcaccggttaaacacaatacttcctaaataattcaaatcgattattgcacttatttatatgataaattatataatatatagagcataagataattttcgagttgtactgtaactctaacggtaacccgtaacaagaggaaaattaagtaaagaaggtaattgaatggccgaacaattgtcattattaaacagcgcgactagctcaaagaatgatagccaaccaacccaccaatcgctaaaaaacgttcagccgttagcgtatcggatgcgcccacgaaaaattgaagaagtaatcggtcaaacggatttaataggtgatgggaagccaatctctatgatggtagccgctaacacactgagctcgatgctgttatatggaccacctggtattggtaaaacttcgatcgcacaagccttagctggcagtactaatcgacggtttatctactttaacgccgccaatgggactaaagctgacctgcaaaacgcactagctgtggctaataccgaaccaattgtcttatttgtggacgaaatccaccggttagatcatccgaaagtagatcttttattggcatccgtagaagatggttccgtcactctaatcggtgccactactgaaaatccgttcattaacctgcccctgcattacgcagccggatggtcatttatgaattaaaaccactgactaaagatgagatcttaaccggcttaaaacaggcactaaacgattctgaccgtggcttaggaaaatacgaaactgctaaaaaaatcggtgactctaaattgacttatttagctgatcgtaccaacggtgatcttcgtttggccttatcttcactagagattttggttaaatctggcgtaccatttgacgaagaacacatcgatgctaccctaggtgctggtgcttcaaaaatcgataacggtgaagacggccattatgacacgattgcttggtactgcgaagccattaaaagttctgatgtaaatgctgctttattagccttgggcgtactactaaatggcaatgatatggaatcggccattcgtcggattgaagtcggcctgtttgaagacatcggcgtagctaacattgacttatgggctcctgtcattgatgcgctacaggtcgctagagatgtgggattaccgaaagcgcaatctgtcttgtccgctgtaaccgtcgcaatgtctctgtcacccaaggctaacgcctcaacaaaagccattgaatttgctcgggaagatgctgccaaggacgactggcaacagcctgatatgactcgtgatatgcactacaaaggtgcactgagtttgggccacggtgtaggctttgtctctgctcaccaatttccagaacacttctggggtaaaggtttaatgcctaaggggatggaaaacaagacctactaccggccggacactaaagctgaagctaagtttcgacagattaacgatggtttacgtgcaaagatgtatcctaatacgccgaaaactaagcctttgtcatcagatgaacggggctgtggaccgaaaaaataatacttgtatatataatctaagaaactgaatcgtttttgttgaactaggcagctgttatctctttgtagtttgggatgatgagctgtctagttttgttttgattacttctaacaaactttgtcagaaataaagcttgacatttactaaacgaaacggtttcgtatcgttgaaaggtggcaaacaatatggttcaatccgctggccaagtggttacggatcaccagcatcctcaaggtaaaacggtgctccggttcggcctcaaggatctggtgacgaaccggttttcgaagaagaactagcagcgatagtttacttttgtgtttaaagctaatctcccttttactaactttcaacctttagaaaattattataacttgaccaataatctttaataatagtctacgtctctaaaaaattttattattaatttaaataacttacaatttgtaagttttgccgcccatatcatgttataataatcacaaatgaatggagggattattcatggcgtattcatttctggatactttcaaatttcctaacaaagacattacgttgaaaaatcgggtcgtgattccacctttgactgaatgcatggcatttcacgatggtaacgtcaccgaagacgaaatcgattattatcgtaaacactctggtggtgtcggactttatatcaccgctgttgccaacgttaatgaggaaggtaaaggatttgaaggtgaactcagtgttgccgacgataagttcatccctgggttgcataagttggcttcggcaatcaagcaaaacggcactaaagcggtcttacagatttttagtgctggccggatgagttcatcatccgttcttcgaggtaagcaacccgttagtgccagtgcaattgcggcagctcgagcaggttccgagcagccccgcgcattatctgccgaagaagttgaacagactattgttgattttggtgaagctgctcgtcgggccattcaagccggtttcgacggcgtggaaattcacggtgccaacacttatctgattcagcaattcttctcccctaactcgaatcaacgaaccgacgaatggggcggcacgcttgaaaaacgcatgaaattcccactagcagtgattaaatcagttaacgaggcggtcaataaatatgctgataagccatttatcgtaggctaccggatttcccctgaagaaattgaaaaaccagggatcactttcgatgacaccttgaagtttgttgacgtgttaaagaatcaaccaattgactatcttcacatttcaatgagtaacgtttggcggaagtcgttaaccgatgacaccatcacaacgccactcaacgaaacaatcaaggaacatctgcaaggcaaagtacctatgattgtcgttggtgacgttcaaacacctgaagatgccgcaaaggctacggatgctggctttgacttagtcgctcttgggcgtgagaacattcgcgaacctcactgggttcaaaaagttgaacaccacgatgaagcttcgattcgctacaccatttcgccagatgatctggacgaattgggcatcaaaccaccgttcttcgatattttaatggcgttaagtggcgcgaatggcatcccgctttcaactgctaaacaaactaaccgtgatgctgctaataaaaatattgattattacctgagtggcggtaaatagtctttttataaatctctaaataaacaaacagtcgtcgagaaaattaatctctcggcgactgtttgcattcaacaatgtggtgattgacattcagcactgaccgtcatatgatatccttcacttgcttccagtaaatctaatgtttatgattgttgatatcacttataaacttgttgttagatctaatacgttttactacatcgaaaggagtttattgtaaatatgacttattctgtccgagaagttgccaacaaaacgggacttaccacctacaccgttcgttactatcacgaccatggattacttcccttcgttaaacgggataaaaataataaccgagtttttgacgatgtggatctcgagtggatccatctgattacctgtttgcgtcaaactggtatgtcactagagaacatcaaacattatttcgatcttgttattgaaggtgaatcaaccgttcctgagcgttaccaaatcatgctggatcagcagaaacaaaccctttacgaaatcgatgaactcaaaaaccatttggaaactatcaataaaaaagtggctcactacgctgacatcttgactaataagaaacaggatagttatgagccttcaaacattgctaaaaaagcaccttcagataccgtttcttctaattaacttgaccccgcactaacatgcgaggtctttttttaacgtctaatatgcttagcgggcatatctgatataattaacaagcattttacacatattaaaatagcgcgtaaattatagtcattgttaaaccgcaagcatttaatttaaattgaaatgattcaaagaagctactatgaaaggaagcaatttaatgacaaaaaatgaaacgagcgtcaaaaacggcatctttgacatgggcgacaaaaacgatgcctacgcaaaatacttcgttggccaaagttatctcaataacctgatcaacgatcctaaaattaacgttggtgtcggtaacgtgacctttgaaccaggttgccgtaataactggcacattcaccatgacggttttcagctattattggttactggtggcgaaggctggtaccaagaagaaggtcaacctgctcgaaaattacaccctggtgacgttgtcgttactcacgacggcgtgaaacactggcacggtgcgactaaggatagctggttcagccatatcgctattacagctggcacaccagaatggctggaacccgtttctgacgaacaatacaacgcactggaggactaatattatggcaaaaaaacaaacagctggtcgcgataatctgggcgaatttgcaccccaatttgcagctcttaacgatgacgttttattcggagaagtctgggctaaagaagacgaactctctgcccatgatcgtagcctgatcacttgctcagcattgatggcgcaaggcctcttcccacaactcgaaagtcacatgaaaattgccaaacaaaacggcgtcaccaaaactgaaatggtggcgttgatcacccacctttccttctatgctggatggccaaaagcatggtcagcatttggtttagccaaagccatttataccgattaatgaggagccattcatgacaaatgttttaattctaggtgccaacggtcgaattgctagactggttcgccaacgactcctaacagaaactaacacccaactcaccctttacctgcgccacgcaaaacgactaggatcgattgacccaacccgcgaagacgtgattgaagctgacgttaatgactatcaggctctcgtgcaagcaatggccaatcaagatatcatttacgctaatctagggggccaatttgaaccactagccaacaatattgttaaagctatgactgctgttagcgtgaaacggttaatttacgtcactggccttggtttatatcacgaagttcccggagaatttggccggtgggtagaaacatccattggcagtgccgtgatgaatgatacccgtcgcgctgctaaaatcattgagaacagttcgctaaattacaccatcattcgtgcggcatacatgaccgatactgacacaattgattatgagctaacagataaaggaaccccatttaagggcacaatcatttcacgcaaaagcgttgctgacttgattatgaaaatcattgtcaatcccgagcaacacagctatagtagtcttggaatcaaccaaccgggaacagacggtgatcgtcctactaaatcgctggaggctcaactatggaactacgactgcttgaatattttttagccattgattcagctggctcaatttcaaaagcggcagagcgattgcacattactcaaccgacattgtcaagacagcttaagagtcttgaagatgaacttggcgcaccgctattcactcgaactaaccgtggcctttcactaactgaagctggcctatttctgaaaacccgcgcccaagaaattttgacgctgactgagcagactcagcaatcctttattaaccagcgacgtgatttattttctggcaatattagtgttggtgccgttgaggctgatagcagtcatattttagctgaagaaattaccaacttcgcaaaagaatatccagcagtcacgtttaacgtttttactggcaccagtgatgacttattcgatcgcctagataaaggcttagtagatgtggcgctattgctggagccaatcgatgctaacaaatacgaacagatgcgactggcacacgctgaacgttggggattagttgcggcgatcgactcacccattgccacccagccagtgattgagcccactgatttacctgatattccactaattatctcaagtcgccaagctgttcagcagctcctaggtaagtggtcacagttaaacctcgatgatttgaaagttaagggacacttcaacctgatttttaacgttcttccgcttgtgcaacggggactgggcgctgcgctaactatcgagggtgtcattgaccctaaaaatcatgaaggcgttcggtttattccgttctcgccacgtgttcaaacccacactgtgctggcttggcgtaaaaaccgccttcagacaccgatcacgaaagcgtttattcagtcctttaaaccacatacaatttgaaaaaactctgtcacggaaattgtggcaaagttttttttaacattttctccaaaagactgcataccactcctcattacaaaatgttataaatggctctaacattgatataaatgtcacaatttatgtctagtccattagaaaaacgttgcacaaattggttgtacaaaaggatttgaacttatttgacagctaatatatactaaaaaagttacgcaaattgtagacatgtcaaggaacttgtgtaataaatttcaaagggtaaaagggagaaattaggatgcgacacagagatcgaaacggtaaccacaatggtaaacttcactacaaaatgtacaaagcaggaggaaaatggacattttgtggcattgtgttagttagtgtagcaactgcttcattgttaaatactcattcagtatatgcggctagtcaaccatcgacacaatctagccaaccgcttcaagggaatccatcaacaggttcgtcatcaccttcgaaatcagaggactcgacccagcaatacataaccggtgcgcagccacctaaatcgtcaccagccacagcaacaccggcagttacccctaccgatgttcaagttaagcagtccggtaatgaaaactcaacaaccatcacaccagccaattttaaggattcatttgacacccatggaaacgcccactttaacagcgacgatgacgataccgtcacgcttaccgactatgctggtagccaacaaggcagcattaccctcaaaaacaaaatcaatcttggccaaggcttcgatattcagggtcaaattaacttaggggcagttgatcaggttaacggtaacggtggtgatggcatggcatttggctttcacgacgctaacagcgacaccgttggcaacggtggtgctggcctaggccttggcggtattccggatgcaatcggctggaaggctgacaccacttataactgggccacttcaaatgatgccacggcggatccagcagaatttagtaacggtccccgaaagcctaacacacctgattttagtggtggtcaagcttttggtgcctttattgaaagttctaaaaaaactgatatcaagactgacgtgccgggtatcgtatccacaattggggtcactcctggtaaagatagcgcgcaagcaattgatagccctactccatggcagacagatcatctccaaaacgaccctaaaaactggcggggtgaatttaaagacatcgccattaaatatcaaccaaacgtcgacggtaagaaattactcactatcaactatgataacaaagtttgggagaaagacattaccgattgggccaccgataaaactgatacagccttcttcgtttctgcgggaacagcggctaatctgaatctccaacaattccgcctcaaatccatggtttatcaacctgcagccagcgtgaacgtgaagtacgtctacacgactgatacagtattattagatcatcctgacgcaccagttgatcccgctactgttaaggaaatccctaattatgtcggcaaagttgactatccatcgggtacttttgtgggtgatccttacctgacctatcaacagtccattagtggctatacttttgctcgcctgtatgatgactcattacctgcaaacggaacgctgaaaaaagcgggaaacaacggcaccattacctacctatacgttcaaaatggcaatggtgggcaaaaagccacaattaaattttgggataaaactgagaataaacagctcggtcaaaccgtgaccattgagggcaagaataacacacgtgcgaatttttccgatcaagtggcgatcaatgcgtacgttaaagcgggatatgcctatgacccgcaaaacgatcaaatcgaaaacgggattgtgtttgataataataatgatgttgatcagacatttaccgttgaactcactcaccagatagaacccactgatcctacgcaagttattacgagaaccattcattacgtcaaagctagcgatggttcagaacttgttcacccatcatcgaccagcctcacctttactcgtaccatgaataaagacttagtaacaaataccatcacttatagtgactggtcaggagcacaagaatttaattcagttatcagtcctacgattgttggctatgtaccggaccaaacgattacacccgcacttcaagttaatttacaaaatggtgttccgacaaatgatcaattaaatgtatatgttaaatataacgatatcaccggcaaagttccagattctgacccacaagtatggacaattgcgcaagtacccgatcccgtctacgccactggtgaagttcctgacactgacccacaagtatggacgattgcgcaagtacctgaccccgtctacgccactggtgaagttcctgacactgacccacaagtatggacgattgcgcaagtacctgaccccgtctatgccactggtaagcttcccgataccgacccacaagtatggacgatcgcgcaagtacccgatcccgtttacgccactggtgaagttcctgacactgacccacaagtatggacaatggctcagacacctgacccagtctatgagttgacagaaaccagtcaaacacggacaaacgtacccgctgaaccagcattaccgaacacgcctaccagcacaccaatcaacggtggcgatactgacactcccattaatacagttaccggtgacgatactgatgtaccgacaccccctatcagcaatcaccaagtgacgaatgttgatcatggaaatacaactaccgatacgaatggcgatgctggtaccactacagatactggtcacgtcaaacggacgaacggcgctttaatgaatcaaaaaggattaaccggttcaacgccacaggcaacacaagcaatccaggcaacgactagtggtaaaagtcagccgaaattgccacaaactaatgaatcgaacgcaactatctggtcattattagggttcagtttgatgagtatcctgagtttacttgggtttactaagcgaaataagcacgataacatcactgattaatgttctgaaacgccagctatcatcatgattgatatgcaacaaatgttaaaggggcagccttattcacgggctgccccttttttactatatggatattccactgtatttgagattatcctaaaagaaaagaacgagtaaaaaacagcttttataaaaataaattaaacttttaagccaaattatgctaagatatagtcaatatttcatggggtgtcaagacaccaattaaacatgaaaagattggacgatcacttatgcggaatctttcactcttaacggacctttatgaattttcaatggcaaatggttttcaaaaggacatgcccgatacgcgagcaacttttgatatcttctaccgaaaagtgccggatcaaggcagttttgttatcacggctggcctccagcaaattgttgacacactaccattttcatttacaccagatgatattgactatttccgaagtctccatctctgggatgaagacttcttgaactttttagccacctttaaatttgactgccacatccgggcgatccctgaaggcaccccggtatttccacgagaatcaatgatgaccgtggaaggccccatcgcgcaagcccaactgttagaaacattgctgctcactattttgaatcatgagtcgctcattgccactaaggcgcgccgaatcaccttcgcagctggtggccgaccaatcatggaattcggtgctcgccgtgcgcaaggcgccgatagtgcgatttatggcgcccgggcagcggtaattggcggtgcagccagcacttcaaacgtgttagcgggtaaaaaattcgccattccagtagccggtactatggcacacagttggattgaggcttatccggatgaactaaccgcctttcgtcagtgggctaaatattaccccgataacagtgccttattagtggatacctacgatgtgttgagctcaggtattccaaatgccattaccgtcttcaaggaactacgtgctcagggacacgaaccagtgggtatccggattgactccggcgatattgcttccctttcccgtcaggctaggaaaatgttagatgatgctggttttcccaaggccaaaattactatttccaatgctttggacgaaaacattatcgaatcgttgctgaaccaaggcgcaccaattgataatttcggtgttggcgaaaaactgattaccagctcgtcgtctccagttctcagtggtgtctacaaattagccgctatcgaacaaaacggccagctcattcccaaaattaaaattagcgatagccgtgaaaaggtcacgatccctggacaaaaacaggtttatcgcctctatcaccacggcaccaaggaagccttcgctgacctgattgctttagccgatgaaccggttgctgatcaacataaactcgacgcttttgacagtaacccgcttagtgtcagcaaagttcaaactttaagcagttttgatgcggaaccactattaaaaccggtagatttaaagcaaacatctgctagtcccttggaaattcaagcgttcagcaaacaacgcatcgccgaattacccgatgaaaccaagcggttaaccaaccctgatacttaccacgtctacatgacgacaaagttagctaaattacaagatgatctcattaatgctaactagactaaacaaacaaaaacagaaagattgctaaatggacatcatttaacgatctttctgtttttgtttagtcattattttaagcatcagcagagcaatgattattactctgattcaacgtgatagtactttcgaaaaccccagtaaaccattgctccaattgccggaacaaccagaccaagaattgacgtcaccgggtcgtcaatgaaattattccccaaaataattaagaaagcaatggtagcaatgatcaccgtccaaggataggcccatactttataagggcgtggtgcatctggttgacgccgacgcatcatgggtaccgctaaaactgataaacagttaaaaatagcaccggagaacaccaccagtgaggttaactcatctaactcacgggtcatcaccagcgcgatagaaatcagcatttgaataaataaactgaaatctggcgtccggtgcttagtattaacgtgggcaaatgatttccacaataaatgatccttcgcagccgcatagtagtaccgtgcaaaagctaaaatcatcccgttaagtgaactgatcatagccaataccatagcaatggcgacaagaatcgtcccaaactggcccagaaaactttgcgcaaccgcggtccctaaataaagctgattgtgctgaattgatcggctaatttggccgaatggcagtgcccggtaaatagctaagttgaacaaaacgtaaaccaccgtagtaaagcccactgataagattaaggcgcgtggtagattccgttgcgggttcttcatttcccctgcgacagtgtttaagttagtccagccttcataagcccatagtgaagcaatgacagcgaaagcaatcatctgaataaaaccaactggactggtattcccgttatgcggtactaacgataaatctggtttatagtgtccccaaaataaaccaaggacaataattaaaatcagaggtaacacctttaaaacgttgaacacattctgaacccattcaccgatatccaccccaaagtagttaatcaacgtaaaaatcacgatcaacgcaatggcccagactttaaccattagcccattcattggaatcagtgaattaagcgccattggcaacgcgattgcgattgccgcaattgatcctggcccaccgattatcatactttgaaagttgaacatataacccactacgggtgagtacgcatccgacaaataaacgtagattcccccagttgccggattcatcgcacctaattcagcaaaacacaggctacccagtaaggtgactaatcccccaatcagccaggcaagtagcgcaagccccatggacatgtgtgctcgttgcagaacataagagccaatgtagaaaatacctgaaccaatcatgataccaattaagatattgctaccgccaaatacaccaatcacttttttaagttgcggggttccttcagtttgcttgtttggttgttccatttaacccactcctttctaccggccattttagcaaatgacaccgtgcccgtcactagggttaagtaagcgcttacttaacgcaaaaagaatcgataatttctgtagtatgcaaaaaagaaaccaactcgtaaatgaattggtttcctataaggaccttttagttcaatttttttgtgcaacgaaattatcacttattagccaacgccaaaaactgatgcatctggtcaattgaagcacctagcatcacgatggccctcaacggcatgttagctagtaattcactgtcactaccagaagccacgttatccaaaacgacatccagtccagactgtttcaacgcagactttaagtcttctcgaccaatcacttgattcagataagtatcttcactaatcgtagtcggcttgtcagtaccgagcttcacgtcaatgacctgactcaagcggatatctcgcgatgaagcccccacttgaatgcaatagtgaccattatcaacgcgccagttagcattggccgtatcgtaccaagcaaaactccgccgatttaagttcaaagtgacaagttgactttctttcggttctagggctacctttttaaaagccttgagttcttgaactggtgtttccactgaactcgcttgattttgaacatacacttgaactgtttctttaccagctacagcacctgtattagtgactttcacagtgacattgacccgatcattctccgtcgtaatcttcaaatcgctatattcaaaggtagtgtaacttagcccgtgaccaaacgggaaattcacttgtttgtgtttcatatcataataccggtaaccaacatagattccctcatgatagttctcagcctcaggactagcattgaaagtcccgaatgctggggtatcttcaatcttttctggaaaagtttctgctaatttgccggaaggattagcctcaccagtcaataccgaccaagttgcctcacccactgcttcacctgcaagatacgtttccaagatggcttgtacgttatctcgccaaggcattgtaacagcggaaccattttgtagcaccacaatcacgtgcttgttaaccttagtcatttgctgaatcaggttattttgattctctggtaagtccattgattccttatcaaaaccttctgactctaattgttcaggaacaccagcaaaaacaaccactttatcagcctgcttggccaattcaattgcttgatcagccagctgagtattcactgcactatcggttaacgtgtagccttgcgcatatgtcacatcatagtcgctactctgagcaaccgataacggtgtggtaagtttataggcgttcacgtgtgagctaccgccgccttgatatctcggcttttctgcaagttcaccgataacagcaacggcatcattagcgtcgagcggtaacacagcagtatcatttttcaacagtaccatgctgtcttcagcagcctgcttagcaaagacgtgttgctgcgctttatcgtatttatcagcctttttcgcgttaatatggaatttctcaaccatccgcaatacccgtaaagctgctgtatccagcttagcttcttctaactcaccatcatggacagctgccacaagccggttaactgagtaatcaccgtttccgggcatttccaaatcaagtcctgctttcaacgcagcaatattgtcagcaacagcaccccagtcagacataactaatccttcaaaaccccactcgttacgcaaaatttgggttaataagcggtagttttgtgaattcaaagtaccattaattgaattatacgaacacattaaggtagcgggttgcgcttgcttaacaattttttcaaacgccgttaaataaatttcacgcagggttcgttcatccatgttggaactagaagtaaaccgctgattttcacgattattggcagcaaagtgcttcacactaacgccgacaccctcgttttggacaccattaacatacgcgctagccaattcaccggctaaataaggatcctctgaaaaatattcaaagttccgtccagccagcggtgaccgcttcatattaacacccggtcctaaaagaacgcttacattttcagcacgcgcggccgttcctagattcttaccaagttgatacagcatttcaacatcaaacgaactagcggttaacgcagaacttggaaaacaaactgcttcaacactttggttaaggcctaaagcatccgcactgctggcctgctttcttaaacctgatgggccatccgtcatcatcattttaggaatttgtttgtccttattttcagcggtaaaccaaaagtttttaccactgactaactcggctttttcttgtacggttaatccctgaacaaacgttaaatcaaattttgctgacatttatcaattctcctttgaagattactctactataatctatctaatagttaataatagaagtatttcgataatgcttcaatagtagattgttttttcggacaactaaccgcatatcatagcgcagaaaaaagaactaatcctttgagatcagctccagtttttgctatttaaaccagactacgtaatttatacgctaacgatgggaaaatcaaaatcattttttcctgccaaacagccggatcaacatctaatgcgatgactggaatcaacgcgttaatatcatcaacagcagtttgactcacttctgacgcgccaacgatcttgttttgctgatcatatgctaatgaaagatgagccttatcgtccgcggttcccgtataaaagtaatccccctgtgcaatttcaagatcttttaccgtcaaatcaggatcttcacgtgcttggtccatattaacacccgcttcagcaatttgcggaaatgtgaaagcaaccgtcccaatcactggataatgaatgccgtcagattgatgtccgcgaagatagctactcagatattcaccttcgaactgagccgtcgaggttaaacctggcacttctttcttaataacatcacccatggcgtagatattagccgcagcagtttgcagatgttcattgacaacgatgccttttttatcaacttttacatccgtattctctaaatacagcgtatcaacatttggaacacgcccactggcattaatcactttgtcgaattttagacgacgaccatcttttgtggtcacttgaaattgcgtatcttcatgactgattgtttgaacttcagtttgatattggaattcaacgcctaacgagtccttcatttcattcacaaccatgtcaacatgatgtttatcaaaggctcgtaatgctcggtccgaacgtaaaagaatggtgacatgagcgcccgcaactgataacagagaggcaatttccatcgcaatatatccgccaccaataatcgcgacagattctggtaattcttccatgttaaaaacatcgttgcttgtcagtaaatactcgttgccaggaacatctagcgaacgtggtttaagaccggtggcaatcacaaaatgatcactagtaatgagcttatcattgaccttaatcgtgtggttatcaacgaagtttgccgtcccttgaatcgtatcgttgccttgttgttcaaacaattgttgcatattatcgggaacaggcgcaaacacgtttttcttttcctgaaccaactgcgtccagtttatctttgcagggttagccatccctcttccggttaatttttgtgaaattaaagcaattttactagcaccttcaaagaagatttttggttcacaaccagcattagggcaaatgccaccaaaatcgtttgcttccacgactaaaattcgttgtttactgccttgcatgcctggtaaaaagcgaaagaccgatggcccactaccaataactacatagttataatcattcatatttaatattctcctgctaaaagtaattttgagtttgttagtgacgtattcctcgctgtttaccagcggacattacttattcacgcatccattttaaccccagaacgggcctaatatttagctggaatcgtcaagctagtgactattcaataatttaattgaatagttgaatactatcacatacttttagtaagtgcaaattttgaacaaaaaaaggtccggttgtgacgtctcgtcactcccagaacccactaatcttcaatttgactcatatcttgccaatccaaaacacttctattcaggctataagcatcaaaacccgcacgattcaaaatttgagctgctgaattggcattcacacacaaccgcccccgacagtagacgatgattctttgatcttttggcagacggctcaaggaatccgataattgatctaaaggaatattaattgcaccatcaacatggttttcagcgaattcatcctggggacgaacgtctaaaagaaaagtctccttttgcatcctttgagcttctgttaaggacaccgttttaacatctggaatatgatcagcctgttgctcgatgtgttgcatctcagacattgaattttcaccaacgttaatcagtaatcgaatcaagtcacttatctgtgaagaagctaaccgatagataatgcggttacccagtctggttgttttaaccaagtgactgtcttttaaaacttgaaggtggcgcgaagtattagcaatactcatcccggtttctttagaaatctcttcaaccgacttcgaagcctgcgtcagcaaatccagaatttctaaacgccgattactggcaatgcctcgacttagttgcgctaatgaattgtataattcgtctttatagttaactgatggattttccaacgaacgtgcctcccattttagcagtggtttaaaaactactaaaataaaatataacatatttaattcgataaggaatagatatcgcatccgttaatgtttatttctagggtctattaacccaaaaaacgactaattttccaatacagaaaactagtcgctaaagtatttattacagttctatcggagccgtcgcaaatttctcttccaacgcattgacatcatctaagccaataaagtgattaaattgtgggaaagtcaccatcttgtcaatttgtcgttccgttgtaccaagttcaaccatgtcacgtagtagtttttcggttgaatacgttgtcgtatataccagtacattaggatggatagcaatcgtgaagcccatttcatgaatttcttcattagaaagcagtggtgttttaccattctcaatcatattagccatcactggtacgtcagggaaactatcggctactttttgcaaatcatctttggttttcggtgcttcaacaaagaccaaatccgcaccagcttcatgataatgacgtgagcggtcaattgcgctctgtaaccctgttaccgcataagcatccgttcgtgacataatgagaaaatcatcatgttgacgcgcgttgacagccgcttgaatcttgctaaccatggcctcttcagaaataatcgtcttgccatccatatggccgcaacgttttggccaagtctggtcttcaataaagagcccagcagcgcccatgttttcgtaaacgtgaacgaggcgctcgatattttgctcatcaccgtaacccgtatcagcatcaatgaaaacgggaatatttacggcattaataatttcccgcgcactatcactcatcagaccaaaatccgcaatcccacgatctggctgtgctaagcgatcagctgaagttgcatagcctgcctgaaaaatggccttaaaacccgttttctcagcaatcttcgcactcaacgcattgggagcaacaaccatgttaactaaatcaccactaaaacacatctctttgaaagctttacgcattctcgctgctttattcatatattttatacctccgcctttgtcaaaaattgctgtactgcttgttcctcggctgattgtctagcagccgacagtacgccggtgtaaaatagtgcactaaatccttggtcggccaaatcttcagcagaagcgaactgatctcgaacagtattgacgactagaccaaatgattcgttctttgtcatatcagccaccgctgcaaattgatctggagtgacatgacccacgagcacaaaatcagctaactgattttgctgtatgtattgaattcgtttgcgtaaaccatcagctccatattcttggatgccatctaactcggcaaacaacattgttttctcatcatcgaaagcggctctgccagcttttaacttagcaacaaaatcgctaaactcaatcatcgtgacttcattttgggcagtatgtgctggaaaaatttggtcatttaaaacgatgcctgctgcacccgaacgttccaaatcttggactacatagtaggtggttaactgattaccaaaaccagattgcgcgtcaacaatgactggaaaattgccgtgttctttcacatgtcttaactcagccgataactctgaaggtgaaattaatccttcgttcgttgcgccaagttgggcccgtaccacgtcgtaaccattgaaatatgccgcattaaaaccatttttctcaactgtattggttgattgagcatccatcgttccaattacggtggttactgatttctgatcaaatacctcttttaatgtcatttaataatgtgcctcccaaattaatttatatgtattgcacggtctcaaaaaaccgtttaattctgataccagaagaatcaatgtcaattacaatcattcaactcatcacgcctgatgaataattgattaaaatgataatcgaaatttaataaacaagaaaggtcactcttttacctttatcgggtaaaaaaatgacctaaagtgaaaattgttggagatgaacccaatcccgcttcgtaattggggtattgataacgatgatgggtttcgctattttagtcgttttaatcgcaaaattagtgaccataagatcatacggttcatcgtcaccagccaaaacaacgttatattcctccttaagatggccatgtacctgtttaaacaaccattcccgatagcttggcgtagcatcaatcactaatcgaacccttaacgatggattcaaaaccgtcgtatcaaagtacgtcaaaaccaccgtgacatactgagctgacagataggttaagttgttaaacactggattccctgttgcttttaaattcaataataaatgagttactgctttaatgacccatggccgcttagtaaccagttcatctgcgatactagcgcgatctaagagcagaccacccaccgtaaatatcattgtataggtatgtaaaatattcaatgaactcgttaattttaacttttcagtctcattattaaggaatccgaattgcttctggagttcatcaagagctaaaacactccccttattaaccacgccagtagtacccaatacttctggtttcaggcaatgtgtaaaaaagagcagacaataatcaaaaaaagtattttcatctggatactgattatcaaaaatacccggtaaatcagctatttttttatgattgaaagtagctcgcgttacgactgttggtatttttacgaaggcatttacttgttgtctttgctgacaaatcacaacccaataactcagttgctgttgcgtaatattatccagatttattccaattttatccgcccaccgattaatttgttgaacaatcgtttgttgatccacatgctcaaacggccattcaaatcgcgagtaagtttcccagtaaactcggtagtaacatagccggatcattgcttctggtccaaccaaaatattagtcgcaggtgaataccgcaaaccgtataaagcaaggtgtgtttgcatctttttcacgtgccgtttagcagtcgaaaagctactaaaatatcgttctgaaaagtctccaagtgaatctgcggtccgttcaaacgttgagcgtattagtttggtcattaatgattccttcgtcaaaaaagacaggatacggtccagattcactttggcactgcgttgtaattcaaccccgtcagcattgacaagcagcgataagtcagttggtttaaaattatttttgatcaatacttctaactcgtctagatgagttgttacggtgtgacgatcaacacctaaatcatgtgcgatactaagaatccgattactgccaggatgattatccagataccgaatcaatttaacattgatcgtatcccgaaccatgaatggttgcatttttaagtctccttatatgataaaacgattaaattatccttgtaattattaaaataagattatatactataccttgtcaattacaaaacttgtgtttcattataggtctcaatttcgctataaatacggaattaacagcatcatattcacgacataatcattcaactaatcacgccaactatatctacttggaggaattattatgtctgataacatagcttctgcaattgctgtaccgcaagatgatacagctgcaacactgctacatagtatgaatacgattcaaacaacaaaaacctttcgccgaatcttctctttatcagcaatcggtctttttctagatgccatggacatttatctagccagtggtaccttgaatagttttacatccagtggcttttcaacctctgtccagaattcaatcttcttatccgctggttttctcggcctatttttaggctctatcttcgctggtgttattggtgattcaaagggtagaatgaaagcttttcaatggaacttacttctttttggactcgccacttttattggtgcattctctcctaatatgatctttttaatcatcactcgttttattgctgaaattgggctcggtgccgaaatggtcaccagtttttcaatcatcaacgagtttgcgccaatcgcatcccgtggtaaatggtgtaccttagcatcttgcctcgcaaatattggtgctcccatcgcgatgttgctatgtctatttattattccacacttttcttggcgtggtatgtttttcatcagtggcgccttggcaatggtcttcagttacttcagacatgatttgcctgaatctcctcgctgggacattcagcatcaaaagtacgatgaagcagccgaaaccatcaatatgcttttttcagaaatgaaggctgaaaataaacaacccttaaaatatcacagcacggaaaagaccactaaccgcactgaccaacacctggctcgcaatacttttgttgcaatcagtttggcaatggctgcgatggtttgtcagtataccttcacttcttgggtccctaccctgttggttagtcaaggtgtaacggcaaccaactctctcgtttacacaacgatcatgatggttggcgctccaattggtgcctttattggatcggtacttgttgagcgaattggccgcaaacttaatattatttttgctttcggcatggttactgttctgggcattatttacggacacttaactaatggaacagctgtaattgtcactggtttcttactaacgatctgcttttacatcttgaatgccaccattattggcgtatacattaccgaactgttttctaccaaatatcgcttcagaggtgccggtactgcaaacggtttagctaagcttgctaactttggcatgccttacgtagtcgttactttactgcaggttgccaatgccagtgccgttatttacctcatcgctggtgttgcagctgttgcggctgtgattgccgcagcattcggtccagaaacaaaaggcaagcgtattaactagttacacatttgaaaattggactttaaaaccaggattaatgatgtgatctataacacacgtaccccaaaagttgtttccagctttaggggtatttttgtgcccttctagaactgtccgacaatagtcacgatacaaatataaattactgcaatcgcaatgacaaacataacagttccagtaatacaaccgcttaaacaacctgcgcagccttcagcatcttcgcttaatttgagcatagttttcccctctcagaaacgtatttttagatggatttacatatcagttttttcttttaaacagtttgtgagaagaatacttatcattataacgctatgaattatacgccaacaactatctatgatttaactattcaggcaatcaaaaaagaggacaagtcttcactcgccctcttagcgttacttaaattttctgtaccattatttattaaaactattcaatcgtctcacaaacagatttctcaattgctgcttggctcaattcctgaccaataccaggacggtcagggattacaaaatcaccgttatcgacttcgtctgggtacttgccgatccactggtttccggcttttaatgaaatttcgtggtgttcatgaattaacgcattaggtaaaacagcttccacttgtaacgcagcggctgttgctatcggtgtgccgcaaacgtgtaattgacaagcaatttcatatgttgctgccatatcacagattttcttggcttctgaaatgccaccacaaatggcgacgtcaggctgaatcacatccaaactgcgagcagccaagtaaggctgaaaaccgaagcgggtgacgattcgctcaccacttgcttgtggaatagcagtcttctctttaattttcgttgctaatcccggattcattggcgaaaaagcttcctccatataatagatattaagcggcgccactttttggacaaactgaatcgccgtattgacgtccaagccagcgtgacattccaaaataatatcaacgtctggaccaacggcatctcgaatcgtcttaatacgatcatagttgagttgtaaatcagcctgactcatcatacctagcaaccgtcgaccaaggtgcccctgacgatcgaccataaacggatcaaccttcacagctgtgtagccctgatcaatcgcctttttagctgtttccgcatactcctctggttgaatgagataccgcgtctcgtcttcccaaccaaactgtagttgacttgcataagaccgaattcgtgtccgagttgcaccaccaagcagttcataaaccggaacgtttagtgacttgcccttaatatcccaaagtgcaatatctaacgcactaacggctgcgtaaaaagttgcaccgccactcttcccccaaaaggtaccttggtagaattgctgccaaatcgcttcaatccgtgttggatcctgaccaaccaatcgtttaccgaggtccttcaagctcccaatagtggcttcaaaaccgctaccgtagaaaattccagcttcgccaaaaccactgataccctcatccgtattaattcgtatcacaattggatgccaagcaccatattgccgattccacttcacacgaaaaatatcaattgatgttattttcacgtttattcacactttcctcttacttcgtcttatacatgtacttatagttccactgagcaccagtagaattatgggtgataccgtgaagcgttgaccgcttgagatagtaattataatcttgatagagtggtgttacggcttgttgatctgcaaggagtttctcggcctgcaacagcttattccaacgcgccgtagtggataaattgccagttgttgacccattaactagcttatcgtaagtcgcattttgccacttagcataattttgtggattattactcagcaatggtgccaagaactcaattgggtctgagatatcagctccacgaccacccaagtatgcgtcgaactgtcccttcaaactccgctgataaacaatctgttctggaacactttgaagattaattgtcagtccaggtaggtacttttgagcattagcctgaatatattcagccaactttttcgaactatcttctgttgatgacattaaggtaaatttcaatgacttctgaccaatctgctttaaccctttttgccagtattgcttggctaatgtcggattgtaagcagcgctttgaccaccatcttgtaatttcgcgaaatcagtccccttattgttataagcgaggtacttcgtgaccacaccggttggtttaacagccgcaccgttcatcaaaacattaacaatttgcttccggtctaacgttaacgaaatcgctttgcgaatgttctcgtttctgaaggctttacgcaacgtctgattagtaggttcttggttaaagaataaataattcatataagagtatggacccttaaataactgcttactattcttaaagtttgatacctgatcacccgtaagaatggtaaaatcaagtttcttggactggtaaagattcagactggtttcggggtcttcttcgtaatgcatattaattttatgcattttaacgactttcttatcccaataattagtatttttaacaaaagtccaagtattactttgcggcttccagtttgccatcttatatggtccggaataaaccattttttctggtgacatgccataagatgaaccgtactttttaacaattttttcatcctgtggtgcaaaagcctgataagtcattaatttattgaagtaggcaattgggtgagttaattttaccgtcaaggtgtgatcgttagtcgctgttacacccagtttgcttgctggcagcttacccgcgtttaccgccgcagcgtttacaattccgttaaagagatacacatgcatggactttgttgctggcgctaaggaccgttgccacgaataaacgaaactctgcgccgtaatcggatcaccattgctaaatttagcgtccttacgcaacttaaaggtatacgttttaccatctttcgagacggtcgacttagttgccaaatctggtacaattttatgatccttgttcatgtagaaaagactgtcgtacatgttcccagcctgatcaaacccttgcgtcttagaaatgtccagcgttgtaatgacatagttagctgataaatcagccgtccggtctagtttcggcttcgacgcggcagaattcgacccacacgctgctagtagcacactcaacgaggcaattcccaataaaccaatggtagccttcaaacgaaatgacttagttgacatcaaaaaacctcccaaataatctaataacggcatacttttatttttcacaaatcctaaaaatatgcctaaccagtatcaattattaccacttttttgtaagcgtttcaatcgtttgaactagctattttgcttgtgaaatcataatatttaataaatggtttatataatattttcatataatatgtggctacttaaaaaatattccactatcaataattcgaattatcagcaaaaaacaaccgctcatcgtaaataaataattacgatgagcgattgtttcagttaccttagtgtcaatctaatttttaaaatttatgatgcctgaaatcctcaatcatctgccacgttaagctaagttcatcatcatggggaagcttatcacgatcaaaccactgcgctttagaaagttcatccgtttcgagttcaattggtaaatccttatccagctccgccgtgaagcccattagcaacgaatgagaaaaaccccaaggctgactagcataatatctgatattgtggacagagagcccaacttcttctgaaacttcccgcctaatggtgtcttcaagcgtttctcctatttcgacataaccagaaagtaacacgtatctcttctgtcccgttcgaaacttagtcaacaagattttatcgccattagtaattgctaagataatgcctggcgagatttcagggtagattttttgcccacaggattcgcacactaatgcccgttccactttgtcttgaactagtggttgcccacaaacgccacaaaatctatgcgatttataccaccaaccgaggtgtgctgcggttacgattgcaaagctcagccattgcggctgcaatcctcttaacttctgcacggattcaaaatgatagtcgttactttcattcacaggcctcgtagatctcctaatgagaaagaacgagacaccgtccacggataggagataagtataatcatcgcgatcaaagtgccactctttatcagcaaaatcaaccgttggtaattgtttcgactcggataaaaatactttcttggcagaatagatgataacaaagtcatcctttttaggcgttcgcccaggatgatattggttatccataacctttggcgcgatgtcttgtaacattatgaatacagtcctttcaaataagtttaaacgttagcactcctaagagattaatcatcatttttaaaacattacatattgtcttaattatatcactgagctaccgaaaaaattaggcaaaaaggagtattccataagtctatattggtaagtatttcaatccactttttagctaggattagtcagaatgatactttgattcaatacgtcaatatagcctaattgcgcttcaaaactcagattccggccatgtaacgcaaagcctattccgaaaagttcgtcggaataggctttattttcgcgttacattctggaatctaccgagttttgtcacagcttgttcaaattaaaagactgatgtcactgactcatttaaactaaattgcgccttatttgaccggtgccgtgatttcctccagcttataaatcgcgttcttaacggtatcagtatcaatatccaacggaatcagatgcatcgttgtttcaggatcagcagaaacagccgcgatcttggtaatccccgcagcgtcaatatcgcctagacctaaatcttcgaggttagttggaatgttgagttcatgataaaacggcagcaaattccgaatatcatcgtaatggtgttcaatggccaattggaccaaaatcccataacctactttgataccatgcaataagtgaacagtttcaggaaatagcgttaaggcatcatggactgagtgagcacccgtggaacgtgcataatcaccgccccagccaccgacagtaccagccgtcacaataatggtttccatgactgtacgccacgtgtgagtcaactgccccgcttgcatgtccttaaccgcctgaacagaattattgagtaagatgttcttgcaattaatggccatttgtcgtgaaatactcagcgcagtcgtgtattcatcatcatccaatgcttcaaacatgagctcagattcatagaacttagccagcgtatccgcgattcctgccacgtaataattaactggtgaatttaaaatgacttttggattgatcagtagtaaatgagcggtttccttataaattttatggtcgaggtgctccccatttgctttatagtggacacttaccgaagaccatggtgcgcagttactggctaacgttggaatcagcaccaaatacaaatgtgtgccagtagtaactgccttggctgtgtccaaaaccttacccccaccaagtccaatcaccatttgaacctgatgctcttttgcaatggctgctacgcgatgaatttcttcgtaggaacactcaccattaaagaacacatctgtcacctcaacgtgatcaccaaagtttggcaaataaggtttagctgctcttagtgacttagtaccgtgcaaaaacaacactttagtaacctttaaatctgaaataaatgatggtagctggtcgtacgcatcaacatctgaaatgtacctttgcggaccgctttgtgaaaacataatctatccttcctctcgtctgcattaattgttcgtcttgaatgcaggtgtatacatatgattaaacttagccttgtagatctgagtcactgatttagtctgataagccttaacaatcttcttgtatgtggcattattcttatcacttgaccgaacggcgatgacgttgatccatggcttattagcaggattggaataactaaaggattccttgtagatggcatcgttgatgggatcttttttagcaactttaacgaagttactattagtgattccggctgcaacgtcaggtaatagattcatgattttagcaggatcctgttgaacaattttcaactttaacttattttctgtaatatcactagtagatggtgtatccccagctttaggatcaagtttgatcagaccagcctgttctaaaactttgagtgcacggccggcattagtcacattattaggaattgaaatcttgtcaccctgttttaaatctttaatggatttgatcttatcggagaaaatgttcattggtgtcaaatacgtctgtgcaattacagaaaacttgtaatgcttagttttctcttcattttcgaggaaggctcggttttgaaaggcaaccatatcgagttccttgttattcatggcttggttggctaggatgccatcagtaaatggtactaatttaacgtgaatgtgttctgattttagattcttgttgacctgagcccaaattgaattatcagtcgtgccaactacaccgaccttcaccgtcttggtggccgccgcattactgctcttgccacagccacttagtaccctagcgactgaaataaacgctaacaacaaactaaaaattaaaataatcttcttactaatcaatctcttcatgtcattttccccttttaaaagtcggtttaatgtgtcgtcttgcgactgactaacgtaccgataatttgaacaatggtcacgataaccagtaaaacgatgatgcaagcaaacgttgcatcctgttcattttgttggaaaccatactgaattgcgaaatcaccaatgccaccaccaccgacaacaccaacgatggcagttaagccgatcaaagaaataaacgtaatcgtggtcactcgcgaaatgttagaaatgctttcctttaaatagatggatttgataatttggaacgttgataaacccatgacctgtcctgactcaatcaatccttgatccaagtcattcaatgccgattcaatttgtctggagaaaaacggcacgatgccaacaatcaacggaaaaatggtcccttttacgccaatggccgttcctgaaagcacccgagtcagtggaatcaaggctgcaatcaagataataaatggaattgaccgaaacaagttaatgattttatctaaaatgttccagacaaccggattactggcgatgccatccttcttcgtcacaaccagcaatacgccaatgattaaactgattaaaaaggaaatgataccggtaataatcagcatttcaaccgtttgaataattgaattttgaaaaatgttgtagttcaaggccacattgggaaataatttactaagcactagcgagcacctcggttctaacctgtttttctttaatgtatgacagcgcaccgctgacatcagattgcttgccacttaaaatgatgactaatcctcccaacggttttcctcgtaaaattttgatgtcaccaacaataatgttggcatcaacgttgaatttacgtgaaatggctgaaatcaatggttcaatggccttactgctgatgtaagtcacttttaccaataaatcattatcatgcaactttaacaaattactgttgaggacctcatcgggcaagttcaacttggaagttgtggcaataaactttttagttaacggtgtcttaggatcaacaaagacggaatagacgtcgccttgttctacgattttacccttatccagcaccgccacatcatcacaaagttcctcaatcacctgcatctcatgggtcaccaccacgatggtaatatccagctcatgattaagacgcctcaacagctggatgatatcttcagtggtctgcggatcaagggcactggtggcttcatcgcaaagcaaaaccttaggatcattgactaacgctcgtgcaatggccaccctttgcttttgcccgccggaaagcgtagatgggaaggcgtccgctttatccggcaggccaacgattttcaacagttccaatactttgtccttaatctgctgttgactctgcttactatacttaattggcaaagcaacattttcaaaaaccgtccgtgaaggcatcaaattaaactgctgaaagatcatacccatttccttgcgagtttctcgaagctgttttttgggcatatggttgatctcaatatcttcaaaatcgacctttccagtatctggtaattcaatcccgttgatgcaacgaattaaagtcgattttccggcaccgctataaccaataatgccgaaaatactgcccttatggattttcaaattaatgttcttcaacacttgaagtttttccttactatccgctcgcgtaaattctttactaacgtgatcgaatgtaatgatgttttcctcagtcattcattccaccttgattcattaatagttaattttgcttaaacgttcgacgacttcttttaaaactgactcatcgtgagtcaaactcagtcgaatgtaattacgaccgttactgccaaacccaattcctggggcaaccacgatgttagtctgttctaagatttgcacggtaaactgttcgccgtctaaaccttctggggctttcacccaaacgaaaaaggtccctttgggttcaactacgttccaaccgatttgcttcaacccacccactaaagtatcacgtcgttgtcgatacaacgttctgagttgttcaacggaagactgatcagattcaagaccaacagttgctgcatcttgaactgccccaaaaatcgtgctgtaaacgtggtcgtgatatttcttaatggccgcaatcgctgattcattgccgagcacgtaaccagcgcgccaaccagccatgttgtacgttttcgaaaaggtgttcaactcgatggcataatccaaagcttcaggtgcttccaaaatgctcacgggcttttcgtcatagctgagagctgcgtatgcaaaatcattaacagctaggatgtgatgtaatttacagaactgaatcactttttcaaaaaattggctagtagcttcagctccagttgggttattaggatagttcagcaacaatatctttgttttttgtaatacctcatctggaattgattctaaatctggcaaataatcgttagcttcagtgattggtagctggtacaacttaccgccagctaaagcaaccgaagcatcgtattctggataacacggatcagtcgtcaccacatagtcaccaggatccagaaaaacttggggaattgctgaaataccaatggctgaaccgttgaacgtcaaaatcgctttgaaaggatctgtagtaaccccataatttttttggtagtagttggaaatggcctttaaaaaattagtctttccttcaaaaggcgtgtaccggtggttttccaatttctccgatgctatttttagttcgtcaatgataaactctggggttggctggtcaggattccccttcgccagatcgatcaaagttgattgatcttcgacagcatcgatttttttatcaagatcggcgaaaaagcttttaggtatttgtctaaccttttgtgaaggtgtaaattccatttcttctcatctctccattcgtttacttgaaattattcgttaaaaatcagcggtgcgatttggcttaaatactcgccatccgtctcatcaaaggtactgtattctggactatctagatccaaaacaccccagaagtgaccatccttgaaaactgggacaacgatctctgatttcgaagcactatcgcaagcaatgtgacctggaaaattgtgaacgttctcaacgatttctgtctgcttggttttggcgactgtaccgcaaacacctttaccaactgcaatatgcatacaagctggcttgccttgaaacggtccaagaatcagttcgttatttttaaaccgataataggtcgtgccattcaagcttggtatctcatgaaaaagtaaagagactaaattactcatgttggccacaacatccgtttcaccttccagcagactctcagcctgtttcaccaacaactcatagttttcttgcttttttcccatatctcattcctccttacaagtaaacagaaaagcaaaaaagcactttcgcccttcaccagatttaatctctgataaagggcgaaagtgcttttccgcggtaccacctcaatttacataattcacttgaattacatacgcttcagatacaaaaagaaaatcttcttataccctaactctgtaacgggagtacccggcattatctaacgtacgctcgacaatgaagactgttattaagaccatattcgaacttagactactaccaccttccatcaaccggtggctctctagaaatagctttcagctctactcatcttacgtctacttgttttgttaaattggtattgattattatacaaatctaagcggaagtcaacagtaaaatgaaaatttgatgagttgcatttaattaactgttaattcataaagtgtgtgtcgttcctttaatagcagtatataatctaactattttttgatagaatttggaaccattaaaaataaatgagtgttgggcaatggcgttggaatgcatcttatacaatcgctaaattttaggattctcaaaagaaaaggagtgccacctaacatcaacggtagcactcctttaatttcatctattcaaaactaacctaatctcgcttcttccgcaaaccaaccagtcccagtaaactcaacatgccagccaatactactcccatcacagaaccagtttgaccatcacgttcatccgtttgaggtaactgttgcgcaccagacgcaactggctgaccatcattattttggctatctatagcttgtccagcagcttccgtgtcatccttaactgcgccagtcgaactcactgcctcggtttcaggcgtctcagtgccatccccagcagtttcaacgccttcagctggttgctctatctctgattgctcagtttcaggcgtgacctcgccacttggttcagccaccgttagctgttcagtttccggttgggtgactatggactgattcgtcgtcggctgggtaacatcaggattaccctgtgtgatcgtaccaccagtctcaccatcatcaatcgcctttttcttgtaaattactttaatggtcatgtccttcaactctcccgtagtcacccctggatagtgagtttcaactttgtttggcgttgcctcataaccttcaatcactggcaccttgacagcgccataactagtctgtgccgttgccatctactcacctgtcacatcattctctggagatgttccaggtaatcgtttcggcaacactcggcgctaacgtgttgccagcttcatccgtaaacgtcaccgtctgggtagtctgcgctgtggagtgagttacatggtgggttaaatgcaattgataaacttggcttgccgctgaatcattatcaaacgtgataacttcgggaattccgtttgaagccaccacatagttcaatggtgaatactaataaatttgtgcatttaaagacatcaaaaaaagagctcaaagttgacgtgtctcccacgaattcgctctttttagtcatatcaaacattacatattttcagaataatctagtagccaaatggaacatatacccattgcacaaatgactttccctgaacggtgtacgaacttgacggtgctgacggctgtttttcttcaacacggtagctccaaccatcagtgctttcagtgtctttaaagccatctatgctgctgatggtcataatcccgttgacggacgattcactaaacgcaataccgtgctcttcaaaataacgttttgacacgtcaaaaaccgtgtctgaatctaaccaagaaagatcccgataaattgtgtagattttttgagtccgggcattttcaagacgatactttgacggtgtcaatcccatttttttcttgaatagctgtgataaataacttgggtgacaaaaaccagcctcattggcaatcacatcaattgattccgatgttaaagccagtttttcacagagaatggccattcggcatgagtttacgtaatctcgaaagttaactttgcaatactgcttaaagagtctgcttaaatacattggtgaaatattagctgcttgtgctgcctcaccaattgaaaccgcctgactgatattctgatgcaggtaattcaaaaccttaatcaaactacttgaagtctggatatcctgcttggtagttacatgagtcgctgcatccgaatttgtggtcatccgtgcagcgactgattctggttctctagttactgactcttcatccgtaagcactgccttacctgttgactgcctcagtgaaaaattgaaaccactcatacgaattaactgattgctatccaacggttcacacacactaatcctttttttatcctgaaatccgagcgattgattaaaaataatttccagaaagctccgcgatgaccgaattctatccgccgaaatatcaccagaatagcaaatgacaaacccccacaactcggtatctatcgtcccagggaaaacagtatagtttttgagatttttaagatgaaaatgttctgctaaatcttcattacccgaaaaaacgttaccgttaaccaataaatggtcatccaaagtatacacaactgtgtcaatctgcgttactttggcaaaatcatcaattctacttgccacactttggtagtttttagattccaatgcttcactcatgattatcattcccatctttaaaaagctgtgaaactaaataaagacgctttaaacaacacactattagtgtgtcgcttaaagcgtcttcgcccttttaaatgtacaccattgtacatgtattcacatttattatacatacaatatagcgcttacattcaataaagtcaaccgatttcattaaagaattattgcacaatcgacattaatatctctttttacactcacaagtagtgagattatccaaatttcaatatagattttcacctaatgcgtcagatagattcttcgtagcttacttatgtcggcctctgtgataccaatgtcagttgttaagtactgcataattccaccgaattcataattaatcagcattaaggcttgttcaagatagtcaagagaaacagtagacaaatcacagatggattgaataaactgacagttcatatgatgagtaagggcttcactgactcgagccttaatccgattcactgatgatttatttgttaacatataatcagtcacaatattttccggctgaacatccagtatcgacaatagcagtagcgtgcaaatccctgttcggtccttcccagcagaacaatggaagagaatagtctcctgctcaccatagttcaaaagagtggttaaaaaatcatggtaagcgcgttgagcatgacgactaactaccattttacgatagacaaactgcatctgcaagctgccagctcgcgcattagtagaatactcttcttgaagtttttcagctgtttctgtgctttccgtatcatcattgtcaagaactggaatatggtcatacgtcataccgtccggcacaatatcaggatacttagtaatctcagcagtcgaccgtaaatcaatgattcttgaaattccatagttagttaatgtgctctggtcgatcggggttaaactcgctaagtgtcctccgcgaaccaacttacgtgaaataacttgtttgccatgtaacccagttaaaccaccgagatcacgaaaattcattccacgctgtaatttaatctcttggccattcatgctcaacgcaccccttttcataattagcttggcatccaactagtatcgcctaaaaacgggctggcaactcccaacaggtcaccagttgacattgtgatatctctgagtgttctgatttgtccagctgtcatcactggaagatcaccaaccaattgtttaacaaccgacgtgacagagtaactagccaaccttgtactactggtcgcacactgcccatagtggcccaaggataagctaagatagtctatgccaagtttattcaggatttcgattaaaaataaattatcctcaaagcatagacctccaatttctcgctcttcgggagaaattcgatatccaataataaatgaacgctttaactgatcccgtaattgcagaattctttgtgtcaaaagtacaggaaattgaactcgctttagtaacgaaccaccccactgatcagtccgcttattcgataacggtgacatgaactgttgaatgagaaaggtgttagcaccatgaatctcaataccatcaaaacccgccgcaatcgctcgtcgagtagccatcaagaactcattaatcacctgagaaatatcatcgagcgtcattgctttgggtaaatcaacaataccatgctttccctgaacaacgctgggcgcaatcacgtcctgtccattagtaatcattcggttggtcattcgcccagcgtggacaatttgtaaaatggctttactatgattttgatgaatggcgtccgcaactttcttcaattctggaattacccggtcagaggctacactaaccgagccgaaagccgtgtttcctgacaatgaaacgtaggccgatccaatgattaccatactaacctgcgctgcaatatctccgtaaaattggataccctcaggtttgagcgcaccgttactagctttttttatatccattggtgctgccaccaaatgacttttcaacgtcactcctgaacgtaacttaaagggggtatataactgatcaattttcacaagtatcgcctcctttatgttagtttactatcgccaataagaactggtttaactcttgatacgttggcatggctggtatattttgatgaataagcgtattttgaatgaatcgaagcatctctggtactgcatgcaaaatatcgtctttttctaaaccaaattcagccaatgtattgggaaattcaagctgttgtcttaaacctataacagtttttggtaggtcatggcttggattaatacataaaacgtctggctgttcacgaactgcttgatacttttgaacaagaattggacaccgagcactgttaaaagccaaaattggtccaatcatcattgcacatgtcataccatatggaacatgaaataaagtattcaatcgttctgcgaaagcgtagctaatacccaccccaatttggtccatcacatttccagtaaacgctgatattaacggtaataccgcgttattagttgctttctcatttgcagttaactgttgaaatgataacttaatgacgtttgtcgctagtaaatcagtcgttggatttgcagcagtagaagccaaagtctccaacccataactcagttgttcaaacaacgcagtcttttcagcaacttttgatagctcatcaagtttattaggattaataattaggtcatctgagtcacatcttgcatctgaataagtgagagttttcccctgttttcctgaactaattacaaattttctagttgcttctagaccatcattatttattgtaggaatcaaaatagcattgagctgcttagtacctgtttgttgttcataaaaatatcgcattgcccgaccggtgctaattgcagaacgatcacctacaattaccattacctcaggttgccactgtttaatcaataaactaccctcaataaccgctactaaaggtgaacatggtcgaacatggctataaattttaactgtttgactaccaatttggttgataatattagtaagtaatgatgttcgcttcaaaaatgggttgcaaacgataagtactcttcgattttgctgttgtgataacgatgctaacccgacttttagattaggaataaatttctttaattcaaccactactttcacttcccatccttcctatcccattaataacaaacaacactgaacactgtgacatgactaacatgcacaatgttcagtgttgttgttcgtatcacataagattactagtaaactgcatcactgatactacagcgtcactagttgtcgtgcgattaatttgttgaagttgattgttcatcatcaaaactcatttcaaggtagtctgccagttcgtcaagtccagtattatctgttaaagaaacctcaaagattgtctttgctccagctaacacaagttgtcgcctagcacgtttaatatcactatcctttgaaatcaaatctactttggtgacgacacctattttacgtttaggaaacatgctaccaaatcctggggaaaaagtttgtcttcgatccgttgcactctgtaaaagtacaacgacatccgcatcaaccgctgtaatagtcaaagcgctataatattggcggtgttccatgaattctccgggtgtatcaattagctgattgtgttggtaaaactgaacaacttgtgtttttcgatacttaacagcttgtttctgtaaccgctgacataacgttgttttaccgcaaccaaccgcgccaataaagattggttttttcatttaataaccgcctcctttataaaattattatgcatcaaatctgtcgataatacccacaattgctgcatccataacatcgtcgattggactaacgcttgtatcactattacgagcaccggcgcctttaacgtacaaaacatattcaccaatgccagcgccaaccgtatcagccgcaacttcctgccgctgcttaggttttccattaaggtcaacttcttgaacgatcatcagtttgcgaccaactaatgattcatgcttttgtgttgaaacaacgctgccgactacttttcccatatacatttgttgcatgcccccttttccatttaatcaacataatcgtacattgcgatacctaatggggtcacaaattgagggaacactggtttaatagcatcaatctgaagcgtcttactaaaagttttaatgaagtctttgaaattaatggcaccaccaacaacaataactggttgctgtaacttattagttacagtctttttcgtaatcatggccattttttcaacaactggtcgaattaccataaatacttcatcttccttggttgcatcgcgtttcataagctccgcctcatcagaatcgatatgatgattacccgcgagcactaacgtcatgtgaataccaccagttggttcatcgacaacttcaacaagctgaccatcctcaaaaatactaattccagtagtaccaccaccaatatcaaccactgttccggtcgaaattcgaagaaacttagcggctgccgtgggttcatcaacaactcttaagcattcaaaatttgcagattcaatcacattttgaaccactttcttgcttccatcgccagttccgggaggaatagcgccacaagctctaataagagtgacacctaatactgactcagctttctgtttcaagcgtttcaaaatattaatgctctcaataaaatcaacgactatgccatcacgaaccgcatgatcatattcaaacgcgccgtatagcggattgttatcctcatccagaaccgttagaacgatagatgacgttcccaaatccacgccaacacgcaacagttcgttcgatgacactgaacgagtcgcatgatcactatttacaatttttgaaaattcctctagctgttgattaaccttcgttaaatcacctttagtttctacagtcatgcgcatccctcaatttctgttggttggttttaatcagctaagttcttgtgattggtggtgttgcaaagtttaaaatatcatgaagtttattaaccacttcatttaaagcattttctacttctgaaacttcaccacacacaaccactgaaccactgaaccgatcaatgaagcctaaagttacagagctagattttgttgcgacatcgctagcgataatcgacgcctcgcttggcgtaattgttaagattcctaacgctgtattattgtcatctagcccaagtttttcaaaaatatctgcatcgggattggcaatcacgtgagctagagtgatttgtttacccggaacgtattcttgaatcattcgttcaggttcagttcgttgtcctagcgcatcagtatcagccatcttggataactcctttcaacatctctaatctgctgccatgatctaccaatttacatctaagcctggtttgcccaatctgctggataagtgatgtaaataaaccgagctgcttcaggagcggaaaatttaattgagctccccttcggaatcaaaatcaactgaccaggattagcagtagccgtcccatttttaccaattaccttcagctgtccactaataacatagtcaacttcgtcatagttcagtgtccagtcaaaagtactcttagtcatcttcattaaaccagcacctagccgtgggctttcgtttagatcaaagaagtcttttgtataaacttgatctgctggattaccggtgtccatccggtcaacttcggtaacatcacatgctggtaaatcaattgagatcaaaccatcaggcgtagccgtcttatttgcactaccacctaatttttcagtcaaaatcttacgaataattgtttcaacttgatcacgatctatttccatttatagcgcatcctctctatatctcgttagattactgattagttctctgcaggctttggatcagctttcttttcgacaaccttatcagtcttcttttgctttcctaaggtccggtcagccatgaacattgcaacgaagatagctgtaacaccggcaacaagtttggcaacaatcatcgggaagatcatatcttttgcaacaccagctacgaatccaaggtgatcaccgaagacaaaggctgcggatactgaaaaggcaacgttgataatcttgccacgatcatccatgtccttcatcatcccaaacattggaatattatttgctaaagtagcgaccatcccggcagctgctgtttcattcattcctaagactttccccatgcccatcaaaggcttcttgaagactttcgtaataacgaaaaccagcgtaaatgcaccagctaacgtcatagcaatactaccaacaacctgaataccttccttaacgttacccatgcctggaataacagtaactccaatcatcgactgaatagcgccaagtgctagtccaagagttccaataataacaatcagttgcccaaaaacagaaaatcctttaatcataccttctggtttaaaccagagtcctaatgcaatcaaaacagcaaaaataataattggaactaagttcttcaaaatcatcatcaaaggtaaacccatcattaggccaccaacgaagcaaccaatcgggattgttaccattcctgataaaacgccagttgctaggaaccggtgatcttttttatcaataatacctaacgcaactgggattgaaaaaacaattgttggccccatcattgaacctaagatgacggctgcaaacatcccagcttgcgggttgattgccatttgttttgctaattgaaatccacccatatccagagcaatcaaactggtagcaaacatcgatggatcagcacctaaagcttggtaaactggcacaacaattggtgataaaattttagccagaattggagctaaaataatgataccaaccattgatagagccaaggcacccatagaattgataccttcttcaaacttttccccaagaccaaacttattgcctaacatgtgatcaacggcacccaaaatcataaagaataccatgatatacattataatttcattaatactcataactataaaaccctcccttcaaataacaggcctcaagattcaatcgaatcaataatgccaataatcgttgcatctattgggacgttagtgctctcgtcagcaagtcgggcaccggatccttcaactaccaataccttttcaccgaatccagcaccaactacatctcgagcaaccaattgtcggatatgccaggtatcattgactttttgatctcgtacgttgaccaacatgaatcgtgagccagaaagtgtatcaactttttttgtcgaccatagattgccaacaacttctccaacaaccataccgaaacctcccaggcatcataaattcagatgcttatctttagccaattctttagctaaatcagttagaacttcccctggctgcaataatggttgttgatttgattgccagcgttgttctaatacttgttcagtgacaaaatgacgtttattcagtccagaactcacagattttaccgacttttttgaccgaagttgtttaaactgttcatcaaactgaccttcactatcgataaaatgaacatcgaattctgatgttttttgaattgctgtttgtagttgtcgccaaacagcatatcgagcttctttgcgataaccttgtaatttgggctttgatgagaaaatccagaccggtttacctttaagcagaaagtctatcatttgtgttgtcacgggatcaattgcggttaaatgtgcaactgcaatgagctgtggcattgttacctgattaagacaaagcaggatagcatcgctatcctgcttttgtccgaaatcgaaatgatagtcagctgaaagtttcttaacatacggtgcaggatacgcttctatttgatcctgaaataggatactgcttttgcaaactactttaagttgcgcccaaacccggtccgtgatgatttgaataagtttctctatttcagcagactgcattttcaaaacctactttttataaattgcgcctcgcatgcccttcgttaagccacaagcgttggcttcatcaaagtcaacatgcatccgagttgaataattcttgctgacccggataactacattgtcaaaaatcaatccacgagatccgtcaactttaacctgaacgatttcaccattcttaactccgaaaagagttgcatcttcaggcgtcatgtgaacgtggcgttgagcgatgataacgccgtctgaaatgtcaacggatttaccattacattccaaagtaacaccaggcgtattatctaaatgaccactctcacgaagaggagctttcaatcctaaggttagtgcatcagttaatgaaagttcaacttgtgaatctcctctagctggtcccaaaatagcaacattatctaacttaccattaggtccaacaatatttaaccgttcctcacttacatactgccctggttgagaaagcggctttttgggcgtcaactcataaccctttccaaacagtgcatcaatagttggtctgtccaggtgaatgtgtcgggcagaagcttcaatttcaactgttgtcttcttgcgcaactcagtcacaatttcatcgaccaaggtatttaaatcttgcgtactaatcacctacttttctagtaacgaattaagccattcctgtatcaaaatttgccatgaaacaaccgcctcataaaaagttgaatttctaagattcggttgaaccgtcaaccaagttactaaagagaatgcaacttgatctaacgttccctgcaatttttgaacggttaacagacttgcctcctgtaatttcaaatcacttaacttcaaggtatctaatgaatactcatcatcctgccaaacctgatcaaacgacgctgagatcagctgattaacgaaagcaacgctgtcattaaccacatcctgattaactttggccttttgttcattcaacagtgttaaatacaacaaaagctgttctcttaaagctgcttgtaagtgaattaatggcgtaccataatcagaaatttgattaaaatccacaggcttatgtgtaacctgaatggtctccaaccaggtattcggctttgctttttcaccctcttggattttaaccccagacgtgttagtctgattgattttgatttgatgttcacctaagaaactacgtgctgacggagttaaaatagtacctcttggcaaagtaagctgatcattatctgagagcttatttgctttcatcaactgacgaactgaaatttcggttaataatttatccaagaggcacctcctttcatagatgacctattgaagtcatctctcaattaatcaatggtagcgtcgttactcttagttgaaagtgatggtaaaattgattccacttcattgtgtggacgagggataacatgaacagagattaactcaccaactttttcactagcagcagcaccggaatcagtagcagccttaacggcaccaacatcaccacgaaccataacagttacaagtcctgcaccaatttgttctttaccgattaaagtaacgttagcagccttaaccatggcatctgcagcttcaattgcaccaactaaaccttttgtttcgatcatacctaaagcgttttcatttgacataataatgtcctccctttatttaaataatttctattggattttttgtaaaacctgacgcactaattcatctactaattgtttctggtcaaagttgacttgtgttttattaccaccagtcgcagtgacgttagtagcttcacgtttgatatcatctaattcggtcacgccaactgcgacgtgcttcatattgatgaggtctaacggactaatgttttcagaagttgcacttccaccaacagcaccacagccaagtgttaatgctgggttgaggttagttgcagcaccaataccacctagggcaccagccacattcaccaaaatccgtgatgctggtacaagcaaagcatatttacgaacggtgtccatgttctctgaatgaataatggcagtatgtccaattccttcattctctaacaatttaaccgttaaggcagcggcagcttcacagttttcaacttcgaagtatgccaagattggcgttaacttctcacgtgagaacggatctttcttcccaacgttttcagccttatctggaacaaccagaacccgggtatcttgaggaaccgtaatgagcgctaaatcagctaattgctgaactgacttcccaacaatttgcgggttcatcgtgccatcactacgcagcatgaactttgaaagtgcagcgctttcgttctcatttaagaagtaagcaccttgtctctttaattcacgacgaacttcttcgctattggcattctccgcaatgattgactgctcagaagcacaaattgtcccgttatcaaacgtttcagaatccatgatccgcttaactgcttgcgcaacgttagcactcttttcaatgaatgctgaaccgttaccaggaccaaccccaatggctggcgtccctgatgagtatgcggcgtgtaccatcaagccaccaccagtagcaataatgtatttggtatccggatgactcatcaactcttgtgaagcctcaatcgttggatgcgtaatcgtcccaatcaaaccttctggggcacctgctttataggcagcgtcttgaacaaccttaaccgcttccaaaatacaatttttggcacctggatgaggtgagaaaacaattgcattcccaccttttaaagcaaccaaagacttgtagaagattgaagacgttgggttggttgaagggataattcctgctacaaccccaactggaacagcgatatcaatcgtttttttctcagggtgttccccaacgataccaaccgtcttcatgtctttgtaacgatcatttacagtcttcgaagcaaagatgtttttaatgaccttatcttgccaaattccgaaaccggtttcttgttgagccattttcgctaatcgttcactgtttgcaactcctgcatcagcaattgcttgacaaacttcgttaattttttcttgcgaaaattggccataaatcttttgcgctttagtagccgcatgtaataaattacgaacttcttggagagaagctaaatcttgatctagattcaaatgtcattcctcctttgcaaatcatctaagatcgcttgtacaagcgttctcttgttgcccatcttgatttgcttctttgtcaacgtcttgatattcatgcgataagcttgcttccgtaagtcaacaacgcgcatgttttcaagtttttgtttatcagtaacccatgtgtttttatcatcggttatggctttcttagttgtttctgcttgagatttctcagttttttcaactgaaggtattgatttaacagtgtctgttccaattgacttgtcatcctcaacacttgaattcttagatggtgacacagttgcattttgaacgtcatcagacgatgatttatctgcagctggctcatcaggtgttgcagcatccgtggcagttaccttagtttccgaagcaggtttagttacaatctttttcggccccctcggtgctggtggcatggtcatttgattggtctgttcatccattcgtgcaatgacatagtttgaaatcagacaacccatgttttcaatgcttgaaaccccggcgtcaacagcagcgtttacagcagcaacatcaccagttaagagaactgttaccagcccaccacgggtaattgttgcatcctgaaggtcaacgttggcggcttttaaggcagcatctgcggcaacaacggctcctaagaaacccctaacttcaatcatgccaagactttctactgccatttattagtcacatccttactaattttctttaggatctgctgcaatctgtttgacagcattcgcaaatgcatcgcaagcggccttacatgccgattgtgacccagttagcaaacctccaccaaagttggtttccgaaggcggaccgtatagaatacccatatcaacgtcagcagctttcattgcggcatctagtccgaatacggactccagtggtggtgcaatgagatatgcaattgcaagaccttcctgaattccagccacttttgagagataactcccagtccgcgaaattgtatgagcaaagtaaacaatgctatcatcttcatttgcactaatgaaatgtgcctcttgttcaatgacttcaacacatcgttcaagaccactcttaacttcagctggactcggcccaccgagaataccaataacttcaccggcaagttttgttgatgcatttccagcacctgcatacatactcttaccataaacaacttccacatcagcagttttagttgcttcgtccaaggccacgtacgtaacatcatcacagtcggccgtaataattgcaagactcttaatatggtctggcaactctaatgcagcagctaattccggctgaacatttggaatgattctggtacttaagacgttggattttaaaatatcttccttcactatgcgattcctcctcccattacacgaacgggtatgttaggcgtttgcatcggtgccattttgaacagctttgaaatcaatccctgacttcttagcttttagcatcttgtccaacaattcagcaatgtaggccccggcttcaacggctggcatcccaccatcgtggatatttgaaacaacagtccggttagcttctggcatacccatggttggtttgtaagcaatgtaagcactcattgacttagcagtaaccaaccctggacgttcaccaacgaacatgcatacaagatctgcaccagttagttcaccaatttgatcttcaataccaacacgagcatatttaacaaaaatgacatctttggtatcgaatcctaaaccgtaaacttttaatccttgttgtaatgctggaataatttccttgatgttagcttcaatagcagttgaacttaaaccatctccaacaacaacttgaatttttggattagacggaacacttgatttcaccttagccgcaacttcgtcagtaaacttacgaccatgatctggacgagttaaaaattcatctttggttttgcaacttgtttgggtttcaaggaagcccatatcttttggtaattgcggatcaacatcatcgaacaccgcatcttgagctgccgcgtggtcagcacgaaaccgcaaaacggattctgtcttgtaccgaacacctgaccgccataatcccagacgagctggtgtgaacgatttcattttcagataaccttcacgatcttctgggttcggaactaagaattgtttacggagatcaatcttggtgatgtcatctaaaacttcaccagaaacattagaattgttactgattggtgaactatttgtatttgaagcagttgttgtgcttgctccgtttgtctctggagatttgcctgcagctacatcagataaaatattttcaatcattgtttttaattctttttcatccataatttagtcaccctctttttactttaagaaaattgaagcgtcgccagcatgttcagttaattgcccatctttactgatacccatcttttccatccagtcttcgaattccttaattgggtgataaccgaagatatctcgaatagtggcagtttccttgaaaccagttgattgatagttcaacataatatcatcagcatgaggaacacccatgatgtagttgcaaccagcagcagcaagcaaaattgtcaaatcttctgcatcgttttggtcagccttcatatggttggtgtagcaaacgtcacaccccattgagattccttgtaacttacccataaagtgatcttcaagaccagcacgtgtaacttgctttgaatcatagagatattcaggtccgatgaaaccaacaactgtgttaaccaagaatggatcataacgtttagcaaacccgtagcaacgagcctccatcgttaattcatcagctccgaaattagcttctgaagaaagttctgaaccttcaccagtttcaaagtacatcacattaggaccttggcattgaccttcatgtaacgcaagatcacgagcttcgtctaacatttctgcattcaaaccgaaagcagtattccctttttctgatccggcaattgattggaaaatcaaacctgctggggcacctttacgaacagcttccatttgagtcgtaacgtgagctaaaactgaacattgtgttggaacatcccattgtgaacggaattcctcaaacttattcaaaatcttaacaacactatcaactgaatcgtcgttaggattcaagccaataacagcatccccaataccataactgagaccttccatcgtggtagccatgatcccatcaatgttgtcagtaggatggtttggttggagtcgagatgaaaatgtacctgggcgaccaatcgttgtgttagcagtcttctcaacatgaatcttcttagcagcaacaactaaatccatgtttgtcatcaacttagtaacggcagcggccatttcagaagtcagaccccgacgaacccgttggatttcatgatcagtaactttatctgaaagtaaccagtcacggaattcaccaacagtccagttcttaatttcgttgaaaatacgcttgttaacagcgtcggtaataattcgggtaacttcatcgtcctcatacggaacggctggattattgtaaatatcgtttaaagtcaaatgacttaaaactactttggcggcaacccgctcagtagcatccttagcagcaactcctgctaattcgtcccctgattttaattcattggccttagccattacttcttttacagatttaaaactgtaaagctgatcagataacatcgtctgtaaaatcattttgtttcctcccttgcaactgtattttgtaaatattaaccaaaaacaagtgttttcacgataactggtaagacttcaccatctgctactggttcgcccaaatcaatgtagtcaccgttttcaacttttacactatcgatacaaacaaacggataacgtgctggcaacctagcaaataaactatgacctaatgctttagccatgtcttcatgaaccataatgatgagtggttcacgtttttcaattaatacctgagcacctttgacaatagctgctgcgtaacgctgaatatcagcaaaacttggactatgaattccagtaaaggctaaagtcacattgctcaactcgttttcaacctgataccacttgattttttcggtaatcttaccggctaaaccctcaacatccagcttttcatcacttgtaggtattttcagaatcggtaagtttcgaagtggtaaaatgccttctgtgtaagcaatcgtgcttccagtaacatcagtagtatgtgatccggcaccgacaacagtggcacgaatcgtttcaactgatggataaaccgtcttttctttaaaaattaaggactgtcttaccgcatgacctaagagcaacccaatatcaccgtagtgaaactgatcatcaggtaaggtttcattcaagcaatcagcaacaccaccagaaaatgttacgccgtcaatacggtcatctgaatgtagtgcatggttagtaataaataagtcgaagtagggacttttatcgcctaaaccaatactgttttccaacacgtgggtgagaacttgtacaaccggatttaagttattaacagtggcaaccactccctctttaagcgaaagattcaactgttgaaccaactgtttgacctttggtgaaatataggtaatctcatgtgtattaggtgccaccttaatgaggcggcccccaatatcaaagcatgcggtatccaatacatcctcatcatcgaacaaaccgaggttacttgtcccgccaccaatatccatgttaacgacgtgggaacgttgttttttagcagtaatgttcgttccagcacccttgccagcgataatactttcaagatctgcaccagctgttgcaactacaaagtcacctgcataaccactgagtgcttgtgtgactgagctcgcattttcctttcgggcagtctcaccagtgataattaccgcacccatttggatatcttgcttttgaataccagcttttgcgtactgttgagtcacaaattgtttaattgcttcagaatcaatcgtatcctgtgataatagaggtgtaaaaataatgtcactttgaaagataacttccttttttgagatgttaattcttggaacggagaaagctgaagcaaagtttttcaccgttaacctagaaagaactaactgcgtggttgaagttcctagatcgatacccacacttaatatcgtgtcatctttcatataacccccttctttcctgcaaaaaaaggctcagaataaactactcccaagcaaacgaacctaaaaataagatagcgtttacactttagaaatagtttgatcctgagccccatcgctcatcactacgtcaatgtaatgatttttgatcaaatgagaaactgatatcagttccctgtttcgaagattcaattttcaatttaccaaataatttttctttcacatagcttcggatgattgttaatccaaggctaccactccgaacattggaggcgtcgaaaccaacaccattatcggtgatatggatggtcactaagctctgaactattttacccgaaatagtaacttgacagtcatcatcctccttataatccggaaaagcatgtgatatcgtattctgcaacaactcattgacgataacggagattgtcaccattctatcattatcaatcttgatttctggatcaacatcaaggttgacctttagccaatgatcttcatcacttagctggactaagtgagaaaccaatagttgaattgctgacttaagacttgtttcatctccgagttgtttcgacattagttcatacgtggaagcaatggccatgatacgtccaatactttcattgataatcgcttttgcctcatcgctattcaaccgtcgttgttgaatacgaagtaatgaaatcaccgattgcaaattgttcttcacccgatgatttatttcacgtatcgcaaccgatttggaaataatttcagcttccttttgtttcacgtccgttcgatcttgaatgagaacgataagttgattcttctcctcactccaaaatttacgagtcacaaaatagtaatctaggtaactaaaattcaaagtttggaaatgttcatggtctgaagcgtttcgtaattggtcaataacatcttggaaataagatccatcaatggacagattatcataggttaagcctaaaatattaccgatgtagccaacccgtttatataatgaaaatgcagtattatttgctagtactaaaaatccgctttcattaaaacacaggatagcatctgttaactgatttgcaatatttgtacccaactgattaaagacttcaaacgttgacgaaactgcaccgtatttagactcatcattgtcacttttaaaatcatttaaaatactttttgaaatatctgattctactatagtgacaccaattgtctgttcatttgacagaatcggaaaaacccgttgttggatcagacgttcttcttgcgttcgtgcaagaaggttatctgatgagacttgagtctctaaagtgtgaaacaccccaggttcgttagctctcaatgcatcctgaccgacaaccttatgcaggtaaagtgatgatttatctcttggctttttatggtaaacaaccatggcttgtttattatattcatttctaacatcaataaacacgtccaagtttcgatagtcatcatttttttcaatcaactgggtttcaatttcaagccgttgaatatcgttttctgacaaacttgtatatttatgacaaagtgtttgtagttcgttcattaggcatccgtcactatcaattcagcaatatcactcattggccgtcttttcgacatgctcagatcacgaagcattttataagcatcattttccgtcatctgattttcatccatcaaaacacctttagcacgctcaatcaccttacgttgttcaagcttaactgaaagttttttaaccttcttgttaagttgttcgtcgtgatgtccttttgcaagtcccacttgtatagttgtgagcaaggaacgttctgatagcggtttcacaagataaccaactgcaccaattcgacctgccgattccgtatcagaatcgtcactataagctgatagataaacgattgattttgttaattgctcttcaatcactcttttaccagccttaagcccatccaatagaggcatcctaatatccataataactaaatcaggcttctctttctgacacacttcaatggcctcaaaaccatctccggcttccccaacaacctgatacccagcttgttcaagaatgtcacgaatgtccaatctcgttattggctcatcatcaacaattactatccgctcattcatgattttcactccctattaacttcccactaatttagcccttcaaaaagttgaaagaaatatcagtgagccatttttcatcagtcacttaataaaataaaattattgaatttcactccacaacaacctgataatattatcacaattttcaaaaaaagtaataacaccccatgtttattataaagtaaactgcacaatggcgtcaattaggagaaacttgtttcgagaatcttaacgacatcttccaccgttggtttacgaggatttgccgcagtagtccggtctttcaaggcagcttttgcgatatcatttttggtctgttcaaacaggtcctgatcgatcccgtactctttaaacgtggccggcatatggagcgaccgtctaaatttcacaatatagttaattagattgcggactgcaacttttggattcggaccagtaataccaataaacttagctaacttagcatacttgattgcggcgcgatttggttcttccatgattcccgtatcaagttcagcattatagctgatgatagtaggcatcagaatcgtatttagtcgaccatgaggaatgtgatactgagcacctgctgcatgggcaatcccatgatttaaaccaagattgactaaattaaacgccattcctgcgatacatgacgcatcatgcatcttgtgacgagcttccatgtcagatccatcatcactgcatctctgcagatattcaaagaccatttgaaatcctttttctgccaatgcatctgaaaaatcatttgcattgattgaaacgtaagcttccagacagtgggtcaatacgtccatacccgtgtcaaccgtaatattttgtggtgctgaggcaactaaattagcatcaagcaacgcaatcttcggtaagatttcatcagttactagcgggtatttcacgcccttctcactatcagtaataacagcgaaattagtaacctcagatcctgtcccacttgttgttggaacagcaatcaaatcaagttctgcgtcatcaggtgaggcctgctttgcaaagtacttcattgcctttgtagcatcgattgcggaaccgccaccgacagctacaagtagtgttgctttgaaattctgcaaaacttcaatgcctttagtaatttcagtaattggtggatccggtttaacatcagaaaagatttctaattcattattatcttttaaatgatcagtaatcttgtctaagcttcctgacttcaccataaatggatcagttacaacaaagattcgttgaccagtgacattatctaatcctgatagcgaattgtcaccagtccaaatctgagtcttaaactgtatttcttccaaatcatataaccccctttacacacatttttcataaacaaaaattaaaaggagcttcaaagcacacaaatactgtgtgttttgaagctccttcgcttcttttaatgtacgccattgtacggaattcaatttttatttacgtacataatatagcgcttacaaagttatgtgtcaacacttttcaataaaaaaaggccgcaattaagcgaccctcaccataaacgccattgtttacgaattctgtacgccattgtacagtttaattaaacggaaaaacattccaccttaccacgagatagaatgcaacatctgtgcgacggcttattaaaaagatctgacttataacagatgaactgttaatcacagtggcgggaccgtaccggaattgcaccggtttccatttaataagttttctatttaactaatacaatatatgttatcatacaaaattaggtctgtcgatcaatcacatctaatgaaagacttgaccaccattttcataaaaaacttccggtgtatcagtacgatagtttattactcttgctagagcatagaaataatcggacaggcgatttacaaattttaaaatatctccgggaattgtcgacgtccagttaagtgtcacaatttgacgttcagcccgacgagtaattgtccgacagacttggaaaagcgccgatactttactccctccaggaagaatgaagcgattaattggatctggttcatcctgatactgatcaattctgccttcaatccaacctaggtattttccattaaagcgctgattttctggtgttaaattaggattggccaaatcacttcctaaatcaaacaagcaatgttgtagttgaagcaactcttttttgatttctggctgggaatcttttaattcagttaccgttaaaccaataaacgtattcaattcatcaacggttccgtatgcccatactcgatctgaatctttactaaccgtgctgccaccaaccaacttagtggtcccatgatcgccgaccttagtatataattgcatcatttatcctccttataacaaaaggacaccaaacagaagactcaactttgagtcctctatttggcgtccttgccaatttctagtatcattatagcgcttacaagtcatatttcaacctaaaaattgctatcactgcgtaatttaatttcaaattttccttagtaacccaattaattagccgtgtaataagccttaacgtcagcaatgccgtccttagtaaaacctactatccacaaacaaacagtgcttaagctcgtatttatggacattctgatcagcatcacttcgtccttcagcattcagcactacctgtcatagatagtctgttaatcctgcaagaattcaataaaattgtccaaattcctcattgcaaagtaatcagcaatcgcgcttttacctgcggatccatcaccatttcgtgcgcagatgccgctctactcaatggcaatcgttcgaattctggtgccttcagtacatccgcatgtgcgatcaaccattcacccgcctgcgttaaacttgccagactagcatgactgatgacaaatccacgcaattgttgttcagccatgtaaaagttaggcaaattgaaagtggcctcagaattttgggaagcggcgattaggataatgcaacctcctactgccagctggtcaaggttaagttgaagtggcacccgtcccgaagtatcaatgattgcatcaactggttgggacagatgctgctcccaacccgcagcgtagtcgattactttagcacctaagacagtcagcgttgaaaaatcacgtggattagccgttgcgattacgtgaagaccggctattttcgcgcattgaattagcagacgtccaacatgaccaccgccgccctcaatcagcaacgtctgatcaggtttaagtttcagaagctgggtcacaattatggctgcggtcgcaccaggatgaaccagtgccaaccaactacttgggtcgactgcgggcattgggaatagccgggtttctggaatagcaacaaactgagccgtaattccttgccggccaccataacccatactgttcgtccatacatgatcaccaacgtgaaaagcgtgaacttccgtacccaccttcacaacggttccccttgcgtcccgtccaatcacttgctgtggcttgagtggtgtctgaaaagtgccagaacgaacgtaagcatcaactcgatccaccgctgcttcttgaattttcaccagaacatcagttggaccgattgccggcacaggtagctgacccacttgaatttgattcacaccacccggatgtgtaaaataggctgctttcatcatttgaacctctttcataatctttcgcctctcctgaattcttactaacttatgactttttcagcttattttattgtactagctagaatgcgtaaacgtaagactaatttttcagatatacaggcctatattgggaggccttatttacatagttgtagcaaaaaagccgaccctctcaggtcagctctgtagagatatactaccccaaactaaagcatcacacaaaatttcgcatatacgtcacagaatgccgaatcgctgcatccacctgcgtggcatccgcctcaaacgctttgtcttcaatttcaatgctggtgttacccgcgtagccaacatcacttaaggcggacacaaaacggccccagtcaatatcaccgtaaccaggcaacttgggtaccatgtacgacagcggtgtcgccatggtgccaacctcagctaatcgttcgggtaacaacttaatgtctttaaagtgtaccaagaataacttatcccgaaactcatagatgggtttcagatagtccaacatctgccaaacaaagtgcgacgggtcataattcacgccaaagttatcgtagtccaaaatatcaaatacctgtcgccaaactgccggcgaagtcatgatgttttgaccacctggccactcatcgtcggtaaacagcatcggacagttttcaatgccaattcgaatgccacggtctccggcgtactcgataattggtggccaaacttcagctactgattggagattctgcgccacagtccggtactggtcacgtcccagaaaagtggtgaccagtggcacccccatcatctgagcagcgtcgatcactcggtaaaggtgagcaatcgccgtttccgcaacctcactatttgctgatagcgggttggggtaatatcccaacgctgaaatctcaacgtgccgatcagttgcatacgcccgcatctcctctgcctgcaccggtgttaaccgttccgcgtcaacgtgggaaacgcccgcgtaacgacgggcaccatcacctttgggccaagctgccaattccacacagcccaacccgcgggcagccacgtaatcgatgacttctttatatgacatatctgccaaaatcgcacttaataagcctaatttcatcatgacccccacctaactttcttctttagatacggaccgttggatcagcaatgcaccaatgatgatgatgcctttgatggcgcccaccagaaacgatggcactcccagcaggttcatcaaattattaatgataccaagggtcagggtgccaaataccgtccctaaaatcgttccgcgaccgccagccatggaagtaccgccaatcacaacggcagcaatggcatccatttcgtagccactcccagaagacgctgagttcatgctgcctaaccgtgatgcctcaataattgacgccaacgctaccaacacacctgataacgcgtacaccagcaataagacccggttcacgttaattgtggacagaaagctagcccgctcgttactaccaatggcgtaaacatgacgtccaaacgctgtccgccgcgcaatcacactaatgaggatgcaaagcgcaaaccagtagatcatcggcattggaatgataccgaataacttggtgttggcaatcgccgtaaaggcactggctgatcggccggttgccaatatcccgccaccatcaaagtagtattcggaaactgaccggtaaatctgcatggtacccaacgttacgatgaaggccggcaccccaaacttggaaattaggcccccagtgatggcaccgaacactagtcccgcaaacaccgcagcgacgatggctagaaagatgctctgggtggcatttaaaatcgtcatggcaatcaggccagtggcggccatctgagaaccaacggccaaatcaatgcctgccgtgataatcaccagcgtcatccctaaagcgatgatcccgatgatcgagttattcattaaaatgttcatgatgttgctgacacttaagaagattgacccttttaggagtacggccacgatgaacaggatcaggaaggcgaaaatggcgctatagtctgcgatcaatcccttcagactgcggtgcttgtgtttagatgctgaagtttcctgcgtatttgtcataaactcaccttcctaatctaattgtccgccagttgctactagcataatgtcgcgttcgttaatggcatcgtggggaagttccgctcgaatctcgccatgagccataatgtagacgcgatcacagagttgttgaatctcaccgatctcactggtgaggatcacgaaactaattcccgttttggcaaggtccataatttgatggtaaatctcggctttggctccaacgtcaactccctgggtgggattatctaaaatcaccactttggggttcgtacacagggcctttgccaacagaaccttttgctgattaccgccagataacgaaccaatcacatccttaacgtcagccactttaatgttgatctgcttcacgtaacgctgcacagtggccgttagctggccacgctggatcaacccgccgcgagataaccgccccagtattggtaacgccatgttttcttcaatgttaagatccggaacgatgccgttttccttgcggttcttcggcaaataagcgataccgtaccgcttgatatccgcggtagtcctgatgcgaaccggccgctcattgaccagtacttgtcccgcatcaaagacggttgcacccacaacagcactgaatagttcgcttcgaccatcacctagtaaaccggtgacaccgacaatttcaccgccatgaacaacgagatcaacgttttgaaattcacgtgctttcgttagcccttttaacgtcaaaactggctttccaagcggtcggggctggtagatttcactattagccagttccttacccaccatttgattactcaactgaacctctgtgagttccggagtaacctgccccgaactcacgacgacaccatcccgcataattgtataggtatcacaaatctccagaacctcattgagtttatgcgagataaaaatcaggctaaccccctgatcttgtaacgtgcgcatcattttaaacacatctttgatttcaacgtccgttagcgaggtagtgggttcatccataataatcaccttagcgtcacgcatcagtgcccgcacaatttctgtgatctgcttgtacgacggattcaggtcgcccaccatagtggtcacgtccagtgcaatgccaatctgatccacaaatgactgagccgtggcaatcatttcacgtcgacgtaataacccgtggcgtttaagttcatggcctaaatacaggttctcgtacacagccaaatcattgaccaacgagagttcctgatggataaaggcaatttgctgctggctggccggtgtcgcgggtgcgccattaatctcaatgtcaccatgatccttggtatacacgccggtgagaatgttcatcaaggtcgttttacccgttccgttctcacctaacagggcgtgaatcgacccagtcgccaaggtaaaatcgactttctttaacacgacattggccccgaaggctttttctatttgacgcatcttaacgacatcagtcatctgtatcaccgacctttagtatggcgatttagcatccaagaacttagaaacgttatccttcgtgacgatggttggggcaatgatggtatccttcttgatgtccttgccgttcatcgcttggtttgccagcttgatggcatcgccaatcatggctggtgagtaagttgccgtaaacttagtaatgtcgccgcccgctttgatttgcttgaagtaagcttggtccccaccggcaccagagatgatcttaatgtcagtccgcttagcatcattcacggcttgtaagattccgattgacgattcatcatcgattgagaagatgccgtcaacttgcttgttggattgcagcatatctgttgctgctttcaagcctttttcctgtgtaaagtcgtcagctgtcatattaaccaacttaatgtctgggtagctggccttcatgactttcttaaagccagcagtccgttcagcactcacagaaccagaactaggcacgtttaatactgcaacggtaccctttccgttcagctcatcaccaatttttttagctgataattgcccaatttgggggttggaacccgcaacgtagccggtgtacttggcgtccactttccggtcaaagacaactagtggaatcttggcattaacaattttcttcgcagcaacggacacttcatcagtttgtggctggaggacgatagcacccactttttgcgagatcatatcatcgatttgtgaagcctgctcattaacggaagatgaagtcacaattttatactttttcagtcctaattttttaacttcttgctgtgcgtagtagttcacgccagcttcccaaccgtggtcggaactaggaatcaccacggcgagagtcttgctgctagtggtggttgatgagtcactggattttttctccgatgacgaactgctacacccggccagaccgatcatcgtggctgcaagtgcggtaataccaagaatcttaacgagtaatccttttttcatttctgttcacccctgaagttgaattggtttttgttgggcatcgctgacgacacaagcgtcaaccagccgcattaagtaatctgcttctgaaaaatcaacgtacccggcactagacttaccgttcacgtcatcataaaaggcctgaataccagcagtaaaggcatccttccaccccaccgcgtggccgtttgggagttccgcatctgctgcggcctgaccatgtaaatactgactggcagcgtataattcttcattaccctgatctcggtgaccgatccataaccgatctggtcgttcctgataccattccaatgcttgctcttgaccttcaaccagcacgtgaaggtcattcttcttgccggcactcacctgcgacacccgaatcaagccggatagtccgtcttcaaaggtcacaaagatgatagcggcatcttcatttgacaccggcacttcctgtccgtcccgaaaacgagtggcatattcctgaagccgtttaacctctacactgacaatgtgctgacccagaatgtactgcaacgtatcaaaacaatgagaaccaatgtcggcgattgctcgagttggcccaccaatctcggcgtccacccgccagtcgtagtcagtttgtttcaataaccagtcctgcaggtattcggtattgacgaaccaaggtcgcccaatcgaaccatcagcaacccgttcgcgcatctcttccaccatcagattatgccggtaattgaagttaacgcctcctttgagtccgctttctgccagttgttgcactaaaatcgctgactgttcagcgttgctggtaaacggcttttcacagtagacgttcacaccagccgaaattagttgctgattgatagcaaagtggaaactacttggtgtacagttgtgaacaacttgcaagttcggctcctgtgctaacatgtcctcaactgttgtgtagtaccggggaatctccattgcttgactgagttgtttggcaactgcttcattaggctcacacaccgcaaccaagcgcgcccccggaactcgccgaatcgcctcgatgtgttgcttaccaatgaagccagtcccaatgaccgcaacatccatgccgtgacctccttctaaaacaatgtgtaatcgcttacaagcaaagaatacgattattacgcgtgatagtcaacgtaatttttgcaaaatatactgtaatatttacagtatgacgttatatatcacacgtttttaagaaaattcgtgctataatgagtgacaaatgagaaagaagggatcgccatgagtcgtaaacgaaagccagcctcattattagacattgctacagcctccggttactcaatcgccacggtctcgcgggcaatcaaccatcggggcaacgtgagtccagtggcacaacgaacaatcgatgcgttggtagcggaattgggctatcacactactaacgcctgtccgcctcctaagagtacgaccattgcgattctaattcccaatttatccaatcccttcaattcatcggtgttagagggaattcgaaacgctgccatcgcccatgatctcaacgtggctttactaatggtcaaggaaactgacactgatattgattactacctgaatatgttgaaagatgcgaactattgtggtgtcatcgccctggcggctcttccggataatcaaaccgcttaccaacttaaccacgagattccactagtgatgtgttctgaatatttagaagataccgagatgtcctacgttggcattgatgacaacattgcggcacaaaaggccaccgactacctcacaagaattgggcgccgtcacattgcattgatcaacgccactacgaatcacaagtacgctcgccaacgagaagccggctataaacaagcgttacgtcgggcacaattacccactgatacggacttgatcctgcacatcaacagcatccgctacaacctggcactctctaaagtcaccgacttgctcagaactcgaaccgaagttgacgctattttcgctgcctcggacattttcgccatagcagccttagaagctgcccgacatctaggtcgccaggtacccgatgacctttcagttatgggctttgataacaccttcttagcaacggtagtctcccccaaactcaccaccattaagcaacccgcctacgaaattggtcatgaagcttgtgagattctgcaggaaaagattgcccgtaagaacgcaccggaacgccatgaggtgttggaggcgtcgctgctggttagggagagtacgtagggcgtttgggtggtaaaatgaactaaagttcttcactaataaaggagttcgatcgcatgattaatttaattttcaaaaatgaccaatacctggatcgtgatggcaaattcaccgaagatattgagcaagcacgcattattaagagccgtaagattgctaaccaagtggccgctaaatatgatgccgaagttaccagttattactggaagccagaccgggagaatccgtggttagaggatatggaagatgaataagatgtcatgaaactagttagctcacctcaattgagtcagttcattgaggtgagcttttttacatgttgattaactatgagatgtcacggacacggcatgaatttgtgatattggcaatttggacacacaaaaacagggctgtgccataagtctatattggcaagtatttcaattaattttgagtcataaaaagttatcaccgtgctttggctctatacgtaaagatagcctaattacgtgcccaaactcagattccggccatttaacgcaaaataatgcctactccgcaaaaatcgcggaataggcattattcacgttaaactctggaatctaccgagttttgtcacagcttcgcacacaattttgatatcttaattctattcccctgactcccatttatacgtttttaccagtaagacaggaacggaatacactttatcgtaaatttttttatcatccggtttgtactgaactgaagaatagctgaattttttttgcccgtctatgatacctgaagcacttagatagtcatttggattcacgtttaagtcagcatgtagcttaacactactaggcgcatcgacctttagtaaaacgacattttgaggctgtttgccgatgccaccctgcaaccaaatgtacgtccatttgtcggtgttatccattgagtcagcctgcatcacagtaccttgccaactccaggctgtcccattatattttctgggatttttaacaatagatttaggataaatctcttttccaggctttgtcttccccgcccattcaatctcatcctcatccgcctgtttaaaaagtttcattggtgtattagcactggaagatactcttagtttttcctgagacttttcgattactgatgaactggtcgaatttggtcctggcttaactgcacttgaacctgaccctgtgcacccgcttaaaaccaataacaaagcagtagcgactaacattaaaaccccaccatattttttcataccctatactctccccttcttaacccttaataagcctaggctgtacttactacgcaatatttgcgtacttttatcccattgctacgtattgctcgctcgtttcccctttttcagctgactttttcaacttcattccagcgaattctgcagtaaccattttgtcgagctgatcggttagtacttccatcgacactggttgactatcatgcaaccagtccaagtacacacgcatcatcccgcccgccacaaaacgaatatgcatgttaaactctgcaggtgacacctcggctggacgttgtagtgctgcatcgaagacatacgcgataatatcgataaagtgttcaatgaaaaaactatgcttctgagtgactgctaagtcatcaaaaaagtcgtaataatttctgatattttggttgattgcttcaataaatcgcctaatcgaaaacggccgtcctgttaacatctcacagtaagttttgactgtattacattcgaattcagccagtactgatgcaatggatgagtagtgccgatagaacgtccttcggttaatcccagctttctcagccaacgctgtcaccgtgatgtctgtataagatgtctgctgcatcaagctcaaaaaagccttttgaattttttcctcggtggtcatacccccgcctcctgtcaatctaattatgccacaaaattgatgaatccgtggcattttattaaaacgcatacatttttctgatattgtgaatttatatcaatcaagggagtaatagttatgaataaatcaaaagcactttcacctttaaaattaggcaatggcgtacaagtcgccaatcggttaatgatgtccgcaatgtgcgatttaggggctacccctgacggtcaagtgacccaagaggaagttgatttcatgaagacccgagctggtttcggtggcatgatcgtcactgctggcgcttatccgcaagccaatgctctaggactccccggccagtatagtgtggcaagagactcagacgttaaagggttaagcaagttagcagcagcaatgaaatcacgtggtgccaaagccatcctacagattggccacgctggtcgtgaagctgctataccagcacaacagggaatccccgtgctcgtgccgacaaagatggactttccttggatcaactatccaattgaagaaatgacgaacgatgatgtgaaccaattaattaccgactggggtaaagctacacagcgcgcaattgacgccggctttgacggtgttgaaattcacaactgcaatcatgatctggtacagcagttcttctctgccttttccaaccaccgtactgatcaatggggcggcagttttgaaaagcggtgcgcactgccacttgccatactgaaggaaactcatcgcgttatcgctgcctcagataaaccagactttatcgtcggatggcgtatttcaccagatgaaattcacggtgaaaacgttggcttcactgtcgatgacatgctgaagcagactaagttagtgctaaacgaaggaatcgactacttgaatatttcactcactgggtcaatgtatagttataaatccaaggcgaacggttatgaccagacttacgcacagttattccacgctatcatgccggatagtgtaccgctatatattggatcacaggtccagacacctgcagacgttgaagatgcactgactgttgccgatggcgtttatatggcgcgtgaagcgttaattgaccctgaatttacagataaactgaagtccgggcatgctaacgaaatcattaccaccatgtctgaagagcggataaaacaggttcatttaccaaaagccttggtgaaagactacacgacacctggtggtttacgggaatcaattccgcttccgggtctgaccgattaatttcaaattacagttactgtaactagcgtgctttatagcctattttaatcagtaacatcatttctatcagaagtatatcaaaagaccatcaagcactcgcctgatggcctttttctgtagtcgtgattatgattctaatcatacttcagtggcacaagatactggttaacgaacgcgtcaactgcctcatcactgggattgttttcatcatcaacttcgggatgatatttaattaatgaatcatccacattgaatagtcgctgctgtccttttactggaaacggttcaatggtacgtagccgatcaagctgccaagcatactgataatcatccaacttgttaacgtccttaagtcgtaccaccacaatggcgtggccaggtatggtttcaggtatcttatgggccgtagcacagattaacaagtccccgcgatacttcgtcggccaactgcgatactcgatggttttgtcacctgctagtacgtcccaagcatagtctggcctaagcgatagcgctttcatattttcacctcacttcatcacaaaatttatatcgtcatcatgacataaagtttgcggtatatcaatgttttcaaatgattattttaaaagctttttaaatcatagttaacagcaatctaaccacaatcaaaaaggtacccataattcaattatccagaaaaatagatacctaaaagtcctacccctgttaccgctaaagaaaaagagattgcgtttttactcaatccctttcactatcatttaattaaattctcgatccacttgtcgacgccatctgctgataatgatggtttgtagcatgatgtagcatcaaatcatacttttgatgttttggcatatagccgacttgtccaccaccattagttaaaatagcagtatacttctttccatcaatcttaaccgtcgttttcttcataggtgctgcaccattagccaagctaagtgaataagtataccacccattcttatgtttctgaaaaataaacttatgcttagcattacctaatttcttaacgaggctgtacgtaccttcactcttatattttccatgactgtactagcagcgtctgctttagtctgactaaagcccaaaaataaggcaaccgaggcaactattacagtgccatatgctaatattcttttccccaaaagactcatttcaacatctcccaaacaaattattgaacattcaattctgattatacccgtttatacgcttattaaacgcaaaataaattcctaattgaaccaatcaaaggtttccatccagtaacaaaggcaaattaagaacaccttctagaaaaagcaacttagtaacggtaccaataatgtgtttcatagtgatcggaaattttaattttattgtgactataccatttagccttaaacgtataagttgtagaaagcaatttccctgttatctgataagtgtggtgacctaaatatttatatttagcacttgtagctgtaggcctggtcatatcactaggaccgtggtatgcctgttcaattgatgtaacattcttttttgtgattttagttaatactcgttttttcccgtgacccacgtgctgccagttagttcgccatttaccttgaagtgacgtaggtgtgcccttgtgccaactagcagcatttgcggaaatagcaccgcttccccctaagataattaacccagtaacaagactcaccgtccccttaaccactctattaaacaatataattaccaccttagtatttgataagaaaattatatcattagtttgcgtatcggtcttactagaagaaccggtgacgatattatgggcttcttaaactcaagctttccaatgaaattcatataatttcccttggaagttttttaaaatacaataacagatgattttgggcagagaaaacaatctatgtattgagtgaagtaataagattgtccagacttaaatactctgaccatctttgatatttattgaaaccaaaaaatacgaattataatgccacaattgacagtattgcttaaattgttcagtatttttgccgttaatgttagctataataattcttacagggggaatttaacggaggttaatgttctaggcaataacgaggagtgaaaactatggggaaaaaagaaatgctattagctattttcgttttgggcattggcttgactggacttgctggttgtggacacaatccggaagatgctgagagagcgaattcggttgcttttatgaaaacttctaagaataagcaaccacaagtatggtttaagggtgaactagatgatggtgaaattcataaagactctgcaattaacgatgttttagtcaccaaaaacggtaaagtgactgattacagtatgacaaatatcacttttcaacaaatcaagggtaaaaataatgatcaacttattaaattagccaaaacacttgataaaaaaggacttaagcctgtgattgccaatcaaaaatcactacttaaagaacaactaattactgcaaaggaaaatttaaaagaacagcagtcttcaaaaaaggattgggataaactatctgacgcagaaaaagacgcagctaaaattggatcactatctgatgcaggctctcccgaaagcatccgagacgcccagaaacaagttaatcaatatacaacatttgttaatcaaatttcacaaaaaaaatattcttatatcgcaccaaaaacttcacctattgttgcctacgttaatactgatgacaatgataaatcagtaacggctgaactacttggttggcaaggttacacattcacgttcccggtggcagataataatgatcaaaaggacctcactaaattaacacacaaagctgatacaaccggtcgtattaacaaaatggatttaaacggtattatgggcgctccaatctcaattttaggtgataagtacattggttactatttatatagcgaaaatgacgattcacaagaagataacttcttaattacaaaaactcaaaattcaaaagcaaaagcacaattggatgaggcaaaaacatctggggtaaagaaaactaatacatcattaacagaatattagttaagttaaataactgctttaattccaaataaagtattgaagtttcatcgctacaatattcttcgaaaatcggaaaaacgacttatcgagaaatctttttaattccctcgataagtcgttttaattgctatcattagtgattttaatcacagccttattttaaaagctatcatgtaaaacatggcatagtaaaactacattgtctggtctctcgcgacgatctcattcaaatcagcctataaaaggaaaatgccacaaatattgagctttcacctcacacattagaagaatagtcatgataatttttaactaaatattcctttcacaatctcgtttagtatatttaaaacttgttattcatctaaaacgttcttagctttttctaaattcaaaaaaagacgggaataatcttcaaatcacatggtatttttttcacactatgccctgtaaccttgtatatggggaatgctataaatttttcttgcgttcaaaaaatttaggaaaaggcttgaaacgggggattattaatggactacacactcttcttcgagaagaatgatcaaattagtttcgcactattacaatcatttgctcgaagcggtcggtacattattactcaagaggaaattctgaggaatttaaatgtttccgagtataaactttcacaagtaatcatcaatctcaataacgatttaacgcagttggcgtcaccagtgggtaaagcatctattacttcgttagataatcgtttatatcgaggaaataatattacaaccactctgattcaccaggttcgcttgatgtatttagagcggtcatctctttttgcactctttgcctataatctattagctgcaaataaggaatcgaaaataacttttagaaaggcaaattctataattaatccgaacagaaattaaaaagcccaaagcaatcacttacaatggtagtagctaattccaaccaatatagggagtgattactttgggtacatctactt

SEQ ID NO: 704 - DNA, 6317 bp, Unknown
  Metagenome-assembled genome
tgttgctcaagcaacaggtcaatggctgctcgaacttcatcaataatagattggtctaaactggctaaccgttttagatcagcattaaaggttgcacgtggtttaaatcttagttttttcattatttaaactgaccccaataatcatcatctgattcaacaattgcatcgtcaggtaaaacatggcgtttaattaactgatcacgtgcaattgcatattctaacgaccttctttagcttttaatgctcttctagccaccatttttcttgtgaaacgatggctactgcgcggacatttgaacgagcaatataaacggtttcgtcttcgtcattaacttgatctaatatttttttaggttagcgcgaaaatcgctctgtgttagtgctaatgtcatatttaccaccctttcgttgtacttaatattgactttaatttgtactaaaaatcaattttaaggagctaaaactatgcaacaagttgtcttacccatcaaagattcaaacgttctcaaagaggttcaagataccttactcaacaactttaaagctggccggcgtaactatacagtttttcaagttggtaaagcgacactgttgcgagtcagtgatgtcatgcgcttaaaacaaaccgatatttttaatccggacggttctattaaacaaaatgcgttcattcacgaccgaaaaacgggtaagcctaataccttgtaccttaaacctgttcaaacagagctcttattgtaccgtcaatggctacttgatcatcagctggattctgaatggctctttccttccattcaacacccagaacgccatatcacggaaaaacagttctacaaaatcatgagcaaggttggcgatctgttaggaattaattatctagggacccatacgatgcgtaaaaccggggcttatcgcgtttacacgcaatcaaattataatattggcttagtcatgaatttgctcaatcattccagtgaagcaatgactttagcttatttaggcttagaccaggctagtactgaaacgatgctggataaaattgattttggttaggaggctggttttatggatttagattttgaaaccaacaagtatgatctttttgatgattggcatcaaaacaagactaaacaagactttacacaaaagttgcaacaacaagctcaaattgaaaaaacacacctgccaaaattattgtcgcgtgaagacttaaaaattcgttggcagatgaactctcgtcaaagtgttcatcaagttgctagtaagcctgattttccacaacccgtttttgcttttaatcatggcaagaccccactttacttagcaactgaaattcaaatttttgaaattaatcacccctgggtgataactcccggtgctcgtcttgcttatagtcattggatccttcgtaatgtgattgattaatcttgagatttggctctaggatttttatcgttggcgctagccttctaatacaaataatccccatcaaaatggggattaaatctacccttgacaagtgtcaagggtgtaagtgcgcattgacctcatttcactcggtctgctgatagacataaaatcaatttttctcgttattgaattgaatgtatttttaattcaatttatgcttgtacttaactaagtttgttatgctttagatacttaagaaatgttgcagattccactgttttaagccaatttttttaatcgttctgtgcaaagaatctttataagtttggtaacaaattttgaatagcggtactgtaaaatctgtgaatctaaattgaaatcattattttgatgttaggagtaatcaagatggacgaaaagaaagtattaaaaaccattgatgaaatgcttgctgatccttggcaagttgatattcaagaattgtttgaagcttctttcaatgaacctgacgagatcaaaaagaatttgtatgattccctggatacttatgttttgcagaaaagacaagaagatattattaatcgtcctggcttcgttatttagccctctaaaagcctgctgagggctttttatttttgctttggtataaagatatataaacagtctcaaaatcgctagaaacgagaaataaggcccttaaaaacgaatatagcagttagattcttgttgagattcagaaaaactaactgtttgctgtcaatggtagcggacgagcgtagcgtgggagcataaggaattgacagctctaaaccagtcttaacactgaattggcgaaagccaaagtttctataaaactttgctttcctgcctaacggcgagtgaaaaagcggttaagctggctcagcttggacggggttcggggcgtcagcgcccgagttaatgtggcttgccactccttttaagcaacgaacagcgtgaggcgcaaggagctgtgcgactggagtttaatgtgagccgttttttggctcactcctttgtgttttttgttttaggtttgtatctcgtacagtggtgcctcttatatacctcttttataaacctcttttaaacctcttttagacccctattgagccttactctcccaaggctcacagaaggttatcaagtaccttttgtctgtttatcaagtaccttttgtctgtttatcaagtaccttttgtctgtttatcaagtaccttttgtctgtttatcaagtacctttataagttctgtacttgataaacaggtacttttattttaatatgtgtttgaggtgataatcatgtctaatgagttagttaagtatgatcctgagttgaatactattcccttgagaaaatttaccccaattgagatgaatttatttttttcaattgtttcccgcatgcgggatcaagggaataaaactgttcgtttctcttttgaccagttaaaagagcttagtaactataaaccaaccgcaaataaacgttttattgatgatattgaaaatacataccaaaagatcctcagccttaggtttggccgtagaagtaagagtggcttaaatcgtgaattttttgtcatgtttactgaatttgaaattaaaggtgaagctgaagaaccttatgttgatattcagatttatcccaaagcattgcacttgctaaacgatttagaaagttgggttcgttatgccctaacagaatttagaaatttaaaaagcagttacgctaaaacaatgtttcgtctaattaagcaatttagaactactggctattcttatttctctaaagaagatttttttgaattgcttgatatacctaaaagttattggaatagtccttcaaatgttgacaaaaaggttattaagccaattagagaagaattaaccccgctttttagagggctaacgattagaaaaaaatatggtaaaggcagaggaaaaccagttatcggttattcttttacttggaaacctgaaagaaaggacgcaaatgatttttctcaaggcaaatttcaagatgagcgtcaaaaactctttaacattcagcacaatgatgaattatcagataaagaaaagtggcgtgcaattgacaaagttaaatgcttgcctttaggaacaactgaaaaacaggtactggctgaaaaacaagctgaacatgatcaaaaaatcagagatcaagcaagacaagaagcacttgctgaactccgaaaggggtttggaaatcatgcctaaaactattagagaacttgctaatgaattgaaagtctccaaacagactattcaatatcactaccaaagactaccaacaaagaaccgacaaaaagatagtcaaggcacaaacatgattagccctacagctgaaaggattattagagataaggtagcaaagcctttggtagcaaataaccaacaaacaggtagcaaagaaagcaatgagctaatcgctactctaagaagagaagtaacagatttaaagtctcaacgtgacaaacagcttgctaccaaagaccgacaaatagatcatctaacaaaattaatagatcagcaacaacaactgcaattaacaactgtagaagaaaatagagagttaaaagcccatattcaaaaaataagtggcttacttgaaccttctgggccatttcagaaacgacaaaataatgcctcagaagaggacgtgtataaaaataaaagcaataaaaattggtggcatttttggtaaagttttcttgattttagcaaaaacgttatattgtcaagagcggcgataaaatagactttatggatgtttcttctcaaaaccttgaattgtattcatcaggaatacataaacttcgttcaaatttattaaattgttttccagaaaataattatgatatttttatatcatactttcacaatgacgtgttgattgctaagagagtagcttgttggttaaaaactgagtttggtatcgatgactttatcgattcaaccatttaggtttccaaagaagccgttttccccacttttagggaaagccctcatgagagagccggaacggcttaatacttgtcaggcttaaggtgtatataatgctgtctggaaatactagcttgtttttttatacgagttgtccatagttgagtcttggggggggcaatatgaaatttcaagaaaagattaaagcgttgagattagaagccaaaatgacccaggatgatatgggaaaatctttattagtttcgcgtaaaactgtttctagttgggaaaatggccgaaattatccagatattaatacattggttaaaatcagtgatgttttttcaatatcgttagatattttgctaagggaggacaaagtaatgactgacaagttgagtgaaatttccaaattgagtaagaaaagccttaggatatttaagattagttatgggtttatgatggttcttactgttttatcttatatatcgagtatgacacgttttaatctacgtaatgggtggttagctatgctttatgtggttagtgtagctatttgtctaacacattttcccttaactggacatcaattaagggaatggtttggttcgtttgatcatttattattgttcgtatttattttaattggtactgggtacctagcgttacacatttctttcgtagtgcctggtgagtctgtcccttacttgacgggtactattataggagcgtttattggcagcttaattcgggttgtatcagttatggctattgttgtatttagtcccgataaagtactaaaaatgacagctaccggtcttgagtgattaagtttacatttctttatttttatcgtcttgatccaacttgttttactactatttgttaagcgtagaaagtaaaactaaattatagggtctataattaccaaataacccctcaaaaacattgaaagaatagcccccaatatctataatgtagatgttgggggttatttgtttttatataccagaaatggcttcttttattcgttattttttcgataccttttagcacgattttgaccaggaaataaacgatcatgcgatccgactcgaattccaattaagactagttcatctttatcaatcgtataaaccaccaggacatcgttagtttcgcttggtgttttgtttttcgggggggttgggttgtctggtttcgtaaatgaaattcattatagccgctcagttcgccgattaagcttcatgatcttcaaataatcttgatggtattgttgttgctcaagcaacaggtcaatggctgtctcgaacttcatcaatatagaaagatgggtctaaactggctacccgttttagatcagcattaaaggttgcacgtgtttaaacttagtttttcattatttaaactgaccccaataatcatcatctgattcaacaattgcatcgtcaggttaaaacatggcgttaattaactgatcacgtgccaattgcatattctaacgaccttctttagcttttaatgctctttctagccagtccattttttcttgtgaacagtatggggactctgcgcgactatttgaacgagcatataaacggtttcgtcttcgtcattacttgatataatattttattttgggtttgtgagggaaaatcgctctggtaggtagatgaagataccacaacttctgtgtgtactgaatatgcttatgctaattaaaaatacattttttataggagctaaaactatgcaacaagttgtcttacccatcaaagttcaaacacgtttctgtcagaagagagttcaagatacctactcattatcaactcttaagatgcgcgcgtcgtcgtaaaagctatacagttttcaagttggtttctttgcttatttaaagcgtgactaatgttgcgagtctagat

SEQ ID NO: 705 - DNA, 924855 bp, Unknown
  Metagenome-assembled genome
aaaccacgccttggcaagtttatggggccttcggtccccaagtaaaatccattactgttgatcatggtaaagagtttgccttatcaggccttagaacaggattatcagatcaaagtttattttgccatccatatttaccatgggagcgagggttcaatgaatattttaatagacgggttacgctggttttcttcccgaaaaagacaatttttagccatagtaagtaacgactgatgagatcctagcagcacttgaactaattaatcaacgaccattaaaaatacatcatcaacagactgccattgaaagattccgggcttgttcggattaaacttgtaatttgcctatataaattctaagctacttcttcaaactatctaataactgtttgccgttatcatagaagatcatttgtttcattggttcagaaacaacgtcggtatccgcaagtgtttttgctaagtgatccaccaatggggcaggagtgtagggtgaatcagtaccgtaaagcaaatggttagggttaaccatttgcagtaaagttggcaattgatagggtaaaaccttaccagcaacatcaaagtattggttagccattactccaggcacatcaacttgactatcggttagctccgagttcattttctttgataacgcaactctatcggaaataacgggaagtagggcgcccgcatgaggaataatgaatttaatgtttggatacttagtgaaaatatcattaaccgtcatgttaacgacggcacgggttgtgtcaaagaaaaagcccataacggcaatgttgattttactcgacatatttttagttgccggatgtggttcattggggtgcaacagtactaaagcgtggtgctcgtttagtttagacataattgggtctagagcaggattgccaagatatgtcccattcgcgttagtgggcagcgtgaaagctacggtgttttttgaaagcgcacggtcaatctcacttaaactttcttcaacataaggtagtggcagcgaggccgcaaagccgattttatcagggtaatgttcctgctgctctgcaccataatcattgacttctgctgtcatttcggcagtctgattagcatcataggctactgagaaatgtggtgccgaagcagaaataattgtgtaatcaatacgttgtctttccatagttgaaagcgttgtgtcgatactatatgctggagttgggcagtcgtcagcgtgatcgttgaacttttccttgagaaattttttgtatcctggagaaagatagtgggcatggaaatcaattttacgatacattattaagacctcctgataaatttaattcacaccgtgtataatatactcacggtgtgaattaatcaagagataaaaaataggaagtgattagaatggctagaaaagcatctttaacaactgaagtggtcgttgctaaggccaccgaaattgtgaaagagtcagggtttaacgccttatcataccgagggttggctcgtgcactcaacgttcagccgcaaactttgtatcgatatgtggctaatattgaagaattgcaggttcaagtaatactcacctttttagatgaattaattcagtatacgcaatctcaggtgattggctttagtggcaatcaggcaatcctcaaatttgctcaagccgtgctcacttattcaaaccacaaattaacgttaaccagtttgctttcaacgtcggctgacatttcggacaaacgtgaaattaaagcaaaattaatggcattacgtgaattgccagcagtaattttaaaacggcagagcagtaagcagattgatgtctctggtcgggttcaaatgctaatgagtttgattctgggttttgcggagtatattgatattggtttatacgatggtacggaagaacaggcagtggcactgttacaaagtcaaattgaaaaaatgctgattagcaattaagattaagtgaaaaggctctgttacgaaatgattaacatttgataaacccacagtgtttctcttgccagttacgtgatttgaagatatactactttaaaatcgaaattaagagggatgataacgtgcaatttatttttacaaaactactatggtcaacgttaatggtcacggggctaatcggctcagttgtcggctttgtgctaccagtcatcccgggtattccgtttttgatcttaatgatttatagcttgaaaaaactatcgccaaaatttcaccgctggctaagtcggacacgactggctgaatggttaaaggaacatcagccaactttagcaaaatggttggtaaactagtagtagcgtgtattcatatatgatatttaaagccaccaattcagaatctaaagattttgaattggtggtttttcgttcttatggaataggctattacgggttattaatcaaagaaactagaattgaatcaatgactaaaagtgaattattcaaaagattaaaaaatactgtttacattacaattaagttagaatataatgtgaatcaacataacgttatataacgttatagaaaatttcaaaaggagtagatttttatgaaacatagttttttacacaaatttgtatacatagtaactttggttggggcgctacttttagttctaagtggttgtggcaagagtaacgcttcttctgtacaaaacattaaaaagaaaggaacactgactgttgggatgatcagttctaatccgccatatgaatttcaaacgactaaaaacggtaaaaccgtcatgtctggttccgatgttcgattggttaaaaaagtcgccaagagtttaggtgtcaaatataagattaagacaatggacttggatggtttactgccagcaatgcaggcacataaggttgatatgttaattacatctatgagcccaacgcctgaacggaagcaaggcgccaagtttagcgatgtttattataagagtaccaatacattagttgtccgtaagagtgatgcaagtaagtatcagaatgctaataactttaagaacgccagtattgcggtaatcaataactcaactcaggaaccaatgattcaaaaagcatttccaaatgcaacaatgaaaaaacttggtaaagttactgatttagcattagcagttaataacggcaaagcagacgctttttcgattgatattccaacggccactattttgttgaaacagaatcctaacttaacgatgacttcgtggcgacatcatgatgcaagtgttggtgcagcaatagcgttacctaaggatacaaacaaagatctagtaaaggcggttaacaaggtgattgcgcaaaacaagaccgagtatgcaaagtgggttcttgaatacgcaaaacaagttaaataaattaagtatgatttggaggtggtggtatgtttcagggatattcttttattggtaaatactggggcttatttctaaaaggtatgggaataacgattgaactagctgtgatatccatcgtgttgggtttgattttaggtgtcatcctctcattgatgaaacgttccaagattaaaatcatttcgttaattgcaaaaatgtatatcgggtttattcgagatacacctttactggttcaaatctatattgtgtacattggtttaccgatggttttaagcattgatgtgccagatttcaccacgggcgttgtcgcgcttaccctttattctgcagcttacattgctgaaatcattcgatcaggaattgattcacttcctttgggacaaagtgaggcagcaatcagtttaggaatgtcaaagcggcgtgttatgacggatattattttaccgcaagcgtttaaaaatattttaccagcacttggcaatcaatttattggtaatgtgaaggattcatcactggtatcagttttgggtatttcagatttaatgtttagtgctcagacggtacgaggatctacggcattgggcttgcagccgatgctggttgcgtccctactgtacttagtgatgacttggttactaaatagcgtattggcgtatattgaaaggaggatgaaggcgagtgatcgaattgcgtaatgttgtaaagaagtatggtgacaacactgttctgaaaaacatcaatatgaaagttcatgacggtgaagtggtagtcatcattggtccctccggatcagggaaaagtacgttactgcgacagatgaatttattggaacagcctactagcggagaggtgttagttgatggtgaagtggtttctggcaaagttaaatcggaagtgacgcggaagacacacgaaaaaattgggatggtctttcaaaaatttaatctttttccgcattatacggtgttagagaatattattcatgcaccgcaagtcgttaggcatgagagtaaatcacaagctactgaagaagcactaaaactgttgaagcaaattgggttaacggaaaagaaggatagttaccccgcatcgttaagtggtggtcagcaacaacgaattgccattattcgctctctagcgatgcatccagatgtccttctattcgatgagccaacgtcagcgctagatccagaaatggtcgaagaagtattaaaagtgatgaagaatctggccaaaagcggtatgacaatggttgttgtgactcatgaaatgggctttgctaaacaggtaggtgatcgtgttttgtttgtggatgatggtcaaattttggaagaagatacacctgaaaagatttttgagcatgctcaacatgaacgaacacgagacttcatttctaagatcctgtatacatagcatggaagatcaaattcagatgaatggggagaggacgaatgcttagtaagcaaagcgcgataccgttatacaagcaagtcaagtcggaaattttaaatgatattcggtcttcagtctataaggtaggcgaaacaattccaacggaagttcaattagaacagcgctacaacactagtcgaattacgattcgaaaagccattaaccagcttgttaatgaagggatcctattaaaaaaacagggtaaggggacttttgtgcaaccccaaaaggttaagcgtaatctcttggatctggttagctataccacttacatgcaggagaccggacaaaaacctgatgcagtaatcagggctctagaagtgaaaccggctgatgaaagctggagtaaaacacttcatgttgacgagggtgcatccattatcagactggctagaaccatggatctgggtaaagataattccggatacgaagttagttactatagcttagagcgctttccagatttaaaccagcggattactgaaggtgcatcggtaacccaaattttaaatgaacagtatcaagcttttggtaagtatagtgaacaaacgttaaacgtgatttcggcttctcagcaaattgcagattatctcaagatagaaaatggtgcgcccatctatcaattggatagaacagtttacgaaaaagacggaaaagtaatgtacagtgcagtgatgtactatgacgttaacaaggtcagttttgctgtgaatacgaaggagcgctgagaatgaaagttgctgctatcggtgataacgtagttgacatttaccttgaccaaaagcggatgtatctaggcggaaattcactgaattttgctaactttgcgacagaattccctgacgttcagtcgatgtatattggtaattttggtaatgatgaactaagtacctatgttaaaagggttttaggtgacctttcagtggattacagtttctcacgtgaactcgatggcgagagtggttattcaaaggtaacgcttaaaaatggcgatcgagtattcatcacaagtaatcgtggtggcgttttgaaaaagggaattcaattgtcggtgcaagctttaagtgaagtaaaccagtatgacttagttcactttaatatcaacggaaacgctgatcaatatctaagagacataagtgggcctaaaatcgtttacgattattcagattttagttcacgtgaacaaattcgacataccatcaatcaagtagacattgcttgtttttcaatgggagacgctagtgaagaaaccgttcaaaatttaattaaagaagtccatcagttatcgactaataaaaagctgattattctgataacgcgtggtgaatatggtgcagttgtgtccacagctacgggaaaaatttatagacaggacgcagtaaaagttgatcgtgttgttgatacgatgggtgctggagatgcgtttattaccgcgtttagtattagtttagagcaatcagaatcaattccgcaggcattaaaaattgccagtgattacagtgcaaagcagattcaaagaaacggatcatttgagcatggtgtggtggcaccagctaaatttttacaataattaatggaaattggagtgtttgataatggaacaagaaactagtttggatgaaattaaagaagtagttaataagattacagaaaaacgtgatgttcgcaacttagtttttatcggctgtggtgcgtcatattcagaattatttgcagcttattattatgtgaaacaaaatgcgcagacctttaaaacggacttaattcaggccaacgaatttaattatgctgctccagcatattttggtgagcattcagttgctgtagtcgcctcactaggtggtacaactaaggaatccattgcggcagtcgaaaatgccaagaagcagggtgcttacgttttggcattgacttataaacctgattcagctttaactgaaaatgctgattttattcttcaacataaattttttgaaagttatgcaactaaggcatctaagcagaaggtactgctgacgtttgctgtggaactgttacatcacattgaggacacgaagaattatcccgaaatgattcaaggactttcagttgtggatagtattgccaatcaagcagccgatggtgcggatgaagatgccgaaaaatttgcccagagttataaagacgaagctcatatctttacgttggcaagtggtgccaatcaaggtgttgcgtactctacaggaaacttcatcttcatggaaatgcaatggatcaagggaaccgttctggacagcgctgagctttttcatgggccttttgaattagcggttaaagacgcaccattcttactctttatgagtgatggtaagacacgtcatttggattctcgtgcgcttgaatttcttcaacgctttaataccaagtacacggttattgatgccaaggattactggttagacagtcaaattgatggttcagtcgttgattactttgacccaatggttctgactgccgtaatgagaaagtttgcggaacatttgggcgatgctcgaaatcatcctctgagtaaaagacggtatatgtggaaactagaaaattactaaaaagaattgtatgtaaaaaagaactgcactcaaaatgaagtgcagttcttttgtttggaattcttaaattaatactgaatatgcagcaactcagcctgcttaatatcttcaatcgtcttagtgccagctaattgcatcacgatcttcagctcattgttgagatgttcaaagactgagtaaacaccatcagcaccacccagtgctaagccgtaaattgcgggacggccaatggcgactaaatcggcacctaaggcaattgccttaaagacgtctgaaccgcgacggacaccagaatcaaagatcactggtacttgatggttaactgctttagtgacgctttcaagaacgtcaaagctggctgggccaccattcaattgacggccaccgtggttagaaacgtaaataccggctgcccctgcaccgatcgcatagagcgcatcttcaggtgattcaattcccttaacgatgactggtaaatcggtgtagtcaatgatccgcttaacgtcatctggaccaatcttttgagcagcagaggcataaatttcagaaatgcccttaccttcgccatcgccttcactgaacttgattaagttagccattggaattggaaattggaaatgattaataatatcagcttcacgatagccaccaacagtggcatcaacggtgaggatgatggcttttacgccagcttgcttagcttcatctaaaagtcacttgttaaagtcccagtctttactcatgtagagctggaagaattgaggagcaccgtcgccgccagcggcagtatccgcaatggatgttgatgaataggtactttgtgccattaacccaccagctttagcaactcccttcgcggtatcaacttcacctttagcgtgagccaagccttgtgcagcagctggtgccatcatgattggtgtcttcaaatctaagccgaagaccgtggtatcagtctgtggattttcaatgttgcttagcgccttaggaacgatttggcggtgttggaatgctttacgattagcatttaatgtccattcatcctctgaaccgctcacgatgtagccaaagccaccggtaggaataatctttttagcatcttcttctagttgagttaggtttaaaatatcaagtgttttttcgttttcgttttgttcgtaaccgttagtcataaccataatatttgcctccagcaaagataattatttttgaatgactatagcttacttactttttgtaagtgagtcaagaataaccacttgctgtttatcaatcaaaaaaccgttatccgactaaaagcttgtcaggtaacggttttatcttataaacgatactgtttaaaggcttcaaaatcttgatcaacttgctgcacgtaagcagccgtccacgtctggattgcctgatcaaacttatctgagtgcccggtataaccaagaatcacgccagcggttggactttgtgcatgagcaatacccagtacccaagcgcaagttttggcataggcttcaaactgatcccaatccagttcagacagttcgatagaggctttcatatcacggaattgccgcacataaaaactcttcttttccgtggcaaagtaacccagaaatgagtcggatgcagattgaaggatcttttggcaatcaacgattcgcttaccttcattttgctcgtactgcgcatttgcgtcatccagctcgtcggccagttgacgatggggcagggcttctttaatttgtaagaccaagtgtgagccgtccgtacccgtcagcaataatagataacataatgacccaaagctgcccacgccaacactgtgacggacgatgtcagtgacgtgatactgcgacagcattaaaccaacatcagtgggaagggtttgacggtattgggtgagatatttcgtaatatgtttagtgacccggtcgttgacatgttgcgttcgcggcgggttctccttaaatgaaattcgacccttgctgtccgtgatcgtaaacttgcgaaccacctgttcagaatcacgtttgcctgctttggacaagaatttcatcagttttttggtgtgcatttctttactggggatcgtgttcaatatgttttccacgctgtttattggatagaaacgattcagcgcggttttctcgaacatattctgtagacttttacggtaggattcgcccagttccttaaccaagttatttaatttgtcgtcgccgaattggtgctcacgacctgccaatagggtgctgaccgccaagcgtttcacgtcccactcaaacggattgatgccagcttcatcgaaatcgtttaaatcaaataggaggtgtcgctctggtgagccaaagaaaccaaagttaccgatatgtgcgtcaccgcagctaactgcgtgaatgggcgaattatcctgatgggtcaagtcagcttccattaattcagcggtcccccgaaaaaaggtgaaactagactggctcatgcgctgagtccgttctggtagcagctcgggaatcagaattgagcgaacctgatccattaattggttgggatcacgatcagttggcagatattcgcccagtgcttcaaatgggtacgctgaacggagcttcttaccaagtttctgttggtctttcaatgattgctgcacaactaactgactaaaatcgaacggcttaacactcattacgtttcacctcagtattagaattattatctctagtttaacacgtgacacctttaaggaatgccttatttacagaggtttacattgagtttacgttgggttatcaattgattttaatgggttacaaaattgtaaattaagtttaactggtcgctaatttaataaccagcagcaaaggctaatactatcaatattgaggaaagtaaaaggataggaagtagcgtgcctaaaataagacatagaattagatttaggttagttttgcagaggcgaaaagtaagtaagtcaacacacataaaataagaaaacgagattaatccaatcgcaaaattttgagtcgctctgaagaaatttaaaacaattgctaaaactagagcagtcccggctattatttgcattatacgatacgatttatgggtaaactgtgtggcaaacgtttcttttattgacttcatattaatcatgattaactcctaattttttgttgtttttgcgtctatgttgctgattctaacttagctgaaattaaattccaagcttgggtctctgttaataaatgtggtgttgcctgtagattcagtgtttgtagtagctgcttgagttttatcagcatgtgcctgctgcacatttacacctgattcaataataccagtacaacaatagtgcagtagcaaaagctaatgatgaatatttaataaaagattgcataagaaaagctctccctaagacttgatgactaatacgtattagtgagttgctgttaacatcactagattattcgtaagtacctactttggggaggatcggaatgcttaccttctggtttgacaaccattagttgcattaaataaaagaaattagtacacggaaagacatggtgcaagcaaaattgaaagatggtaaaattgtaagggtattcagagaatacagaaaatgaaattatttagtaaaatttttactctttttccggttttcggcttatactgaaagcggaagcattattgagaacacaacttaaacttaagaggagtggcgatacgatgacttggcaagataattatcaagtatggaagaactatcaagacttagatccagcattagcacaagaattagcagatatggctgatgaccaagagacactagaaaacgcctttaccaaaccaatggcctttggaactgcgggtatgcgggggttgattggtcccggaatcggacaaatgaacctttataccgttggggccgccgctgagggattggctcgctttatggataccctggacgataaggataagcaacgcggtgtggcaatcagttttgactcgcgttatcaatcgcgtgaatttgcacaccattcagcacaggttcttggtgcacacgggattccaagttttgtcttcgacgatattcggcctacaccagaactttcttttgcggttcgtcacttgcacacttacgctggtattatgattaccgctagccataaccctaaacagtacaacgggtttaagatatacggtcccgatggcggtcaaatgccaccaaaggctgctgatcagatcactgaatacgttaacggtatcgataacatgttcaccgttaaaactgtgaaggaaacaacgctcagaaagcaaaatctcgttcatatcattggtgaagatgttgatgaagattatttagccggtgttaaagccgtttcggttaaccctaaactgattgatgaagttggtaaagacatgacgttgatttacacgccattgcatgggaccggtcacatcatcggttaccgggcattgaaggacgctggttacgaccactttacgatggtcaaagaacaagccattgctgatcctgaattcccaacggtcactcatccaaatcctgaatttccagaagcctttaacatggcgattgaattaggtaaaaagcaaggcgctgacttgttggttgctactgaccctgacgccgaccgtttgggtgccgctgttcggatgccaaacggtgagtatcaactaatgactgggaatcaaatcgcctctgttttgctgaactatattttgaaggctaagcaggacgcaggaaagttaccagctgacggcatggtcgttaagtccattgtctccaccgaattagcaaccaagattgctgatcactacggcgttaagatggtcaacgtgctgactggattcaagtacattgctgaacagatcaagctggctgaacagaatcatgatcacaccttcttgtttggctttgaagaaagtttcggctacctgatcaacccgtttgttcgtgataaagatgcgattcaatcaaccattctattggccgaagtcgctgctgattacaaacagcagggattgaccctttacgatggcattcaacaactttacaagacctatggctacttcaaggaaaagaccactgccaaggagttcgatggcgttgatggtgccgacaagatggccgctattatgaagtccttgcgtgacagcaaaccaacggaatttgctggtgttaaggttgagactactgatgattatcaaacgcaagtggcaacccaccaagatggcggcactgaaaaattggatttgccagtttccaacgttttgaagtattggttagcggatggtacttggatcgctgttcgaccttcagggactgaaccaaagatcaagttttacattgggactaatggtaaaactgacgaagaggctactcaaaagttaactgattttgaaaatgctttaactcagtgggttaaggattagtaaaaaaacgatctgattttatcaaaatggtgttggtaaaatcggatcgtttttgtctgcacggagcgcggcaacgtggtgaacagctgacattgatcagacttgaacactcataaagattgatctgaagctaaagaaaacgatttcatttttcgttgacaagaactaaattttaggttattttagaggtagtaaaaatttagtaaaatctgtggaggcataattatggattatcaaagcttaaaagaagaattcaacaaagcttttggctacgaaggtgaacgcgtttacttttcaccaggccgaattaacctgatcggtgaacatactgattacaatggcggtcacgttttcccttgtgcaatcaccatgggcacatatggtgtttacgcagctcgtaaagacgaccaagttcgactttattctgctaaccttccagacgcaggtattttgactttcccaattgataaattagattttgacaaaaacgatagctgggctaagttcccacgtggtgtgatgtacgaaatggctaagcagggcaagacggtggatcatgggtttgacctcttcgttcacggtgatttgccagacgcttcaggcctttcatcatcagcttccattgaactcttgattggtaacattttgaaccaagaatttaactggggtgtcgatcaaatgacgttgatcaagaacggccaagcagttgaaaatgattacttagggcttaacactgggattcttgatcaatttgccatcggtatgggtaaaaagaatcaggctgttttgcttgatgcaaataccatgaagtatgaatatgttcccgttgaattaggtgacaacgtgattgttattatgaacaccaacaagcggcgtgaactgacggattctaagtataacgagcgtcggtcagaatgtgaaaaggctgttgcacttctacaaaagggcggcgtggatgttaagacgttgggtgacttgtcacaagaagaattcgataaggatgcttacttggtcaacgacgataccttgatcaaacgtgctcgtcacgcggtcatcgaaaaccaacggacattacgtgctaagaaagccttgagcaacggtcaacttgaagaattcggtaagttagttaatgcgtcacacgtttccttacattatgactacgaagttacgggtaaagaattggatactttagctgaaacagcatggaagcaaccaggggtcttgggtgctcgtatgactggtgccggcttcggtggctgcgcaatcgccattgttaacaaggctaacgttgatgacttcattaagaatgtcggtgatgtttacaagaaagaaattggttatgaagccagcttctacgttgcaagcattggtgatggtcctaaggaaatcaaagcttaatagagtttaaaaaagcgcaaagcaatgttacttgcagagcgcttttatatcggaattaggttaaagagaaagtatggaggtaatcatttatgacagttgttgtattaggtggtgcgggctatatcggttcacacacagttgatcggttagttgaaaaagggtacgacgttgcggtgattgatagtttgatcacaggtcaccgggctgcggttaatcctaaagcacgtttttaccaaggtgatattcgcgaccgcgcctttttggatgaagtttttaacaaagaaactgatgtagaaggcattattcactttgcggccttttcaatcgtgccggaatcaatgagtaatccattgaagtactttgataacaatactggtggcatgatcaccttacttaaggcaatgaaggaccatgacattaagcgcatcatcttcagttcaacagctgcaacctatggtgaacctaagcagattccaattaaggaaactgatcctcagattcctacgaacccatatggtgaaagtaagttagccatggaaaagattattcactggtctgatgtggcatacggtattaagttcgtggctttgcgttacttcaacgttgcgggtgctaaagctgatggctcaatcggtgaagatcaccatccagaaacccacttgattccaattattttgcaggttgctgcgggtgaacgtactggtctgaagatttttggtaccgactatcctactaaagacgggactaacgtgcgtgactacgttcatgttgtggacttagcggatgcacatatcctggctttggaatacctgaaggccggcaatgacagtgatgcctttaaccttgggtcatcaactggtttctcaaacaaagaaattttggaagctgcccgtgaagcaactggtcagccaattcctgctgaagatgcaccaagacgtgccggtgatcctagcaccttgattgctgctagtgacaaggctcgtaaagtcttaggctggaagccacaatacgatgacgttaaggaaattattaagaccgcttggaactggaaacagacgcatccaaagggctacaacgaccgaggtgaagcctaaaatgtcaaaaactgttgatcaatttgttgatgccattcttgctagcggaacctatcaaccactagaccgcatttacgtgacaaaccgcgttcttggactagtcggtgatgacgatgccgttgaagctaaaagcgatgatttattggatgtcgttgatgccttgttggcaactgcagttaagaacggtaaaattgaagatggtcaatctgaccgcgatattctagaagctgaactcactgatttgctgaccccaacaccagctaaagtgaaccaagaattctggaatgaataccaaaagtcacccgaagatgcaacgaacttcttctataacttgagtcgtaaaaacgactacattaagacgagatcgattgctaagaacatcgtttttgatgcaccaacggattatggtgatcttgaaattaccattaacctgtcaaagcctgaaaaggatcccaaggcgattgctgctgctcgtaatcagaagagcaacacgtatccattaagtcagttagccattgaaaacgaaggttatcgtggccgtttgggttacccagcacggacgaatcaccgggttattcggttaacacttggtggtgaaccatggggcttccagtattcgccatacgcttactttagcgaacacgccattttcttgctgcaagaacaccgaccaatggtcattaaccagcatacttttggtaatttactggaaattgtccggttattcccacactactttgtaggtagtaacgctgatttaccaatcgttggtggctcgatgctggcacaagaccattatcaaggcggtcgtcacgacttcccaatgatgaaggcaccgctggaccgtaaaattaagttagccggttttgatgatgttgatgctggtattgttaactggccaatgtccacgattcgactttcaggtgaaacacctgaatcgttgatcaatgcagcaacagccatcgctaacagctggcagcattatgacgacgaatcagtcgatgttcgttcatatactgatggtgaacgtcaccacacggtaacaccaattgcttaccgtcgtggttctaagtttgttttagatatcgttttgcgggataatcagacctctgataagtacccagatggtattttccatccacatcaggatgttcagcacattaaaaaggaaaacattggtttgattgaagttatggggcgcgctattttaccagcacggcttaagactgaaatgcaagaagttaaacactatgtattaggcgaatcaaacgagatgaaggactatcacaaggcatgggctgatcaattgaaagcagaccataagtttactgctgacaatgctgacggcattattgatcagtcaatcggtgaagtctttgctcgggttctgcaagatgcaggtgtcttcaagtggaacgacaaaggccaagctgcttttgaccgtttcattgcacaaattaagtagcttattatacgaaagggggaagcatctatgaaagtgactttaaaagacatcgctcaaaaagcaggtgtttccctgtccactgtttctcgagtgctcaattatgatacgacgttatccgtcagtgatgatactcggcaacgcatctttgagattgcggaagaactgaactataccaagactaaacgagtctcgcaggtagctgatacctataaaatcgcagttgttcagtggtactccattaataaagagctggatgacctttactacatgacgattcgaatggaaattgaaaaacgcagtcaggaactgcatattcaaacaattccagtctttcaaaatcaggtttctgagatcagtaaggatgtcgatggcattattgcggtcggtaaatacagtgaagcacaggtcgatgaactcagtgcaatcagcgataatttagtcttcgttgactggagtgaaatggatcgtggttttgatagtattgtgactgagtttaagccagccgttctcaaagtgattgactatctgttgccaaaaaatcaagatatcggcatcatctatggttctgaatacacgacggatgggaaacttaagattcctgatccacgctttaaggccttcaagtcgatcatgactgaacgaaagttatttaatcctcagtttgcctttgaaggtaactacactaatcaagctggttatgatttgatgaagcaggccgtacgggacttaggtgatgatttaccgcacgccttcttcgttagcaatgaccctatggcaatcggtgccttgaaggcattgggtgaagataatatcaatgttcctgaacgcgttagtttgttcagcttcaatgacacttcagttgccaagtatgtttacccagagttaagcgcggtacacgtggcaacggatcaaatgggaatcagcgcagttgaattaatgaagagtcggctggagaatagccgagaagtaccgctaaaagtggttgttggcaccaagctgattattcgtaagagtactcggtaaacagaaattaaatcacacaagaaaccaaaaatctagcaaggcaatgagctgagctagatttttttgtccgcttaagagcgaattcgtgaaagttattgtaaacatttccaccccgtgttaaattaattatctcaataaaagcgcttattattacgatttgaataatatacatttgataaatttaaaaaataacgtgatttttttaaaaaagtaaacaatttttcttgaaatgaagtataatgaatgtgacataaagaacaaacaaatttaaacgagaacagttgttagatatcaggatcaactgaaaggagactatcattatgataaaaaaacaccgaaaagtattattagttggtgacggcgccgtgggttcatcttttgcattttcacttctacaaaactgtgggatcgatgaactggtgatcgttgaccttcaaaaagaacacgctgaaggtgatagccttgatttggaagacctgacacctatgatgatgccagcccggatcagaaccggtgaatattcagatgctgcggatgctgacatcgttgttttgaccgcaggtgttcctcgtaaaccaggcgaaactcgcttggatctggtcaataagaatactaagattttggaatcaatcgtcactccagttgtggaaagtggcttcaacggtgtgtttgttgtttcggctaacccagttgatattttaacggctttgactcagcacatctctgggttccctaagaaccgtgtcattggtactgggacttctttggacagtgcacggctgcaagttgcacttggcaaagaactggatgttagtaccagcgatgttgatgcctacgtgttaggtgagcatggtgacagttcgtttgctgcttataatgaagcgacggtgaacggtcagccactcttaagcctgcaaaacattgatcgtgaccgtttagctcagattgaaaaagacgttaagaaaaagggcggcgctatcattagccgtaaaggcgcaacgttctacggtgttgcagtcagcttgatgaagatttgccgggtaatcctattagatgagaacctggtaatgccaatctcagcaccagttaacggtcaatatggtctggaagatggctacatcggcacaccagctgtgattaatggtggcggtattcgtcaggttatcgaagtcagtctgacggatgaagaaactgaaaagatgcaagaatcagcacgtaagatgaacgaagtcttactcgccgctgaataaataagtgatagaataagattaatcgaacgagttgggtagcaattgctggcaactcgtttttgtttgaggtgaaaaaattggaatttacaacgagtgatcatgtacggcttagctatactgacgaaggtgatggcccagcggttttattgctgagcggtattgggagttaccgtgaaatttggctgccaacaaaacgatttttagttgatgcaggttaccgagtaattaatttagacgcgagaaatcaaggcgcctcccaacgaacgtttaagggtcggcggatgtcccgtcacgctatcgatatcaaagagttactggcacacttggatttaaatgatgtaattggaattggtaattctatgggagccagcacattgtttgcgtacgcttcgttatttggcagtcaccaattcagtgcgtttatcgatgttgatcagagccccaaaatgatcagtgatgacacgtggcaatacgggttcaaaaaccttacatgggaaaatttcccagaaatgttaaagttgccgtttggtcctgcgacagccacacgtgtatcggatgaagttcgaaccaatgtccgggctgccagacaggcacacccctatgatgtggaacaaaataacgcatttttagtggatcatgcctttcaagattggcgggatgttttactaggattgcagataccgttgctgatcgttgctggggcaaaatcaccctattttaatccgaagtttgcgtcagtggctgctgcactggcaccacgagggcaatcgcaagtgattaatagtgctggtcatattgtgatgacggagcagccggcgttatttaataaagcactgtcagcctttttgaagaaaatttgaaataatctgttggtttcataactcaataaccatgtacaaaataagcggtatcccagtgctttcgggataccgcttattttatacatggttatttattgaatttacgatctacccatctcgagtaaaactctgttagcaacagattcattggttacaaagtccgtcagtaggccaccacgtaaagcaccaagtagagcacgtcccttgaacttacttttcacgatggcgatacgatgaggaacagtgaggatagcatctaaggaagcaccaaacagtttatcgtgtcctctgtttaaaatatggccattaatatcgtatggccgaccatacagcatgccagcaacgtcgtctggttcgatttcacccagaatttcgtcacgatgattttgccatagaggaatggaatcgaccgatgccagagtaccaaccccagcgaatagcaggtccatcttagccatggtagtgaacgccgaaactaatgctggttcttgttgtaaagcgttacgagtcgcatcattaatgatataaaggggtgccggaatggttctaaagctggcaccgaatttagtcgctgctttttgaactagcggcgtggcaccaagggtagagttgtattttaaattgtcgcccataaactgcgtgaagacgagatcatctaaaatttcggactggaagtggttgatcacgttagcaaccgtaccgccccagccaacaccgatcactgaactgcggtggagcatatcctgaatttcttcggccgcaaactccaccacgttttcatagtcttcattagtattgtccgcatcttttagaataaaggcattttgcagaccaaactgctttttaaaccgggcctccatttccatattgcggtcaatgggtgcgttaatggtgattttaacaaggccgttgttcaaggcatcatctaagtcttttgtaattaaataacggctaaggttatatttttttgagatttgcgaaattgtcaatttagataggtaataatcgcgtgcaatattggcgagttgctcgcgggatttcatgttgtccaaaaagtttcctcctaaaagtttcagtagccgtatcgatagcagaaccatcatacaagttttcgtaagtggttatcaattagatgtgaatctagtttcattaattaacttccctaccatcatatcatgttagaacaaaaatgttcgtatttttaaacacttttatcagaacaaaaattcttattttaaaaatgtaaaaaatatgatttatatttgaaaaagttaaaaaggcggagtaaactataagagtagaagaacttaataattaaatcacaagtgattgtttgaaaggaatggtgcgattgacagataatagtgagattttaaaagtgcatgagagtcacacaggtgtattggacattcaatctgatctaggtgtacataataagaccgatttgggcaaggcgtatactcccggagtagcggtgctctctaagttgattgccaaacatccggaacttaaaaataagtatacggttagcggtaagttggtcgctttgattacggatggttccgccgttttaggcctcggcaatattggtccagctggcggtttacccgtgattgaaggtaaagctttgctatataaggacttggctggcattaacgccattccaattgcggttaaccaagtgtcaactgacgaaatcgttaagacgattcaaaatatgtcgcagtcgtttgcgggtattcatttggaagatattgcggcaccgaagtgttttgaaattgaggaagcactgagtcaatcgttaaacattccagtttatcacgatgatcaagaaggaactgcaatcgttgttttagcaggcttaattaacgccgctaaagtcgtaggtaagcaattgtcagatttgcgcgtggtgattaatggcgtcggcgcttccggcttagccaccgctaaattactttacgcagcaggaatcaaacaactgactttagtcgatatttatggtgtggttaccgcaaatgatatgagatataatcagtaccaacgtgattttgcagctcaagttgaggctagtgatgctcaaaagggacttaaattgagcgatgttatggatggtcaggatgccttcatcggtctttctgatcagcatctgttatccggtgatgatgttcagcggatggctgctgacccaatcgtctttgcgttagcaaacccgattcccgaaattgaaccagaagttgctgctcaagctggtgctaaggtcattgcaaccggctcaagccaacatcctaaccaggtcaataatattttgtccttcccaggcttatttaaaggtttgctggccagtgggataaagcacgttgacgccaagctacaattagttgttgccaaggctttagcgagtgttgttgaaacaccaacggctgaggaagtggttccaggtgtgttcaataccaaggtggttgaaacagtcagccaagcggttatagattatgccgatgaccaaaagaaagaattgatgacggaggtctgacatggacaatcaaattgtcgatctgtatcttagcaaccctaaagtgaaaagggattgggaagattttttaacgagtctgaagattaccaatttctctgccaatgaggttgaccaaatcgactatacgattggtatttacagcggtgatgacttggtagcaacgggttccgttgccggtaatgtgctgaagtacattggcgtctgcaataagggtgtgactactggttcccggttcaacgcgattgtttccgagttagttaatcgccaatttgcgaaccatatctatcatctatttgtgtttacgaaactgaagtatagtgacagtttccaacatattggctttagtgaactggcacattcagatgaagccgcgtttttagaaaccggtagtccggatgtgaatgactttttgaccgatattccccgggtcgatgatcaaagtgataaacaagttgctggcatcgtcatgaacgctaatccgtttactcgcgggcatcgttatctagtcgagcaggcggctagtgaaaacgatttggtgtatgttttcgtcgttaatacggatgcttcgttgtttacgactgaggaacggttccagttagtaaaggacggcacagtcgaccttgataacgtcatcgtagttaacggtggcgactacatggtcagttacgcgacgttcccagcttatttcttggcatcacctgatcaggctgtgacgtatcagacaacattggatgcacgcatcttccgtaatgtcattgccccagcgttgaatattacgacacgctacgttgggtccgaaccactatctcgcaccactagtatttataacgatgtgctgacacgagaattgccgtctgcagttgaggtgaaggtgattgatcgtgatcagacactaacaagtgatcatcaagtgatcactgcaacgcaagttagacagttcatcaaaaagggtgagatcagcagtttaacggcttttgtgccggaaacgactgctcaattcatccaaaatcatttaacaaccctacaaaaacggattcaggaaggaatgaacattgatggaaattaaagaaacagccgttgctggtactttggaatcatcagatattcagattatgatctctaaagctaccgacgggattcagattgatttgcagtccgacgttgaaaaacagttcggcgaccaaattcgtcaggtaattaccaagacgttaaacgatttagacattacagccgcaaaggttaaagcagtggataagggtgcgcttgattgtgtcatcaaagcccggacgattgcggcagcccaacgtgctagccagaccactgatcaaccagcatgggaggtactctaaaatggctgaaaatgaagaacgtttacgtcgaacaatgatgtttgttcctggtaataacccagcaatggtgaaggatgccggtatctatggtgccgactccatcatgtttgacctggaagattccgtttcactgtcagaaaaagacgctgctcgtgttttagtatacgaagcacttcaaacgcaagactacggtaatgctgaattggttgtccgagtcaacggtcaagacactgaattctatgctaatgatgttaaagccatggttaaggccggcatcgatgtgattcgtttgccaaaagctgaatcagctgacatggtcaaacaacttgagactgatatcttagctgccgaaaaagaatttggcagagaagagggttcaactcatctcatggctgccattgaaagtgctaagggtgtcttaaacgcacctcaaatcgccgcggcctctgaccggatgattgggattgctttatcagccgaagattacaccactgatatgaagactcaccgttacccagatggtgctgaactcgaatttgcccgtaacatggtacttcacgctgctcgtgcagctggtgtggcagcctttgataccgtctttaccaacatggacgacactgaaggtttctaccgtgaaacggaatacattcaccagctcggtttcgacggcaagtcactggttaaccctcgtcaaattgaaatggttaacaaggtctacgaaccaactgaaaaagaagtattgaacgctaagaacgtgatcaacgccattgaagaggcccgccttaagggttcaggcgtgatttcaatgaacggtcaaatggttgaccgcccagttgttttacgtgcgcaacgtgtcatgcggctcgcaaaagcgtctaacctagttaatgaggagggtaattacattgaaaaatagtgttaatcgcgacttaccagaagatgtcatgaaagacttaaactacaaaccatttgaatccactgaaattggtcatcccgagattcagcgggttgcccctaaagttcacgtttcaaccggtgacgacaaggtagttacctcaatcaagcaagtaatcaaagataccttaaaagatggtatgaccatttcgttccatcaccacttccgaaacggtgattttgtgtttaatatggtgatgcgcgaaatcatcgatgcgggctacaaggacttaaccttagcgccatcgtctttgactggcgtcatgaatgatttagtgatcgaagctattaaggctggtaccattacgcacattactagttcagggatgcgtggttcattgggcgatttcgtctcacatggtggtttaaagagcccagttatcttccgttcacatggtaaccgtgctcgtgcaatcgaacacggcgacattaagatcgatgttgcattcttgggtgtgcctaacgcggatgcgcttggtaatgccaatggtatggaaggtgacgctgtctttggttcattgggttatgccttaatggatgcccaatatgctgacaaggttgttttactgactgacaacatcgttagttatccaaacacgccagcttcaatcaagcagactcaagtggactacgtggttaaagttgataaggtaggggatcctgacaagattggttcaggcgccactcgtttcactaaagaccctaaagaactgaagattgcatcaacggtgaacgatgtcattgtgaactcgccttacttcaaggatggcttctcattccaaactggttccggtggtgcggccttagctgttacccgttacctgcgtcaggctatgattgataataagattaaagcttccttcgcattaggtgggattacgaagccaacgactgatttgttaaaagaaggcttagtcgacaaggtcatggatgttcaagactttgacaagggtgctgccgaatcaatgcacaccagtgccaaccaacaagaaattgatgcttcatggtacgctgatcctgataacaaaggcgccatggttgatcaattagacgttgtgatcttaagtgccttggaaattgacactaagttcaatgttaacgttatgtcaggttctgacggtgtcattcgtggcgctattggtggtcatcaagatgctgcaacggccaagttgactattatttccgcaccgttagttcgtggtcgtattgcaaccgttgtgccagatgttactactgttgttactccaggtgactcagttgatgttctggtaaccgaatacgggattgctattaaccctaagcgaaaggaccttcaagaagctctcggtaacttgccaggtgtgccagtttacaagattgaagacctccaaaagctggctgaacaaaaagtgggcaaaccaaagccacttgaattcaccgaccggaccgttgccatgattgaataccgtgatggctcaatcatcgataccattaaagaagttaaagactaaattagagaatcgttattccctgaaaggactgagttgatgaccgccatttttcaaactggtcagccgcaagaaatcactgatgtgcttgataaccgtgatgcgcgagtagcactgcagcagcaattactgacacgctatccaaccgatacgctgattgccattaaactgaatattcctgggccaattaagaacaaccagcagattaaacagttgtttacagctggtatgcaacgtttttatgacgagttaaaggcacagactcggcactttcaaactgttacgcagtgggataaaccaactggcaatgaacttttcattaccgttgaattagatccaacagctgtgaaacagttagctgtgaattttgaagaccgcgatcatcttggtcggctattcgacgttgatgtgctgcacgctggccgtgagcgggcactgtcccgttctgactttgatttgccagtacgtaaatgtctgatttgtaatcgagaagcgaaggattgcgcgcgttccagacgtcattcggtagcggaactacaagcccgaatcagtgagatttatactgctgaattcgcatctgcgggaggacgttagacatgactgcaactgaaaaagatgcgttagttggcgatgcattacgcgcactgctatacgaagttagcgtcaatccaaagcctggtttagtcgacccggtgtctagcggtcctcatcttgacatggacgtcttcacctttattgatagttccatgagtctgagacagtatttcagccgttgcgttgagcagggtaccacgtttcagggtgatgatctcagagcgttgttcttagcgattcgtccggctggtgttgaggccgaaaaagatatgtttgaggcgactaagggtgttaatacgcataagggtgccatcttttccctgggaattttggtgacagcagatgcctatcatgctgaccatagtgacctgtcgatacagaagattgttcagctaatgttgaaggatctaaccgtcaacgattttaaagggttagcggataaggcacctgaaacattaaccgctggggaaaaagagtatttaacctatggcattaaaggtattcgtggtgaagccgaagcaggttttccaacggtgatgaacattgctttaccagctttacgtcagcatcagggaactaagaatcagcggttacttgataccttgatgaccatcgtgggtaatagtgtagatactaatctagtaaaacgcgctaaaaccaacgacatcgttgcctgggctcgtttacagtcagaacggtacttcgctttaggcggcagtcgaacagtccaaggaatggcatttcttgacgaattaaacgagatttttaccgcacgtaacctcagtttgggtggatcagcggatttgctgatcttaacgatttttatggggctgcgtgagggcgttatttagagcttaaaactaaatagtaaaaagcggataccttttttggggtatccgcttttgctatctattaattagtagcgagcttagctagttcgtcgattttatcaaagaaggcctcagcgtgaacgttggtgacgaaggtaatgtcacgtccgttttcagtgatgaaggtccggccttcagaaggtgcgtggtcgatcacatcacttttaacggcgattgaatcaactaaatcgggatagttactgattagagtcgttaaaacgtcccaaaggtagtaagtcgaattagcttcaaaggaatggacgagtgaatatccctgaccaattaaatcaagagctggatactgccgttgtttggcccagcgcgttcttaattctttagtcaatgggacttggtccgtactatccaagcccaccatggtaatctttaacggtgagtcccagacttttttaaccgcttgtgcgtcccagtaggcgttccattcaaccgtgcccgtcttgtccaggttctgcaacgtttccttggctgttcatggcaccgcccatccagaatagctgctcaatgttgtcagagattgttgggtcagtggccaacgcacgggctaagtcagttaacggtcctgtcatcacaagggtaacaggtgtatcggattgtttgatggcatcgaccatgtccagatgagctggttttgttgccaacggtgttttgggttcaccatgttcgtttagaatggggaagtcgtcgaatgaaaacgcgcttaaccgccattctttaggaaactgatgtgctggtcgtgaattcgatttagccacggcagctggtttacgaccctcatgaccaaaccggtcaatgattttccgggaagcagaagatgcaggatcgacatagccgtcagcatcgataacaccgacaccaataagattaacatcgggcatttgaagcagcagtaaaagtgaaaccagatcgtcgacgttaccatcgtgatcgaaatagacattatgcatgagaaaaggacctccagttatttttagccaaaattagtgataaccgtactgtggttctacgcgtcgatataacctaaacgtgttcaatcaggcaaagagctgcatgtaagcagataacgctaatcatccaaacccaggatgtttagcattatctacttacactccgctctctaaaagcctgttttcacactctaccagattttcacacgatccttcggtgccttatacatcttatcgcccggttgaacgttgaaagtgctaaagaaatcatcgaggttttgaacttgaacgttggcccgcagtttggctggcgcatgaacgtcaatggacagtaatagttgttcgcgttccggagtagccttttggcgccaaattttggcccagttgaggaagaaggcgttcagatccacgtctggttcacctttagctgcttccaacgcacagctaaggccgccaccatcagcaatgttttcagaaacggtcagcttaccatttactttttgaccggcgtaaggcagaccatcgaattccttcaccatgttttctgctaattcatggaaatgctcattgtcctctttcgtccaccagttgtttaggctaccgttttcgtcaaacaacgaaccgttattatcgaaggcatgagaaatttcgtgggcaattacggcaccgataccgccaaagttttcactggaagactgtttcaagctgtagaacggtgcttgcaggatcgctgctgggaacacaatgatgttgtagaaggggtggaagtaggcgttcacggttgaagcactcatttcccaacggcttctgtcgacgggttgattccaacgggcaaaatcgtcttcgttacggatgcgggtgaatgccattaagtttgacagtacactaccgccttcactcgcggtagtgaccttgaatttactgtagagtgggtcgatcttgtctggatagccgacttggatgcctaatttatcgagcttcaaaattgctttttcacgggttgctttaccaagccaagtattgttagccaggcgtttcttataaacgttgaccattttgacaaccatgtcatggacgtcttgcttagcagcttcgccaaagtatttacggccatagtagtcaccaacgacttgatcaaaagtgccggtagctaaatcataagcggctttttcttgactacgagcttctttacggccactcatcgcacgaccatagatggtgctggtttgacgctgctcgtcggttagatagctggataagcccattaccgtcttaaacaggagccagctcttcatcatctggaagtgatcatcggtcagtagatcacccaaggcatcgaagaaggccggttccgttgcgataattttttcaggtgtgccatgaaccagagtcgtgatagcggttctcagatccaatttatcagtgctatcggcaatctggtcaagtgttcgtggattgtacattttgctgtaatcagcaccttcttcggctgatttaacgtgaggtgcaatcagtttatcaaaggcggttgcctgttcaatgatagttttagcttttgatgtatcgtacccagcttgttcgaataactgagtcatcatcttctccagaactggcattaactgtttagccgcctgattgtccttttcataataggtcttatcgggcaagaataagcgtggcccgctagcaaacagtgcatacttagtggaatccttcatatctgaatcaatatccagtgagaacggtgttggcagaccggctaaaatccagtcagccagctggtcactaagatcttgataattgttaagggcttcgatgcggtcaaggtagggctttaatggtgcactgccgtctttttcccgcttatcaaagtcactaacaagttcatagaatttcttaaattcattcatttcatcgttttcaggtgttaatttacccgctaataaatccttaaagtcggccattaacgttttttcaatcccatccgagaggtcggtaaacccacctgtagttgagtggtcacccgggatggtggctgttttaagccattcgccgtttacagcgtcgtataaatcagtttttattaaatcttgatcaattttatctgccatttgataacctccatctgattagtagactgttcttattatactgctaccccagtggctttgatacaagattgattacaaaaagccggtctcaaagttgtcaataaacttcgagacccgccagattttgtaattatcactcagtcgtatttagctgaatgatgagactattcaattaaatgtaatagcgactaataccagcttagactgttaacgaatcgttggccagtcttcataacgttaaactcgtactaaattttccaccaatttttttcaattacggtaacgttgtttaagtcttctagttcgaaccgttcaatatcgccatcatgggtcaggtaaaaaacaccgtcacttggggaagtatttaccattcccgtgacagctttagattggcttaacgtcaacttgatcacccaattatggtgataggcttttgtaatagtagatgataaatccttggttgtttcttgcattgatatccccccgatttaaaaactcaagcttcattatagggagccaaaatatagaattcaatcttgacattttgagcaggtcaagcgacgtactgttgcgtggcgatttaccaaagaaaaaattttttgaaccttttttcatgaaagcaagggtgaaaatgctcacattattttggtacatattttaacgttagcgctttcaaatgtggtagcatgaaagtagaaaagaagcggaggtgtcattcatgtttgagaaaattttagttccaattgatggcagtgagaatgcttatcgggcgcttgatgctgcggttgatattgcgaaacactatgggtcaaagatcacggttgtcgcgattgccaacgatcaaagttacactcaatatggggcaatttttggcgacgacattatggcacacatgaaggaacaggctgaagaatcattgcaggcagctaaggcgcgtgctaaggatgctggcgtggatgtagaaacggattttgaggttggcattccaaagcaggccatttcggagaccttgccagatttactggatactactttgaccgtcattggtaaatcgggtgttcacggtttgaaccgagccattatgggatcaactaccgggtatgtggttcgtcggtcaatcacgccagttctggttgttggtgagtagcataaacgcgtaaaatttaagcttagaaagcatgcatttcgactgatatttagtcgggaggcatgcttttttgaaacaaataaacgacaagtgttttttccataaaattaatgagactcatggtaaacttacggtaatttcagtacgtgggggtgtgtaagccatgttgcacacgttattaaaatcggtacgtgaataccggcttcaaacgattgtttcaccattgctcgtagtgtcagaatcggccattgagacgtttattccctttttgatggctgcaattattgatcaggggattcgtcctggtaatttatcggtcgtgattaaggttggcgtattacttttactgatgtcggtggtttcactgacgtttggtgccggtgccagttgggtttctagtcaagcggcagctggctttgccaagaatttacggcacgatattttcagtcagattcaaaccttttcctttcaaaatttggaccattttgccacttcaagcttagtgacccggctgaccaccgatatcactaacattcaaacggcgtatcaaatgctgattcgagtggcggttcgagccccgtccatgctgttgttttcaatcatcatggcgtttttagtcagtcggcaggcgggctggttatttgtttgcgttgttccggtgctggcaatcgggttgttctggatcgttaaaaaatcccgaccgctttttaggcaagtttttcgtcaatacgataaattaaaccgggtagttagagaaaatttgcgtggcattcgggtggtgaaaacatacggtcagaaaggtgctgaaatctctaaatttcgtcagtcagcaaaggaaatcgctgaggttttcgccaaagcacagcgaatcgttgccttgaacatgccgctgatgcagtttgtgatcagtacgaccatgctgattttatcctggctgggtgctaagttgattgtcggtaaagctctggaaatcggccaattcgtcagtttgttcacgtacagcatttcaattttatacagtttaaacatgctggctatgattttttcacagttgtcggtttcacaggcatctgcggaacgtgcggtagaggtgctagaaacggcaccagacattgtggcggtgcctgatgctgagactgaagtaccggatggcagtatcgattttgaacacgtgacgttcagttatccgggtacggatgataatcagttaaatgacgttaacctacacattaacagtggtgctgtagtcggcattattggcgaaacggggacgtctaaaacgaccttggtgtcactgattccacgattgtacgatgtttctagcggtgtcgtccgcgtcggtgggaaaaacgtgcggcaatacgccttgaaaactttacgggaccaagttgcgatggtgctgcaaaacaccattttattttcgggtacggttcgcgaaaatttaaagtggggtaatccggatgccacggatgaacagcttgatcaggtacttcagcaggcccaagctaaggattttgtggcgcatttaccagcgggtttggatactcaaattgagcagactggtcaaaatgtttcgggtgggcagcggcagcgactgaccatcgcgcgagcactattgaagcaacctaaaattttgattctggataatgccactagcgctactgatacgcagactgaagcgcggatccgccaagcgtttaaacaagacttgcctaacgtcaccaagctgatgatcactcagcgaatcggcagcattattgatgctgatcaaattattattatgaaacgcggtggtatcgaagccattgggacccatgacgaattaatggtttctaatcaatggtaccggcaactttaccaggcacagcagaagacgggaggcaacggccatgaataagcgacgtgaggtcttctggcgccttttgagactgttggtgagtgattataagggttggctgagtatcagcctaatagccattattttaagcgctttatcaggagtggctggttcgttgttcattcaacgattaatcgatcactatattatgccgttgacccgagccgctaatccggattttaaaccgctactggttgcaatcggtgtgatggcggctattttttacgttggggtgattgctaccgtgatttactcacaaatcatggcggtgattggtcaacgcattcaagagtcgattcgggatcagatgtttgaaaaaatgcaggtgctaccgctgcgttactttgatcaaaacgactacggtaacgttatgagtcgttacacaaacgacgtggataccttgatgcagctgattacgcaaagttttccgcagtttgtggtggccttgtttaacgtgacttttgcactagcagccatgttgctgttgagtccggtactgactctagtttcactggtgatttttgcgaccagtattatgatcgtgcgctggctgactcatcgcagtgccaaatattttcgagctcagcaggcttctctaggtaagttggacgcctttgttgaagaaatgctgaacggtgaacgggtgattaaagtgttctcccacgaaaaacaggtgcaagcagagttcgaaacgtataatgacgccctacgaaatgatgcgaggtatgccaacggttttgccaccatgctctttcccataatgggcaatatgggaaatttgctgtacgtgttaattgcggtgctgggtggtggcttagccattatgcacccaacgctgatcactttagggactatcgccgcgtttttgcagcttagtcgttctttcagtcagccgattgcccaaatttcacagcaattaaattcaattattcaggcgatggcgggtgcaggacgaatttttcaactattagatgaggtaccggaggatgaccaaggaaccaccacgttaatcaaacagggtgaaagctggttttggcagccagcagatacttcacagccacgggtgccggtgaagggaaacatcaaattttcccacgtgaattttacgtatccgcagtctagcgctgggttgcacgatttaagttttgaagcacaagcaggcgccaaaatagccctagttggcgaaactggggctggaaagacgacgactaccaatatgctcaatcgattctacgatattgatagtggtcagattatgtatgatggtgtggatatctcaactattagaaaggccgatctacgccgggcattggccattgtgttacaggatacgcatttgtttacgggcactatcagggataatattcgttatggtatcccggatgctgacgatttggcagtgattgctgcggcccagttggcgcgggcagatgtttttattaaggagctgccagctggttacgacacggagattaccggtgatggtgaggaattgtcgtctgggcaacgtcaaatgctggctattgcccgcgctgcaatcgtggatccaccggtaatgatcttagatgaagcaacttccaatattgatacccgaacggagcgtttggttcaggctggcatggataacctgatggctcaccggacaacttttgtgattgctcatcggctatctacggtctttaatgcagatttgattttggtgatcgacaacggtcgaatcattgagcggggcactcacgaggaattactgcagcatcatgggcgatactacgaactctatcagggattagcatagatagaaaaaaggtctcatttaagtgaccatgcatagtcgcttaaatgagaccttttttacttgcaatgcttgcgattaacaagaattacttcttgttttcgctcttaagccattgttgcaagtttgaaatttctttttggcgcttggcgtccttcttttggttcactggacgacggccttgtacgccatgtggatgtgcttttctcatgtgtctaaccctcacttcttgaatatggtgtaatcaatcactcgaccattctaccctatatacccactcaattgcaagaatagttgttgaaaaaagtaaaaactaacggttagtttaaatctgttagtgctatgaatcccacaacggcccgtatgatatgatggtttatgacaaggtggtagtgaaatgataattggagcaaagcagacgcattctttatggcaacgctggtggccatacttggtggttatcttaggtgcattactggtatttggtgtggctcatgacgaccaactgtaccaaacacccattttaaaaattcaatccgttaagcaaatcagttcagacaaacagtccgaccagtttaacaacgaggatcgccaagttgaacaggaattagatggtgtgattaccaacggaaacgataaagggaaaaaactaaaaattgagaatacttatttgaagtcgcaagcaacgacgctggggtatcatcgcggtcaaaaggtatttctgaccgtgcaccataatcggaatcgcatatcagcaaccattagtaaccttaaacgggatacggctttagcttttacagtttggctaacggttagtcttctcctagttttgatgcggtttagcggtttaatggcactaaccagtgtgattgttaacggtgttttattctggctagcagttagctggaacacccatactcaaggtggaatcgttctcgctatttttggtggtctagccatcgtttttgcggcattaacactattgatcgtgattggctttaaccggcaaatgttaatgacgttactggcaacgatcggtggtactgcgattgcaatcattgtggcactggctgtgtttgcgctgacccatgaacgtggcgtgtattatgaatcaatgcagtatgtgacccaattgccgcgaccgctgttcctagccgaaacgattttgggttccttgggagcggttatggatgaatcaacggatattatcgcctcgttgatggcattaaaaacggagaaaccagatatttcagcgaaacagatatttaagtctggcagacaaatcggcggcgagatcatgggaccgttagtgaacgtgctgttctttatcttcgtggccgagaccttaccactggctttgctatttttgaaaaacgccaactcgtggggatatacctttaatatgactatgtcgcttggggtggttcaaagcctcattagcgggattggtatcgtattgacgattcctcttgcctgtggcattacaagtctaatgattggaggtcataagtcatggggacgattacagcactaggtttacttttactcatttgcatggttgctgtgggtggtactcagggattgcaggcttggatcagcttactctttaactttggcgcgctgttctttgctatggtactgatggccttccacttttcgcccgttttagtcacgttagtaacggggattatcgtgttggcaatgactattttccttggtggcaatgattccaacagtactatggtagctttctatgcttccgtggcggttttgatcctgctggtcattttaattattcccattgaacattgggcacagattcagggatttggacaagaagatagcgaagacttggaagggatgtccacgattttaggaatcagctatctaaacgtggccatctctacggcaatcttgagtacgttaggtgccattgccgaagcagccattgcgattgctgccggattagccgaaatactggaacagcacccgaaaattaccttaaaaaatttgcaggccgccggtttcaaggtggggtctcaaatcattgggacgacgtttaataccttgttcttcgggttctttggcggttttttggcactgtttatctggtttgcaggtgttcattattccctaggtgaaattttgaatgataaaattctggttggtgaagtgctgatggtcctgttttcaatgatgtcagtgattgccacgattccgttaaccacttgggcgatggtggctagtgagcggcaggctagaaagaaagtgtgaaataactcggtagatttcagaatttaacacaaacaaggcacagccaacagaaatccccaaaaccgggatttccattggctgtgccttattcttcactctctaaacgcttgttttcacactctatttatctaaatcaacggcatcggagtatacccagtactgtttagcgttcttagcagtgctgaaagtgagacggtaccaagttgtacctgctttatccttcacacccttatcgttaatgtagacttttttgcctgtagcagcctgtacggaagaccagctgtacttagaagtgttagcgtatgcgttcttaacgtgattgtacaaacggtagttagcatattgacttgaaagcttaccagttgtcgtcaatttactgtaggtaactttatccagtggggttgcagaagctgaactgcttggtgttgaagcagacccaccaaaatcactgtagtagtatgaatgaactaactgatagaaggcggccatgttgtagctttgaccaaagtacttcttaccagtggttgagtaataaccaactggatcagtatggtcagaaccaccaaggtgtttagcaactgaaccgtgagaccaaactgttccgttaccatcataggcggcgtcatttggctttaagccatattggtgaagcagataggctgtataccaagcagcgttggaaacttcgtgggcaaaggcgctcttactgtgaacttcgacttgttcgaattgaacaaaccgagcgttaccagggaagccaacgccccaagcaaggtagttcgtattagcaatgttaatgatgtgcgaagcatcaacgaaagaatgaacgaaagcgttgttgtaatgtgccttcatataagcaatttcgttgtaaatggtggaatttgggttagccgtttcgtgtacgactacaccctctggcttaccaacaccatgccggtaagcattcttagggaaaccaccccaaagagttttggtcactttagcaggtttaattttttgacttgaaatataatcatttacggctgaactggcagcgtgagcagtggttgtactggcagcacccactgtgaataacgttagtagtccagtaagtaataatgaaaactttgaaaattttttcacatttatcatctctctataaacaaattttatttttaatgaacggtcgattcattctctgaaatcatactaccgagaaaaaggatgattgacaagttgtcaacggccactaaacctgtaatattacaggcatagacgttgtcttggtaggctaaactgagcttgttttcattcatgttaaaaacaggtaacaaaacgcttaagccattaattttagatttcaatcaagtatctaaaaaaaccggctcaactttgaagttaaagttaacccggttttgcgtttaaagttaggcgttatttacgaagcacgtgtaatgccttttgcttggcattcggggcagagaccataaagttcgatgtggcaggcgttgaaatcatacccagactgcttttgagccgtattttccagcatactagcaatttgtggcaaattgggatcataaatatcagtgaccttaccgcaattttcacaaatagcgtgatagtgcggccggccaaagaagtcgtaccggacaccgccgttttcgttaggaatctcaatgacaattcccagttcaacaaaaaggttcagtgtattatatacggtagccagactaagcgaagacatttgcggtgccaattccttgtagatttcttctacgggcgggtgattttcatgattcatcaggtagtctagaattaatttacgctgaggggtaatccgaacgtgctgttcacgaagcttagcaagcgcagtactaagggttgcatcgggttctttcatgattatagtctcctttcacattagagtaattattagttacccttattaaaacacttttcttagaaagattccagaaagcctcattttaatttaactgacaactgagaactctgaagctgattcttagaaaattcggtcatataggttttgatttcatcaatgagtgtttgatcgttgccgttcactctggtaattgtgagctcagtcgtttcaaaggtgccattcaccggagccaaggtaacgattccaaggaagccatcggtttgtttgtcgccgacaccccaggtcaaggcctgatcattcatgacggtgctcatttcacggttgatatagttagctgtttcaatcatggactcgttgggattaatcgtttggcgtaaagcattgatatccttcactttaaaattggtcagccaatttaactggtaatgcggcgttaatatagggtggtaaagttcaaattttgccatggaaatacttcctttttgtgagtgaatgtctatgagtgtaacataaaatgtgtttgattcgaagtatttcagtcaagtaaaaatcatcacaaacaaatcattcaccttttaaggtcggactagacctgtgctataattgacacgttgaaataaaattagcatagtggaggattgaacatgatcgaaacatttttaatcggtacctatacgcataagagcagtgaaggtgtttacgaactgcaattagacacggaaaagaaacagttacaaaaccttgaattagttggccgcgctggcaatccaacctacgttgccgaatcaaaggcacataaggtttacgctattgacgcggaatcagaagacggtaagaagattggtggtttgaaggtctttgatgctgccgaaaagccgtttaaagaactggataaaaacctgattgctggtcctaatccagcttatgttgctgttgatgaagaccgccaattggttttcaccgctaattatcataccggcgtcgttatcgtctacaagatcaatgcagacggtactttgactacggcggacaccactcagcatactggtgccgttggtcctgctccagaacagcaagatggcccgcacccacactttgctgatttaacaccggataaacggttagtttcctgtgaccttggtgaagacgtggtctacctttatgatttaagtgatgacggcaaattaactgaaaagtctcagttcaagtgtgctgctggttttggcccacggcacattattttcaacactgacaagaacgtggcttacttagttggtgaacttggcagtggcgtagatgttttagactacgatgccaaggcaggcaagtttactttacgagaagaattaaagaccattccacgcgattggactaagcataacggtgccgctgcaattcgcctgtctagcgacaacaaatttgtttacgtttctaaccgtgggtacaactccattgcgactttcaaagttgaagataacggtgaactaacgatgattgatcaaattccttcagaaggtgactttccccgtgattttaactttaacgctgacgaaagtttcattatcttagttaaccaaaacactgataacgcaacgttgtacagccgtgatgctgatactggtaaattaaccttggttcaaaaagattttaaggtaccagaaggcgtttgtgtcgcacccgttaaataagtaaaacaaagtgcgtaaataagatttatctaagcactctcatttttaaaagcccgtgtctatcacctttaggacacgggttttttggttggattagaacttgctaaaagctgctacaaacgcttataaaacggtattggaagcgttacaatgtccttggttagataatcaactatcaggataggagtgagttagacatgatgaatcgaattaatcttcagttggtggctatgggacgagaggtaacatgggggcgagtcttgttattgacgctgaaccttgtcaccttcatcagtctgattctggggacttcggaatttttatttgcctttctattatttgccagcttagttctttttagtggccactttatcgtttttgatacgactaaacaggcacggggattacaggaacttgacttgtggttaattggtttaacgttagctgcagggtatctgaaattagtctttggaatttaaacaatcgacatcgaattaaacagtcgtttcacagtgaaatggatcaattctcaacgtgggattggttcatttttacttttattataggtggtagaaaacgtaacaaaaataccactggtagcttaggaatgttaaaatacaggaagtgaagaaagaggagaatagtgtaatgaagcgacatgcagctccaaggaaatcaatactgaaacggcctattttctgggtgattctcgttgtgatcgtgttgattggtggtttcgcggttgggcataaaccgattgccaacttgttcagtcaaccaacgactactaaacctaagccaaaaccgaaaccgattaaattaacggcctcagagaaaaaggtggcccagaagtatcatttaagtcccaaagcaacggccaaggcgcatactgttaaggttacagcaattggtgactcggtcatggtcgatattgtgccagaaatgaagcaggtttttcccaatgcccaagttgatggcgctgtgggacggcaattctatgagttaccgacgattgctcagaatttaaagaacgaacataaattggccaacaccattgtggttaatctggggactaatgggccaccaaagaaagctgatatttcgcgttttcttaaagtggttggcaataaacggcaggtctactggatcaatactcacgtgccaacgcaaaagtggcaggatcaaaccaacgagatgattgcgtcaatcgctaacagtattcctaatgtacacatggtagattggcatggtctcagtaaggatcaaccgacctggtttgcgggtgacgatgtgcatttacaaacgaagggggccatcgcgtacgtggggttattggcgaaaacgatgggaaagtaggagagtgtgaaaacaagcggttaaagagtggagtataagggggaccaagcgtaaatgccctgaactttgggcatttacgcttggtcccccttatatgcaactctttgcttgtttgaacacgtttatgggagcgaagagcaaggcaaaaatcccgcacttggatttatgtcttgcctgccttacatgcagctctctgcttgtttgaacacgtttaggagagcggattgtaacaccaaaaaacgtcattccattatggatggcgtttttgtattggttgctaaattaatccaacgccaaatacctttccatgatttccaaatgatgttcaatcgtcagcgccttcagcacacccataccagggaagtggtgctcctcagacaacgccactaatttagcagtagcagctgtctgatttttggttggttggcttttgatccattgaactgccttggccaaagcttcgaagtatttttcccgttgatgtttaaaatcatcgtgctggtcagaaacaaagtgacggatgcgtacctgatgattagcaaggtaaattaaatgaagtgtgactgtgcgactagggtgaccacgttcaaagtaggtagcgccttgagtcagataatcgctaaagccgatttcatggtattggtgggcaaactcgatatcgttagaccagaagctgtctggcatcgttgaaaattcaaaactgtgttccggcacagcgtaatgatcgaataagtgaccgaaacggcggccagcaagtagttgacggatacgggcttcaggcggagtcaagagcgtggcggaattgggtaaccagtcgtgatcgagaaatagttttaaatcggcgtagtgctgaacgatcactaggctgttatctaaaaggttgggtggtaacagcggcgttaaaacgtaagcccgttgaataccaggctgttcaaacaagtcatcgatgggataacgtttggcggcctgataatcatagtgatccacttggggattctggataacagctaatcggtggtgatgctggccaaacgctttgattgttttcggcaaagctggtgaatcacgcaccggttcaataatgggcacaatgtttgcgatgtggtcacactcagcaaattcagttaacgcacgcaggtcgtattggcgaccgcggaaataggggtaatagatcatttttgcttcgcctcatagagttgatgctgcagtttggcaatttcgaagtttaacgcgtccacttcttcttgtagggctgtgaccgcgttggcacgcgtttcgtcaataaagcggtcgtaaaaattattttctggattatagatatcgtagtgttgatgacgttttttcagttctttgaagagccggtcggtggcatactgactgatgcccgtttccactcgtttagccttgcggacttcccgggcaagcgaatataggaaatggcgcattaattcgccttgatcaagggtaatctcctgataccgtggtttcttttcaacggttagataccccggcgttaagaccggttcagtagcaacttctagctgggctggatcatatttttgataactgaggacaccaatctctgccggaatttcatctgcaacctcctgatagagggatagtggcagaacaaagtagttgtaattcccgataaatgaaagtttggcgtgtgaatgaaaatcacttttagtcacctttaattcgtagcaacgccattcatctgtaccatttggtaaatgctgatagcttaaagtatccacgattccttgatcatcgggcatggtgacttcttccactgcaatactgccagcctcaatgcaggtttcgtacagtgttttttccagttctaacgtgagcttcgttttcaaaattaactcaactccttatcggtcatttcccagaagtgttcaatggtgggcgccaattcatcagcgctgtgcagaatacggtggtactgccagtgcggcgggaagtagcgagtataccgctgactagcaaatcgctgatccattaggagaataactccctgatctgaggtactgcgaataagtcgacctgctgcttggaagacgtgattcaagccgggtatttggtaagcatactcgaaaccgggctcaccctgtgaatcaaagtagtcccgcagcaaattattttcggtacttaaccctggaagtccgacgctaacgatggcgacaccaatcagtcggtcggcggttaaatcgattccctcggaaaataagcctcccaggatagcgaacccaacgagtgattcgtctgggtttggttgaaacgcagccaaaaaagctgacctgtccgactcattcatgttgggagtttgagtgacagtttttaaatctgggtaggccgttttgaacgccaaactaacggtacttaaaaaactgtaagagggtaagaataccaagtaattacccgttttgccgttcactagcgttttgatgccggtgataattttggctaaattagcctcacgactgcgataggtagtgctgatgtagtccgtaatcaaaatactctggtgttttggcgggaatggtgagggtagctgataacagagactttcatcgttccctccaagtacccgctggtaatagtctagtggcgacagggtagccgaaaacagcaccgcaccacgccccttatccagacaatcgcgcagaaacgcgctaggatccagacacagctgtttgaaggtgatttcccggtcgtgatcatcacccaaattaattttagttcggtaggtttcgtcgtaaaagtcagcgatttttaagtagcttaagcacgcaaaataataatccaaaacggtttttgtaaaatcggtttgcggccgttgttcgtcgcctagccagtcgctgatatggtcacttagtttagtgacggctttattaaaatcatcggcaggactattgaagacactttctgcctcaccgctttcaatcagtggacccgcgaccttaaagaaagcgcgtcgcatagctcgaaaagctctcagcagggtcggcgtgccctcatccgagtttttggtggctgcaatcagatcagttaatggtgccaatgataattctgtggagtacatatcccgggaacgactgactaaattatgcgcttcgtccacgagaaagaagttgtcatcgtcatgatcaacagcaaagaaccgctgaaggtagacttgcggatcgaatagatagttataatcgcagataatcacatcacaaaacaagctgatatccaatgaaaattcaaaggggtctagttggtgcttacgtgcgtaagtttccaccgtttctcgagtaatggcagtttcattggttaaaatatctttcaaaccgggttttaaccggtcgtaatagcccaccataaaaggattttcttctggtgatagatccgcttcttctggaaaggtgatggtatccttggctgtcagcgtaatactgcgaagaatcagtcctcgttgtgccatcaaatccagtgcttgctcggcaactcgccgcgtactttgtttggcggttaaatagaaaagccgctgaatctggttttcacccattgccttaatgcatgggaagacggttgaaatcgttttccctgtaccagtaggggcttcaataaacagttgctttttaaggcgtaacgctttatagactgacacagccagttcacgctgaccagttcggtaatgatcgaagggaaaagttaggtctttgatcgaagtattgcggccgtctcgtaaatctgcttgaagttgcaaccaggtttcgtattcagcagtgaccgacttaaaaaattcagtggcttcggctaatgtataagtcatttttcgtgtcgtgacttcctcggttgtccggcgatagtaagtcagttgtaaagtaagctgttccaaactttcatcggtcatcaagatatacgcgtacattttggcctgtccccaatacagggttagagtgttttcggtcaaatcttcaaaagctgcgtcagaggttttaatttcttcaatcaaggtctcgttaccgtttaaaatgaccccatcagcacgaccatggactaagtagggtttgcctgctagttccacttcatgttcaagactatattctttttgatagtgttcgccacgtgatttttgaagcatgcggtgaatttgggcgccttctaaagcagtattcatgctgttcatgctggcgttaagatcgccagaccgcagtgtgaattctactagttcacgaatccctaatttggtgattgtcatttttcgttcctctttgttcatagctgaaatccattatagcatgatacgtcattaacagttttccgttctcaattctcaaaaaaatttgaaaaagaacttgtttccgacaaataaacagggtatgatatcagcaatgaaacctttaacaaatagtcctgtgaggctaagaaggcacgatgaactagacgcagagtctagactttggtgaacctctctacccacaggcggtagagaggtttttgttgtctgacgatttaattgtctcccgtgagagcaaaacgtccaaaggataaaacccgaaaaggcgcgctttgcaaacacggcaaggcgcgtttattttaggaggaaaaaactatgattgaaaccaccaagccgttaagttacgcaaacgtactcagtatgaaagatttggatgccgatgaagtgatggcattcattaaagaagcccagcagtttaaggccggcaaacagattcatctgacgcgaccggtttacgctgccaacctgttctttgaaaacagtacccgaacccacaccagctttgaaatggctgaacgtaaattgggcttgcaagtcgttgacttcaacccggctgtcagctctgttaataagggtgagagtatgggcgataccgtgaaggcactgcaggctattggtgtggacgtggttgccattcgtgatcgacataacgaatattacaacgcactagtgaatgaccgcaacattcatgtaggcatcgctaacggtggtgatggttctggtgagcatccttcacaatcgttgcttgatatgatgacgatttacgaagaatttggcacctttgaaggtttaaaagttgctatcatcggtgatttagcgcattcacgcgtggctcgatcaaacatggaagttttaaacaaactcggtgctcaagtcttctttggcggaccaaagaggtggttcgacgatcgttttgacgcttacgggacttggttgccagtagatgatttagttgatcatatggacgtgatgatgtttctgcgcgttcagcacgaacgactggatgctacagaaaataagcactttacggcggctaaatacaatgctgagtacggtttaacacctgctcgcaaggctcggatgcaggaacacgccatcatcatgcacccagcgccagtgaaccgtggagttgaaattgcggatgacttagtagaatgcgacagttccagaattttccagcaaatggctaacggtgtttacgtgcgaatggcaattatgacaagtttgctgcgctaccaaggattggtggatgaggattaatcatgaaacgattaattaaaaacggtcagtgcttagttgacgggcatttacaagtgcgagatatattgattgctgacggcaaaatcgaaaaaatcgggcagcacctagcagcaaacgttccggtgggtcagattattgatgcccagggattatttgtgagcccggggctagttgacctccacgttcatttacgggaacccggtcaaacagataaggaaacggtcaaaacggggagcttagcagctgctcatggcggttataccaccattgctgcgatgcccaacgtcattccggctccagacacaccgaaacggatgcaagacatgctggcattaaatcagcgagacggtgcagttcatatggttcagtatgccaccattacgactgatcgtggcggtgatgaactggtcgatatggctggcttaaaggctgccggtgcctttgcattcagtaatgatggtaatggtgttcaaactgcgggtactatgtatcaaggaatgaagcaggcagctgcgttaaacatggctgtggttgcccatgcggaagacgatagtttaacctatggtggtgtcatgcacgaaggcagtgtgtcaaagcgactgggactacctggaattccaagtgtttccgaaactgcccaagttgctagggacgtggctttagccgcggctaccggagtccattaccacgtttgccacgtctcgtcggctgcgacggttcaggtgattcgagcagctaaagcggcgggggtgaacgtgacctgtgaagtttccccccatcatttactgttaagcgatgaggtgattacaagtgataatgccatgctcaaaatgaatccgccactgggtagtgaacaagatcgacaagcgcttattgcgggtctgctagacggtaccattgacgtcattgctactgaccatgcaccacacacggatgctgaaaaagcacagtctatgttgaaggcaccttttggtattactggtagcgaaacggcatttgcgatgctgtacacccgttttgtgaaaacgggactgtttagtctggcacagttggtcaattggatggccgttcagccagcggcattgtttggactcaatgctgggcagcttactgaaggtgcaccagctgatctggcactgtttgatctcactacgccatttacgatcaacgctgatgatttcttatctaaggggcataactcaccgtttattggtgaacaagctctgggtaagactgtacgtacgattgtttctggccaagacgtttatccgcttcgagatattgactgatacttgctttgagatgactccaatcgctataattaatatagtgaagattgggggaatgaagatgactgaagcagaattagctgctttaaagccattgctggctgcatataacattgagttggtgactagcggtacggttattactcacgtgaatgggcacgaggcgcaattagacgtgacaggttatatgcctgatcagctaatcaagcttgtgttggagatagtggggactgatctaagagccaagttattcaaaaaaatgcacgagtaatataacagttgtgtgacaattgtttcaaattgctgacaaatgttaacttgaatgagacactgacgtaattttctttgactatactagtctatgttgtttacgaacgaactagattgttgaggagaattaatcttgtcattaaaaacttggatagcgagtctattactcaccgtatcaatgtttgcgggcgttgccggtgtgaccggaacgaacgcagctgcaaaaacaaaatataatcccaaagcagatgcaattatgagcatctcggcgtttaaacgcatgggccgtgttcattatcatcatcgcgtatttacctattattcaccaaatggctctcatatttttggtatgggcgcctacacgtcagatggaacttacacgttgaatggtcatgataagaacggctatttgattttagcgaataacaaaaagtttggtactaagattaagacgccattaggtgtgggtgttgttcatgatcgtggcacttatggcggtcactatgatattgttgtgaagtagagagtgtgaaaacaagcgtttaaagagtggagtacagggtctcaaggcgaaaattcccgaacttggaatttacgccttgagaccctgtatgcaactctttgcttgtttgaacacgtttaagaaaataatccctattctgataaaaccatcagaatagggattatttgtatcttaacgttttgcattgtaacttagttaaacttccagtcatcaagttctttttcgtgtttgccgagataactgatggcttcttgtacgagtgattcggattctttatcgagctcatcagctggcgttccggattcatagtccgaaagaaatccttcacctacggctttatagatatgttcacgggcttcgccaccatctttaaatagtgaatctaagcccttaacgtcgtcttttgctgcgttataaatgatctccgcaaggtcatctcgattacctaattttttggcaccatactccattaagaagtcattcatgtcgacgataacactgtctttgagtgctttctcagattttttcaagaataatcacctctttcattcattttaaaactttctgtggtagaaattcaacgtgtacgcaatgataaatggcggttgtcgattaataattaatcggacttgatttacgtcaagttcaatcactgttttatcggctataatcggattagaataaagtaggaaggtaactggattggagggtaacaaaatgctagaaaatcatgatgcgatagcttgtgtcaaattagtaccgatttttcagcaattagatcatgacacgatttctgccgtggctgagttggtacaggaccgacacgtcaaaaagggtgaattcgtcttcatgtcaggtgaccatgcggattcattgattattatggctcacggacaagtgaaagtgacccaaagctcagctaatggtcgtgaacagttgattcggcttcttcagacgggagatttcgatggcgaatccgttttgttcgaagattcggaaaggaaaaccactgcagaagcactaactgacacgcaaatttgcttaattactcgacaggactttcaaaaattaattaaacaatcaccaacggttgccattaacatgctgaatgctctaggtaagcgggtgactgaacttgaagctcaggcagctgcaacgttaaccactagtgttggtgagcgtttggctaactacttggttgaaactagttcggaattagaaactaacgactttgatttaccgttgcaaaaaaaggatttagcgctctatctaggaacttcgccggaaacaatcagccggaaactgaaacagttctcgacgtcgggattaatctcacagcgagggcgcaaccacattaagcttaatgacattgatggtttaatgatggtggaaaattagtcagttaaattaattactgcaactattaacagactgaccgattagtggtagtctgtttatggtttattgggtccatagctcagttgggagagcgcctgcttcgcatgtaggaggtcgacggttcaagtccgtttggatccattttgttttgctcaaaaaagattaaggattgtattaatacatttaacatgctatgattcggttaatgttatgggtctatttttagggggaatcataatgatgaaaaagattggtacaaaattacttattgtggtagctgtaatgcttggtggtgtcgtggccgtgcaacaaccaaccacagcacatgcgtcaaacaaaatttcgtctgttccaagcggtcattttaaggtatcaaaagccgcttatgcgtttcactggcaaacagttaaaagtggcagcaaaaaggcacaaattcttgtatttggtgactttaagcaacctactgttcgttatgctgtcccaactaagtataagttaagcaagaatcaccggactttgacgacttactatcgtttgatgaataagaataagttagataagacgacttaccggatggatatctataaatacagtaacagtaagtataaagttaagttaaatcagtataaggcgggcttactgccaagctataagggtaaatcttacacggccaatgtgactaagagttcaccagcgcagagttatgcgtcaacttatgctaagcctaaattatttaatgcagaatataaagcaacttataaagcgaattatgacgcaaactataaagcagcgtatgatgcatatcttacccaagtgaccgacgcaatcaacaagggtgctcaacaagattataaagatggtaaaaatggggatccaagtacacccgaagcgcaacaagatataaaaaatgcggcacttaaatatgttaaagacaatactgacaaaattacccaaaatatcaccaagaattttacccaagctgtgacccaaaaggttaataaagatgtcaccaagactcttcaaaacctggtttcggcatacaacgcacattgatttattaaagaccaaattaagttgtgacaaaacttggtagattccagagtttaacacaattaaagcctattccgatgtacttttcggaataggctttaattgtgttaaatggccggaatctgtgttttgatgcgcgattaggctatattgacgtatagaatcaaggtctcattacgactaagcgtaactaaaaatggattgaaatacttaccaagctaaaccttgcggcacaacctcatttttttgtacagtgaaaattatttcacagcaatttcaattgctgtcgcaatgagcaccaccaactagcctttaataaaactatattttcattagaaacatcttgatttcagcaggttaacagcttgattagaaaagcttgtcttgtttaatgccgaactgaacggtgaccaccactccgtcgtcccttaatgacttgacgtttaaacttaggttttgcgttatcagcttcaaatttaaagtgatgcatcttgccggcgaatggctgtccactcatgcggatacgtagccaagattgcatggtcgccaacatttgtttagcgttttcgacttgaatggtttgacctgctttttcggctgctggaaggatatcttcttgaatctgtttaactagtttttgatggtaggcaactaattccatcgttagtggtgcctgaacatactgattaaataagttttcaatatagcgaagcgcgtcttttgcgtttttgggttgataataacgatcatctgtcatgttttacacctcgagtatatagaatagcagtctaaatcaggttaagcaagaagcgacgttaaagatgtggaaattaccgctgtaagtagattaagtgtttgattaaaaccgtaaaaaagcgtaaatttaaaaattgtaaatagctagtttcaaagtgagaaggtgcagcgtggcaagcaaagattatgtagccgaccagcgggttcaaagacatcgctggtggattctagcggcggtgggtttatttacgttcatgtcgacactagatgctagtattgttaatattgcgttacctgtgatttcaaagaatttaagtattccaatgaaccaatcagagtgggtagtttcgatttacctgatcgtcatctgtgcactgttactcctattcggtaagctgggtgattcactgggtaaaatcaacgtttttcgaattggcacgttactatttgttttcggttcgttgctggccggctttaacggcaatttttacttgctgctgtcggcacgagtggtccaagcacttggggcatcgatgaccatggcgaataataacggcatcattaccgaaatttttccctttagtgagcggggtcgtgctctaggtatgattggttcgttcgtggcgttgggtgccattgcaggaccaggattgggcggtattgtactgtctcatctcccttggggctatattttctggttaaacgttcctattggggtggtgacaattattattggccaagtgatcttacctgcagatatcactaagacccacgaaaaaattgatcgttttggtgcggtaactatggcgctgttcatggtgtcgctatttgttggcatctttttaggccaggaaattggttttaccaatccattgattttagggttatttgttttcgcaattgtgattggagccgtctttgtccgcattgagaatcatcagactaatccgttattgtcatttagtctatttaaaaatggcgcttttacgatgagcttgttatgtgcgttcctcattttcgtcaccaacttcttctttaatgtcatttcaccgttttacttagaaaatgcccgtgggttaaaacctaatgttgccgggctgatcttgatggcttatccaattgtgcaagtaatcgtggcgccaattgcgggtgccatctcagatcgaattggccctgaactgattaccttttgtggcttgattttgattctgatgagtcaaattgggtatatgctgacagatttgacgacatcactgtggctttttaccgcaatcgtgggctttgttggtttcggcaacggtatttttcaggcgcctaataacaccattgttatgagcgcggttgatcccgaaaatcttggcattgccggtgggatgaacgcattagtgcgtaatttaggaatggtagttggcgtttcgttttccacaacggtgctttttagcgccatgagtcactatcaaggaacgaaggtgaccacttatcttagtgggcagccagacgttttcatttacggtatgcacgtttcatttttgattgccgcaattatttgtgcaatcgctgcaatgataacgggatatcgtttaattaaacggccaactgggccaacgaaaggtgaatcataaatggcatatcagacactgctttttgatattgatgatacattattgaattttcaagctgcggaaaagcaagcgctggaagggttatttcaagaactgaaattaccattaacgacaacgacctacgcgttttatcatgctgaaaacttggccttatggcaacagtttgaattgggtcagatcagtaagcctaagttgctcgttaagcggtttacaacgcttttttcacacttaggcattactggtattgatggtcaggcaatggaggaacgctaccgctattatttggggcaaggacaccagccgatgccgcaagctccggaagtcctgaacgatttgtgtcgggatcatgacttatacgtagtaacgaacggtgttgctaagacgcagcaaaagcggctttctgaagctcattttgaccgctactttaaaaacgtctttatctctgaactagttggcgctcaaaaaccggcaccagaatttttccagcgggtgacggctgacattcagtcttatgaaccagctcaaaccattgtgattggtgattcgttaacctctgatattaaaggggcagccagctttgggttggattctgtttggtataatccagctcatgcggataataaaactggcattaagcctacgtacgaaattgatcagcttgaaaaactggaagagattgtggcttaaccgttaaatcatagaaatcaaaaaagccgactgctgtagtcggcttttaatatacggttacttttaatgatacctatcgtttagaaatgagtaaaatctgagaaattcacacttcatttcatattttgtatcaggttaaattttgtctaacgcttgtttcaaatcagcgattaaatcgtccgcgttttcgattccgactgagatccggatcaaatcaggtgtgataccagttgctttcagttcttcttcgttcaactgggcatgggtcgttgaagcggggtgaatgatcaatgaatgtgcatcgccgacgtttgccagcaacgaaaacaaatcaaggttttcaattaattgtttacccgcagcttcgccacctttgagaccaagagtaaagattgagcctgtgcccttagggaagtacttttgggcgagtgcgtggtacttgctgtctgccagttctggatagttcacccaggcgacctttggatgatcatttaagaactgagtgatcttttcagtgttggcaacgtggcgttctacccgcaaagagaggtcttctagtccttgaagcagtaagaaggagttaaatggactgatagcagcaccggtgtcacgtaacgtttgagcacgaaccttggtagtgaatgctgcaggggccaaatcactccacacaatgccgttgtaggttggatctggcgtagtaaagtcagggtatttgccggatgccgcataatcgaatttaccgttttcgacgatgacgccacccattgaagtcccgtggccaccaataaacttagttgcggaatggacaaccacatcaacgccgtggtccagtggttgaatgaggtaaggtgtgccaaaggtattgtcggcaattagaataatgccgtgatcgtgtgccacttttgcaacggcttcaatatcaattaagttgattcctggattaccaatggtttcaatgtaaagtgccttggtatggtcgtcgatggcggtggcgaaattctgtgggtcatctggatcgacaaaggtggttgtgatacctaattttggcagtgtcacgctaaataaatcgtaagtcccgccgtaaagcgtgctggctgaaacgatgttgtcgccagcattagcgacgtttaaaatcgatgcggtcacagcggcggcaccggttgctaacgccacaccggcagtcccgttttcaagtgcggcaacccgctgttcaacgacagaagtggttgggttggtcaatcgggtgtaaatgttaccaggatcagttaatgcgaaacgaccagctgcctgtgcagcatccttgaaaacgtatgacgtggtctggtaaattggaacagcacgggcaccggtttcatcgacaacttgacctgcatgaacttgtttcgtttcaaaatgtaaatttttctcagtcatattaatctctccctaatttttagtttatttatgatgtgcacttaaatatgtgtatcagaaaacgaaaaaagcgttcaccccaataccagcctaaagccagtatgggacgaacgccgtgttaccacccattttcataattcacttacatgaattacctcaacaacacctattgatgtttgggatagtaacgcatccttgcgggtcagttgcgtgaacagctcaccatcaattttgggttcattcaccaaatcgagctatgcctgcctctcactaaatgcaggtcgctgtgtaaagtctcattggttactattcccatcaaattttcattatctaattgtgttctaatatagtcggtattggttggaaagtcaaattattttttgacttttttggaaaataaacttttaaaccagccgaaaatgggtccccaatccatcatgccacccgagttaggtggcgttttaatatccactttaatttccggtaaactgtgatgttcctcgactttgcgagacttgtctggcatgttaaaatctccttatgagtgaaatccaaatttaattacattttaacgcaaaacgattgttttcaggtttgaattagcgtaaagtttcattgttgtatgagttacattagcgaatagagaggtggtgcgtcaatgaattcgatcatgaatgatctgcaatatgcattgcaacggaaagctttagtgaatgtttatcaggttaagcaagatattgtttatactggttatgttgagattgtcgatgatgctggcatcattttgacaacctttgatgatagtggcagtgaagatggtgctgtttatctgacgtttgatgtgattgaatttgttgagtttgacagcgatgatctcgataatatgcgttatcggattgaaaacgctactgctgaacacttcttttcttttggtcagatgaccactgaattcgactcgaagcggccgctaattcggcaagtattagaaaacgccatggtagaagaagccacggtgatggttctcgataagcagagtggtgaacttcatgaaggtgaagtggtccgaatctcaaaacaggattttgattttcaagtgtttaacaaatttcacttggatcagcacccattattgacccttgattttaccgatgtagccctgattgaatttgagggcaaagaactcacccttcagaccgctgcgatgggcttcttacagacaataacacccgtaaaaactgtttcagtattaagtttaactggtatttcagacgtgcttcatcgtgcagaacaaacccagcagctgctttccattaagccggtggcagatgagggcatgttcttcgtcggccgagtgaatacggttggcgaggattgcgtggtggtgaacctggttgatatgaccggtcaatttggtggttattggttggttaagtttactgccattgcccagattacgacgcagtctgattacttatcagtgatgaaaacttacatgacgttagatgatacgttaggagtgactgcacagacaggagtcaacgatgaacggttatttgacggtacggataatttattccaagaagtactcagtcaggccggcaagtttcaccgggtgatccggctacagttgacggatgatgaaaatattaccggttatattagtaaatttggcggcaacgaaattatttttcacgcagtcgagcagggtaccgtagttgataaaatgggtacgctgattgatttaaacgaaattgatgaagtggccttcgattatttggatgccatgttaactgaaaaacagttacgtaatcaaggcgaactttaggggggatctcctttgttggaaaaatggcagaaaatgccgaagtggttcaaggacaccatggcggttattgcgccaatggcgattttattgattctttacgatttactatctccgcaatttacgcatcagccatattcgatgacgacctttatcgcgtttccctttcaggtgatcattgcttttggactcttgggtttgtataaccatcataaaatcaaaattatcgaaaaagataaagcacaaaaggctgaagcagcgcgaatcgagcggcttaaaaaagaacagcaggaacgtcagcatgaagaaaatagccaacgtaatcgagctgttaaacagaatcgaccgcaataagagtgtgaaccaaggcgcttagagactgaagcagaacatcgccccaccataaatcccgaacttggatttgtggtggggtgatgttctgtacaggtctctgccttggtgagcacgtttgagagagtagtgtatgtattccagaatataccgtaaaaatgccaattccgagcgaactttgccggaattggcattttttgatttgtgctatatgatcagaaactgatttgtgtcttatttttctaaacgtgttcaacgtggcagagacctgcatgtaactaggtcccaccataaatccaaaaccgggatttttggtgagtcctagttacactccggtctctaaacgccgcgtttcgcactctgcttttttgaaacgtgctcaaacaagcaaagagttgcaaataaggcacagccaacaaaaatccaaacccgggatttctgttggctgtgccttattctccactctttaaacgcttgttttcgcactctaatccgtataaaattcaatcgccaacgcgcccacactcgtataagtgctgatcactggtccagcttcatgaatggtgaccaatgtgtttggtaaggccgccttaatttggttggccacttcacttgcctgagtcagattatccacgtgtgtcagaccaactttagctggtgcaacggtcttgattcgttccactaaatcggcaatttctttacggataaaccgtttgccacgccctttagccgccactctgagttcgccgtctttgacttctgccatgactttgatgttcaacaggttagcgataccaccagccgccttgctaattcggccacccctgatgagattttcaagtgtgttgagaaaaacgtaaatctcagtgtgggaacggtgtagttcaatggcatttaggatggtatccattggggcaccattcttcgccaatttagccgcagtgatcacttgaaacgctagtccgcggtcaattgactttgagtcaacaacggtgactttagtttcggaaatttctgctgcttgtcgagcggcgttgaccgttccactcaaaaaatgagtcagattgaggcataaaacttcgtcgccattttcacccagccgattgaaagcctctaaaaactgaccaattgagggctggctggttttaggaagttcatcatcattgactaaatgactcagaaactgggcgttggtgatttgaacaccatcgtttaaaaattcttgtttacctaaacgaacgatcaacggtaccacggtaatcggcaaggttgccatttcttcagcagttagctgaaccgttgagtccgttacgatttgaatagacataagtccacctctttagtgaattactcaacgtatcctttacaagacgcgttgcttgattttgattctataaaatcaatgccataaactatgggacatcgtctttcaccaattccaagtttggcggtatacttaattatacgcactaggcacattataccgtaaaatcagcaaaacatgaaagatggggttaaaaaatgactgagtcccaaaagaacgatatgcctgacgaaccaacaccagcgaaaaagccgttaaacctcaatgatttagcttctaatccgatgcgagtcgggatggaacgaatggcgcaggagaaaaagtcgcagacgaaacagcaaaagaagcattggtggtctaggaaaaagaagtgaggtgttcaacgtggcgaatcttaaattgattcagggtgacattacagcctttaagggtgatgctatcgttaatgctgctaacacaggtttagtaggtggcggtggcgttgacggtgccattcaccgagcagcgggacctgagctgaatattgcctgccgaaagctgcatggctgtccaactggtgatgcaaaggtgacgccggggtttaacttaccagttcgatttatcattcacacaccaggaccaatttggcgtgacggttcttttgaggaacctaagttgttgcgtagctgttatgagaatagtttgaagcgggcggtggagaatcattgtcaaaccgtggcgtttccgtctattagcacgggaatttacggttatcctttagataaagcctgcaagattgcggtatcaaccattcgaaagtttgacgcaccgcttcaagtgacgatggtggcgtttgatcaaaaaacgtatgacgcttttaacaaagcaatggcaaactaaaaacagcttgttaatcagaaaacatctgattgacaagctgtttcgtttatactgtgatacttgtatcgcgttcattgatgttgaccccgatgaattagtttgcaccgataaaatgatttagtaccgcagtttcttcagtcgttgggtcactttccattgacttgatattgtgtaaccgttcaactgtaatgtgaagatttaaggccagttcagtatctgtaagattatgtttcttttgatattgaatgattttttctgcaataccgtttacttcttgttccataatatacctccacctgatatgacttaaaactaaacacaactaaacctaggttcattataaacgatttttgggagtccgccaaagaattagaagtttggatgatcgataagccagaatttaaaagcaaactgcagtcacctaaaacccattgatagagcaggtagaccaataaacaagtgaaaaaagttacataaaatcaattgcactgtaatcttttcgtgatgttgctcctgtatcattgtaaatattaataattaatatgaggtgatagttatgaacttaaaacacagtttactaatgctgacagccaccgtttcattgtttggtgcaacggttactacggcttcagccgcaactattcaggcactccctaaccaagaagctacaagagcggctcataatgccgttgaaggaagtactgataatagtagtgagaccgctgatacgactcagtcaactagtagttctgctaccgttactaatgatggggaaactgccaccacgtctcaagccaaggcagtggttaatttagcgaagaagttagccaccatgaatattccctacgtctggggtggtgaatcattgcacggtatggattgttccggattaacggattacgtttacgcccatgctgccaacattcacttgggtcactatacggtgactcaagagggtcaggtcaatcgtaaacccgtctctcaagctaaaccaggggacctgcttttctgggggtcggctggtgcgactcatcatgttgccatttatattggcaataaccagtttgtagcggcgcctcaaccaggtcagaacgtggatgttgagacgattagcagttacttcatgccaagttttgcagggactgtcaagtaataatcgctatcccgcttacttatttgcactcatggtataatgggcgtaaataagtaaggggggagcggcagattcagtgggatgaatttgcccaatgataagcgatgaaaacgttaatcaagatcgtgttaccaatggctgttttaggattgctgggcgggtgtggctcacaaaccaagtcacattcagcatcaaaggaatcaaaaacaactgaagttgctaaacctaaaactaatagtagcagcagtagtagttccacaagtgattcttcaaccaaaccagtggctgaatcatctgccgaatctgagcaaccaagcgagaaaagacagaacaaccaaaccaccgctaaaacgcaggctaagacccaaagttctcaagccaatgtcactcaaagtcatcctgcagtgacgcagcaaatgcttgctagccgaatctctcggttactcagtggtcaatatgctcctcaggatttgagctttcagttcaatcaagcagggtctggcatttatacggttcaggtgcaggaaaaccatcagtcacccaatatgaaagctaagggtgcggatccaagtaccagtccaacgattgcgtggtttaagaccaatgcgaagggccagttacttaaatcagttgacggcggtgttaattacgtggtggttggtaatgcgtattaaaaataggactgtttcataattcaaattttgactataaaaacaaacaagcgctattctgaaatttctcggaatagcgcttgtttgtttttaagtcagtatctggtaaattaccacataccgtgttttttacgaattgatgatctaaatccaaacagagcaacgataaaggcaaagaacgcgattgcagcaacgattgtccatagccagctagtagtttgaacgaaaacgtagtagccgattccgattgaactgaaaaaagttagtagcaaggataaaaagagattgtcgataccgtaaaacgcatggccgatagtcaaaacaatggcacctgtaaatactgtttctgcgcttaccatactgcccaagtgatagaaaaatgcacctagttcgagtaacgcgcctagaaccattacggtcacgccgaatgctgtcgtgaatttaagtggtttttgagccataatgatcaccttctttaaactatattataaatcttttaagtaaaatggggtaatcatattattgcaaatgtaagccgaataacgcaacttgcaatagtgccagactgccaatgacgattaaccagtcccaccagcggatgcgaatttgcttgaaatatgtgcggggagcatcctcagaaaagccgtgagaagtcatggcttcagccaagttttctgaccagtctaacgaggcgagaatcgctttaaaatacagttggggtgaccagatatgcaatgcttgtccacgcatattacctgctgcgcggatcacattaacttcactcacaatttttggcagtaagttgaaggcacctaagaagccgtaagcaaacttactgggaatatgtgcgttttgttccagcgacatcactaaatcagcaactgaagtggtcaacgttgcggctgaacccacaaagacgtaagcgtagatccgagtgaacaaaactagggcaaaatgaataccagcgttggattgtaataaaatcgctactgctaatgctactgcgggaattaaagggacaaagaacaacagcacaagtcgttttagacttggccgactgctgaggatgaccaacaaaccgatcactgccagtcctaggttgactgtccaggtgttagtgaaggaaatttccagcgcaatcagtaccgctaataagaattttaaactcgggttcacgctaatccctccacatactgtaattgtttgttttctagagtcacatggtagtcaactaaggcatctaggccaaaaagctggtgactaacaatgatcatggtttgctgacaatctttcgcaacctgtttcatgatggtcataacggcctgcaatgaactgaaatcaagtccggtaaacggttcatcgaacagcaagaccggagtagccatgatcagcatttctagaatctgcagttttttcttttgaccgccgcttaacgtgtagaccacttgatcttgtaactgagttaactgtaattgttctaggaacttaggaatacgatccttaaaataagctggtgcctgactattttttaaggataaggctaattcttccgataccgttacatttaagaattgctgatcggcatcttgaaagacaagcgcaacttgctggtaaaggcgattaggccgaattttagcaatttccttttggttaagcaacagggaaccattgtattgatgcagttttgaaattgctaatagcaaggtcgatttgcccgtaccattggcgccagtcaacagggtaatatggtgctggaagaaatcaattttaggctgggtcagcaaagtcgatgttccagccgtcaactttaagttgtttgctgagataatcggttcatcagtctttttaggcaacagcaactgttgattagaggtatctcgccgcttaaaggcagccattttttgttgtgctgctttgtcgttgagcaatacgagtgaatcaccggtgttattcaacacaaagagatgatcaatataggcatcatagtcttcaaggtcatgatcagaaatgataatggttttgtgttcttcatgctgcagtcttgaaagtttagccaacagcagctgacgggcaactggatccacactggcaaagggttcatctaataagatagtgtccgcttgcatggcgatgatcactgctaaagcaaccttttgtttttcaccacctgagaggctattgagttggcgatgacgtaattgactgatttcaacgtagtcaagtgcacggtcaactctagccatcatatctgccggagcaacacactggttttctagcgcaaaaattaattctcgctctactgtgtccatggcaaattgctgatttggattttgaaacatcattgcaactaactgaccacgatccgtttccggtatgtcactaattttggtgtcgtttaaccggacttctccggctgtaatcagtccgccaaatttcgggtaaaggccactgataattttcatcagagtggacttaccggaaccagaaggccccgtcaatagcgaaaagccgccgttaggaaaagtggctgaaatatcggccaaagtcaaaggcttttgaccgtcctcagtcggataagaaaatgataggtgatttaccgaaatcgttgccatgagtttacctcaattctagcgcgtttgagtttgcatcaagtgtgtccggtcaagcaagttgacgatggctttaaccagcacaccggagaagatccaagttgagatgagacgaatgatgaacagtgcaattagtaaaccaatgtgatacttggagtaaccgttacgaatcatgtcccaaccaaaggtgacgatagtggtggtcagcacactaaggttcaagctgaaccagtcataacgtttgtaaccggtaaacgtgaagcctaattctgaagccaccccttggacaacaccagaaatcatcgtgctggcaccccattggccaccaagaaacatttcaaccacagaccccaagaattcaccaagggtagccgaaccgactttcttaaagacgtatccggataatggaccagccatcacccagatgcccatgacaatgtcgttggcgcctggtccaaggccaacgggggtaagagcaaccgttagcacgttgtacaacgggccgatgatccaatagattaccccgaagaaaatagcaattaacgttaataagataatgtcgcgtaaatgccaagcatttgaatatttcatgacaaaaagcctccacatataatatagttttgctaaacggtttccacagaaaaagagccaaagataaacgtttatctttgactcttccttttggcttttattatcagaaaataaatgcattatgctcccttcgctggtattaaccagatcaggttcaatgggtggtatctcagccaaaaggcaccccagataacgtttagtacaatgctcagtttacacggactagttagtatttgcaagcaaactagcgcagcgttatgcgcggcctaacttctttagatttggaattgtcagcatggtgcacagactaatgatgtagagtactgacaggaagcccataacgacgattaagctgtaatgatccatcaaaaagccgatggcaacactggagaaaccgccaatcgcccggccaacgttgacaatcacattattagccgttgaacggatttcagtgggatagagccgagaaatcacggcaccgtaaccgccaaacatcccgtttgagaagaatccgaggacagcaccggcaatcagtaaagtgacttcattgactgccagagtgatactgaaaacggcaacagccgagcagatcaggaaaataccaaatgccaatcggggaccgaagtaatcaagaatgctgccgaatgtcatcatcccaatactcatgccgacgattgttgcaatcatccagatggaagaaccggatacgcttaggtgcagcttttgttgcatgatggaaggcaaccagttcattaagccgaagtagccggcgatttgaacaactaccataacgctaagtgcaacggtttgataagccagcttcggtgttttaaacagcgcgctgatacgaacccgtttgctgggatctttttcagcttttttagcggctaaaaattcgtcgctttcgtggagatgacgacggatgaagtaggttaaaccaactggaatcagtccaaataggaacagtgcacgccagccgaatacaggaataatgaatgcagctgagatagcagctagaatcgcgccgatttgaccaccaatagccgcaattgaagtcatcttaccaatcttatgatgattgaagttttcagcaatcagcgtaatgccgacgccatattcaccaccggcaccgacaccggcgatgaagcggcagaggtagattaaggtaatgctattagcgaagtacatggcagcagtggcaaaagcaaaaatgaaaacggtgtgggagaaagtacgtactcgtccgaaacgatcagcgatgacgccgaaaaaaataccgcccactagcatgcccaaattagtgattgatgaaatcagccctgcctgagcaccgttgatatgtaaatcagcgatgatggaagaaagtgcaaaggagaggaacaaaacgtccatattctccaaagcaaatcccgccgaggtagaagcaatcgtccacttttggttcttgcttagtgcgtggtgttgtgcagtagtttccatattcagtttcctccaaaataagtgctcactggcacttgttatttttgcggttacggatctaaccgtcgctggtattgtgacatagtttattgatgaatacaagtacttcttgacggtcactagctggctgatgtaaactcaaagcaagatatctttaacttagcccagtgagactaacaagtttacggaagaagtccatcttcttgatggaaccagtgaaccgtttagcgctcgagctaaacggttttttgtgtatagaaaggagaacgaaatgcgccccatcattattgcgttagactttgaagatcgaaatcaggtattcaattttcttgatcgatttgaccaccaagatcaattatttgtgaaagttggcatggaactcttttatttcgagggaccgaagattttattggaattacgtaagcgtgggattcaagttttccttgatttgaagctgtatgatattcctaacaccgttgagcaagccatgtatcagttaggtcagcaggaggtttccatggttacggttcacgcggctggcggtgctgagatgatcagcagggcgaagaaggggcttttgcgtggcagtcaaaaagctggcgtaaagccggctaaattactcgccattacgcagctgacttcaacttctgaagagcagatgcggaccgaacagctggtcaatgccagcttaacggaatcggtacggcactatgcccaattggcagaagctagcggtgcggatggcgttatttcatcagcccttgaagatcccatgatccaccgttcgaccagtgatgaatttttgtgcattaatcctgggattcgtttagccactgatagtgcagacgatcaaaagcgggtggtaacgccagctcaggctgctgaacttggcagtgatggtctggtagttggtcgctcaatcactcaagcggatgatccagtcgttgcttatcaaaaaattgccaaagaatgggagctataatcatgactgaaattgcacgtcaaattgcacaagatcttttagaaatcaatgctgtaacgttatcgcctaaagaaccgtttacttgggccagcgggattcaggcaccaatctacactgataaccgccggacgattgcctttccagccgttcggacacacattgcagaaggacttgccgattacatcaagagtaacttttctgatgcaaccgtgattgctggtgtagcaactgccgggattcctcacgctgcaatcgttgccgacaaacttgcattgcccatgagctacgttcggtcaaagcccaaggatcatggaacgggtcagcaaattgaaggacaaatcttgccaaccgataaagtagttttgatcgatgatttgatttcaactggtggcagtgtgttaggtgctgctaaagcggtccaacggtcaggtgcagaagtattgggagtcctcggtatcttttcttatgaattaccggatagcgcggagaactttgcgaaagctgaattgtccttgcatacactgactaattacagtacgctgatccagttggctaacgaaaaccacgacattgatcaagcagaactgaattcgttgcagcaatggcgacaggacccgtggcactggttaccagcagaatctaagtaacggagatgacgcggcatgtccatcaaattaattgctactgacatggatggcacctttttaaatgatcaaaatgattatgatcacgcacggtttcaaagactattaacaaagatgacgcaaaaaaatgtccggtttgtggtagccagcggtaatcagtacccgcatttaccccaatattttcaaggattaaccggagaaattacctacttagctgaagatggggcgcacattgtctcaaatgaacagactatcagtgaagatgtgattccacgtgctgtactactcgaattcctagaatggatgcgaactcaaccactatttaaacatgcatgggtgctactgtctggtcgacaagcggcttggactgaaatgctggcttcagctaaacggtttaaaaagtccagttatttttatggcaatttaactcacgttatggatctagccgaagtgaatgatgatatttataaagttgatattacgtggcctgcttttgacgtttcagctcaggaagcattggttaatgaggcctttgcgggtaaactacgggcaacttctagtgggtttggtggcattgacgtgatccttcctcatgtgaataaggcgtatggcttaggcaaactgcagcagcaatggcagatcagccgtgatgaaacactcgcgtttggcgatagcggcaacgatttggaaatgctgcagcaggctaagtatggctacgtgatgaaaaatgcgccagagtctgtcaaaaaacaggtgaatttaatcacaccgctgacgaacaatgatagcggcgtcctcgctgtgattgatgattttctcaaatagattgaaatgggttatactgaaactattgtgaagaaatcgacgaggtggataaaatgattaaattagtagcactagatttggacaatacattactcactaacgataaaaaaattagtcaggtcaacgaactggctttgaagaaattaacggcaactggtgttaaagttgttttatgtacaggacggccaatcaacgctatttggcactatattgaacagcttggcttaacgggtgccgatgattatacgattacctttaatggtgcgctagtgattaataatactagtcgcgaggttttggctaagcaggggctcaccaagactgacttagtgccactgcatgatttttgtaaggctaacgggtttccgatggatattctggattttgaccaggtttatccggtcacggatttagtgaagtcaatttacacgttgggtggcggcatcaagtttgcccccatgacgtttgatgagctgcctgatcacttatatgcgaaagttgttgctgctcaaaagccggaagagttggatcaaatgattgccacgttgacaccagaacttcatgaaaagtatcatattgcgcggtcacaaccgcatattttagagtttttgagttcaacaactgacaaatccgttggtctgcatgcactcttgcaacatttcggctgggatgaaagtaacctcatggcttttggcgatgccgaaaacgatgcaggtatgttgaaagcggcgtctgtgggtgtggcaatggcgaatgcaattcctgaaattacggcgttgactaactaccacactgggactaacgaagaagacggtgtcgcggaattcgttgatcaatattttaaacttaactagccatttataaatagtgtagctcttgattttcaatagagaatcaggggctttttttatgccactggagttgagtggtaactgttggatggaaaatttagcttgcttgcacttcaattcagtgttatcatttattttaatcgcacacgattgattgaggaggcttacccatgacaacgcacgttcatattgctgatcaactttgtttcagcacgtataatgtcaatcgattgtttaacaaattttaccaagaagcgctggcaccgtataagttaacttattcgcagtatttacttttgacggcgctgtgggaaaatgaccatcaggaactccgtgatttaggtgaggttctgcatttgaagtcaaataccttaacgccattggtgaaacggatggagcagcgaggctgggtgagtcgcactcggcctgatgataaacggcgcctcattgtgaacttgacggacaaagccaaggctagtgaggaaccgattcatgaggagttggcgacgtgtttaggtcgccgacacatgtcctatgaggactatcagcaagcgttagctttgaaccaaaaatttatcgccgcttttaacgagtaaggcggttttattttcaataattaatcgtgcacgattatttaactaggaggctttatattatggattttgatgttatttttattggttctggtcacgcaaactggcatgcagccgttactttgaaacaagctggtaaaaaggttgccattgttgaaaaagacatggttggcggaacttgtaccaactatggttgcgatgccaagatcgctttggacgggccgtttcaacttgttgaacagttgaaccgttttaagggcagtggcgttaaagaaacacctgccatcaactggccagaattaatggcctacaaacatcaaatgattgatccgcttgcaccttctatggatggtttatttggtcagatgggaattactatgctcaaaggttctggcgtgatcactgatgctcacacagttatggttgcaggcgagtcttataagacggactatatcgtcattggaacgggtcagcgtcctgctactttagatatcgaaggaaaagaatatgttcacgattcccgcgagtttttagacattcctgacatgccaaagcgattgaccttcattggctcaggtgtgattgctatggagtttgccgcaatggctgctaccatgggtcgagaagttcacatcgtagaatttgctgaccgtgcacttggggcctttccgaagacctacgttgatcgtttgcaggctaagttagaacagcagggtgttgttttccactttaacgaagcggtaactgctgtgactaaaactgaaggtggcctgactgttaccaccaagaatggtttgaacattgagactgactacgttcttggtgctacaggacggattgctaacgtggaaaacattgggttagaaaatgttggtatcgatgcttctcgtcgcggtatcaaagttaatgatcatctgcaaactagtgttgcaagtatcttcgccagtggagatgtgatcgacaaaacgcagcctaagttaacgccaactgcaacctttgaatcaaattatattgcggacgtgattttaggcaatgatcaaccaatcagctatccagcaattccaagcgtggtctttacgatgcctcggatttctcaagtcggcgtgagtgtggcgactgccacggccaacccagacgaatatcgcactcaagttgttccgtttggtaagcagctagcctttgaattcaaacttgctttggatgccgaagcaacgttggtgttcgataaagccggctacctagtaggtgccagtgtatacgcagatgatgcggatgatttgatcaacctcatcaccatgatcattaacggtcatttcactcagagacaactcaatcaacagatttttgcctttccgagcgcgactagcggtgtgatcgatttacttcggtcattattaccaaaggactaaaattaaaactgaatcattttccaaaaacattaaaaaagtacgctcaaggctaatcctttgagcgtacttttttgatttaatttagcttagtttttagcaaacagccctgttagatatttcatgaaggttgctagataacggtccgcatcaacgttgataccaacgttgacgttcgtttctggttgatccaagcgcgcttggtcgccaattgttcggccgtaagtttctttatcagtggaaacaaacatgttaagtcccagtgtggtaataaaacttggatcaagtgccacaccaacggcaaggggatcatgcaacgcacaaccaggtacttgagggttggtttcttcgtaggcttcaatgtagtagtcaacgatatcggcaaaggcagtaccagctttggtattaagttcacgccactgtgacgtttctttacgagtcaatagtgtccgcaaggtaacatctaaaccgaccatggttaactgcattgggctggtaaagaccgcgttggcagcttctgcatcttggttaatgttagcttctgcataggcgttaacgttaccttcaacggttaaagcaccgcccatgaaagtgacgttaccaatctctgtggcaatttcaggggctttttcaagcgccttagctaagttagtcattggaccagttgggactaacgtcaagtctttgccgtattttttaacggaatcgattaagaaatcaacaccagaagtggtttctaattggcgcttaggttctggcagttcaacttgaccaatcccgttttcgccatgaattcgtgcactaacttgcatccggtcgaagtgatcacttgtaagggagtgactttcgccgagataaacaggtacatcaggggcacccagcaattccaaaatcttcagtgagttgatgccgccttctttaacgtagacgttaccatatgaaccaatgataccgattagatcaacatctggtgcggccaatgcataggcaatagccaatgagtcatcaataccagtatccagatccaaaatcattttttttgtagccatcagaaaacctccatcgaacaacttatacccagttgttctttgttattgttgaaagcgctgcactatactcttcaatgataagtgaagaaagattgaaatacaagaaatttacggttagattcgggtacgaatagcgtcctgatgggaatctgattaacatattgaaacgggatgagaattttgtatcgatactggtaaccggatacatgtggtacaatatttctgtccagtaccatgtgaaaatcatgaatttggaggtaatgaacagtaactattttgctgtaaaaggatatcaatctttgtaaagtggtgcttctatcctattccgtattcttataaggctggtgaagatataactaggttaaagttaaaaattgaattttccgtattagctgatagcttataagtagtgatttatatgaatttcattaaaaggctttttaagataaagccatcccgtataatatgagggacacctcacctagtgattaaatttaataaggcggaacaacagatgttactcacctataaagtcgaaattaagctgactgaaaaacaagcctggcagattgattgtcatattggtggtagtcgttgggcctataacctgtttttggatatcaaccggcaacgctacgaaatgggttattgttacttaaacgcttacgcctttagtaagtggtttaaccatgaatatctagaagccaatcctgatgacaggtggatcaaggatctatatgccaaatcgattaaacaggccttcattgatgctgacacggctatgaaacggttctttaagaaactgagcggtttcccacattggcgctcgtttaagcgcggtcagggcagttactactttgttaagaacgataaaacgcaaatcattgcctgtcagcgtcaccggattaagttaccgaaacttggctacattcccacagactcagagcacttcgttatcaaacaaggccggattaaatttaaggctggtcggtattacctgacctgtttagtggaacaagccgaattgccaaagttagaactgattggtgagcccattggcattgaccttggcctaaaagaattggccattctaaacgatggtacattgtatcccaataagaataagagcagccgggtaagacgtatcagaaaacgtctgcgacggctgcaaagaaagttatcccgccagtatgaagcactgaaagctagaagacagaaagaaggaaaatctgctactgatttaaatctagctaaaactcagcagaaagtgcaacgcttgtatcaacgattgaccaacattcagtcggattatcaaaataagattattgctgctgtggtgagaaccaaaccgcagtgggtagccttagaagacttgaatgttaaaggtatgatgaagaatcggcatttagctaaagcggtcagttaccaaggattctacaactttagaatcaaattaatcgctaaatgccaacaactaagcattccggtacacttaactggccggtttgaaccaacttctaagttatgccatcaatgtggctataaaaaagttgatttaaagctaagtgagcgaacctatcaatgtcctaaatgttgttatactgcagatcgagatattaatgcggccttaaacatcagggatactgaaaactttgaattagcctactaacacaggcttcaaagtacgtaccggtggctagctgggaattaacgcttgtggactatcatatcaactgcagtagtgagtttcatgcgaggcaggatagggagaaacaagaataatctataactttttatcagttatcagtagcaggtaataatgactcagaatttaacggaggaacaaattaaaaagaggcgcaaagaaaacctcctggatgatgcgaccaaggaacttaacgagtggaccggagatgacacagccgtcgaaattcatttattccaaatgttttcagaggtttttaagcggcataataaggatgaaggggacgcattattcattgtgggtactaagaccacgaccccaagtttatccgaggtttcatcagctccagttaaaccttggcttttctcccgggtattagcgttgttgggcctaagttttgccttactgacgctgctatttcttgtttttcatagtgataaagccgttcccgggatggtttttattggctcactagccgtaccgttttcactagctattatgttttttgaaattaacgtttataaaaatatttccgtgtttcaggctaccgaagtttttctgattggtgggattgcttcgttgattgcaaccatggttctgtatcaactgattccttcaggtaacggggtggatttagtctctgcgctaacgattggattcattgaagaaacgggtaaattactgattatcggttactttatcaatagtttccgggtgaattatatctttaacggcatgctaatcggtgcttgtgtcggtgcgggatttgcggtttttgaaacttcgggttacaccggtgaatttggcttagtcactttgtttgtgcggagttggcaggccattggcacccacaccatttggtcggcaattattggggctgcaattattctagccaagggtcgtcataagccagtgaagggtaaaacaatggtgcgaccaaaatttttgcgcttttacgtgttggctgtcttacttcatgcaggttgggactggcaagcgccaacgccgttcctatctgcttttgatattcagaaatggctgattatcattgtgggttggattgccatttttgtcctgatcgatgcggggttacgggaagtgcgtaccttgcagggacagcgtattattaattaaacgtttagaggagtgtcgaagttggataaacagtatgatttaacaattattggcggaggtcccgccggtattttcgccggattttacgcaggcttacgtgaggcatctgcacaactgattgaaagcttacccgttttgggcggtcaggtcagtgccttgtatccggaaaagcggatcttggatgttgctgggatacccaatattcaagcgcagcatttgattgatcagcaggtcgaacaatttaaacagtttccaatcgatgttaagacggaacaaaccgtcactaacattgagaaaacagcggatggttttacggtgacgacgcctagtgaagtgacccattcgaaaaacgttttaatcgcggttggaaatggttctttcgcgccacgtcccttagcaattgataatgtgaaggaatttgaaggtaagagccttttttacgccgttactgatttagctcattttaagggacatcgcgtgctcattgccggtgggggcgactctgctttggatgaagcactaatgttagagccagtggcgaaaagcgttcatttagttcaccggcgaaacgaatttagggcgctggagcacacggttgctcaggttaaagcttcaacggtcgatgttcaaacgccatacatgatcaaaaccattgaaaagactgataatgggatgttggtcaccattaaaaagatgcgttcagacgatgaaaccgaaacctttgaagtcgatgatgtgatcgtcagttatggtttcacttctgaccataaaacagtggatggctggggtattgatcttgaaacggatcaccggctgtttaaagttaacacacaaatggaaactagtgtgcccggtatttacgccatcggagacagtgtgacgtatccaggtaagcaggcgttgattgccaccgcttatggtgaagcgccaatcgcggttaacgcaattatggccaagctgtatccggaccgtcgcggaccgatgcattcttcatcgattattaagcaaaagtaaagcgagagagtgtgaaaacaagcgtttaaagagtggcgtataagggctcaaaacagaaattgccttgaactttaggcaatttttgttttgagcccttatacataactctttgcttgtttgaacacgtttagggaaatgttcgataacacaaataaagcccattccggcgaacttggaatgggctttatttacgttaaattgtatagatgacgtccagattaaacgttacttatcaccactgtttgcgtccggattcgtaatcttgattcggttggtatccgttgacttatgatttaattctggtgcatttgtcttgtagtctgattgggtcgatttattgccattctcactgaagagactggtagacttaccctttaagcgacgttcaatattgatttccttacttaaaccgttggcatagttgtactttgctgggttaactgctttgagtcccttaggatgatagaaacgtagcaggttcttttggttaagcgaatctgacaggctaagttcgagtttgactttggcttgcatcttcttgatcttagcttgtagttttttattcggatgaagttcttgacctgttttattatcgtagacagtgcccgataagcaagtatagcggtcactgacccaatcttcatttctgaaggccaccaccgtatcatgttcctttgagaataaatcagttccaaattgaatgtactgcttggtgctgattcccaataaatgtaacagggttggcaagacgtcgatttcgccaccatacgtatggttaatgtaaccgcctttggtaccaggcatattgaacattaacggcacacgttgaagctgagcgttatcaaagtcgttccaatcgcttggatttttgcccagtgccttcgccaagctggtattttcagaattagaaatcccgtaatggtcaccgtataagacgatcatactctttttatccagtccggttttgtgcaggtaactgtaaaattccttgatggactcgtccaggtaatgagcggtcttgaagtagttatcaacggccttatcaccagtatcgggcgccttgaacccatcgtcttggtcttctttatcaagggagaacgggaagtggttagtcacggtgagatacttcacgtaaaatggctgttgcaagcgttgcagatacttcacggagtcgttaaagagcaacttgtccttcaaaccaaatccaagtgatttatcaccagaagtatcgtagtaactggcatcaaagaaatactgataacctagatttttataagtgttatttcggttccagaaactggccacgttaccgtggaacacagcagtggagtaacccgctttttgtttgagaatcgatggggcaccctggaacgtattgtcgctgccaagctgtgcaaacaatgatccttgaggtaaaccataagtgctggtttccaacatgttctcggcatcactggtcttaccttgaccaacttgatggaagaagttgtcaaaagcgtaggttgactgactatggtagagcttgtttaaaaacggtgttacttctctaccatcgacttttttatcgatcatgaactgctggaaactttccaagtgaatcacaatgacgtttttacccttggccttaccatagtaagcctggttaggtttagcgtaatgtttatggacaaactttaaaatatcggttagctctgattttttggccgtagcgcggacgtcactgttgtgttgagtcttcatcccatcatagagggtaaaggtgtctaagccgagatatttgaccacgtaagagcgatcaaaggtcttggtaattaactgtggccggttcatttcactgactgccatggtcaatccaaaggctaagaagccaagtgacgtgacggcgaatcccgcacgccagtttagcttttgatcgtcagttttaattcttctggtaaacagtaaaataacgatgacgactaaatctagccagaagaaaatatcgtgaaagtttgtgagcgcaatcgaactgccgctaagcccctggttgactttgttatatcccaacatggtagagacagtcataaagtctgtaaactcgcggtagtaaatcacgtttaggtagagtaacacggtatttaagatatccaatacaatgattgacgtataaaacagccgggtacgcttaatgtaaagcgccaggctgtagaaaataattgcagttggaatcgggtttaagatgtataaaatcacctgcagcggatcgttgagagtgatgtgaaaatcaacgaagtaggcgagcagtgtttttagccaaaaacagaccagcaacagggtggcaaaaccaagtcgcgtgtccgttttttgccataagcgcttgataaactgcaaaataatgactcctttttacgacagattaattcttaatgctcactagtttagcagactttcggggtttgtgccgtattcaccgtaaaatttatcaaaatgtaagaagtcagcggcctaagttaacgctttcattttcatccttttgttccttacggatggtgatatacttgaagtaacttaagaaatgaggtgtcttttaatgactaaactcaatttatacgttgtccgtcacgggcaaacttattttaatatttataataaattgcagggctggagtaattcaccgcttactcaaaaaggtattgatggtgcggttgctactggtaaacgcttagctgacgttcactttgaggctgcttattgcagtgatacaactcgggccatggatacggcaaagctaattttaaaagaaaacaatgcttcggcagttaaagaaccgcaaacgacgatgtttttccgtgaagagttttatggctattacgaaggtaatgatatggcgcaagcttggtatttagccggggcacctcatggcttgccaacctttaaggatattgtgaccaagtattcgattggtaaggctaaggattatttgaaggaagcagatcctttccaccaagccgaaaacaatgaggaatattggaaacgggtggatcaagggtttgatttgatccgaagcaatccagatttaaaggatggggacaatgtgctgttaattagtcacggtaacacattgttaagtctgatggagcgttatggtggcggcaagtatgatttgacggtgcgtccagcgaatggcagcctgacgaacttaacgctgaccgatgatgatgtgattgtggaaagttataataaataaggtgcggagtcaagcggttagagagtggagcagaaaggcgtccaatggaattccatgaacttgggaattctgttggacgcctttctgtgcaactctctgcttggaaaagcccgattgagtaaggtgtggaaccaagcgattagagtgcgaagtgtaagcgcgtgataactaaaatcccgggtttggattttggttattacgtgattacatatagcactctgcttggagaagcccgattaggctacataacagtcgcaagtgcagttattcaattaataacttattcatccgcatcccaactcaaatcaccatcatcactaaagtcaacgttctgcttagcgtagtagtccataatagttggccgcagtgattcaaattttggtggtaatcccaaactattaccaagtgtcaggatgggttcatctaggctgaagccgggagtcggtgttgccagttcaatccgattatcgccgggttcacgaatgtagaggctcttaaaccagccacgatcccgatacatttcaatgtcccagccttgttcttctgccaggtggtaataacgtagtaattctgcttcatccgcaactcgtaaagccacatggtcaatagacccacgaccaaaacgggttatctggctaaagtcagtggtttgcaccagtttgatttgttcagcgccttccaattcaacaacgttattagtaaccgttaagtgtaatagtttttcaaaaaaggcctgtgaggcacttacatctggcacgtgtagctcagtccctatgaagcggctgatttggtacttagggtcgatgccgttattgggcacaatttgccactcagtgagttgatgatcagtttcaaccatcgttactgggatttgatcaggatcgtcaaacgtgaggttaccgtccgtttcagtcacggtaacacctgcgttagaaagccgattttgccagaaaactttgctaccagttggaatggctagacggataccatttataaaatgattaccgtccgttcgatggcctagtagtggtaaaacgaaaaaggtaatcactgatccaggtgtacccaaataatcgccatagaataggtgtcgaatgtgaatgttttcttggttaactgagttcttgactagccgtaaacctaaaacatgtgtgtaaaaatgaatattctgcttagcgtttttcgtcaaaagtgaaatgtgatgagtttgcacgatacccgcctgctttcgtaattttcttgccccaagtatagcatatcgatactaaaaccccgctgatttcgctctttagaagtggggtataatataacgaataaggagtgtgagatatgaaaattgagtcagcagaaaagacgcatagtcaagtatatgcggatgcagctagtatccggcaagccgtttttgtgaaggaacaggggatttcggcccagttagagtttgatggtctagacgatcaggcgacccactacgttggctacgttgatgggcaaccggtggtgactgctagaattcgatatgaagatcaggtcgtacatattcaacgggtagcagtcctgaaatcgtttcgtcatcacgggtatgctatggcactgttacagcaggtgattgctaaaatgacaccaggaactcagttagaactcaatgcccaagcaacagccattggtttgtatgaccaactaggctttaagcaaactggtgagccgtttgaagaggtcggtataaaacatgtcaagatggttaagcaactataggaagattgattgatgccattaaaaaagcttggttgccagtataaaactgacaatcaagcttttgttatatgttcaaatattatatgtgtgaattaattttgagatgcagtagtactgaaatcagtaacgtgtgcgtaaccaacaacgtgccaccatggtgcgtgaaccttttccttcaccacaccgcggttttgtgcatcaatcattttaccgttaccgacgtataagccaacgtggctaatgctacgggtactgtaaccaaagaagactaagtcgccctttttaacgttagaaccactaacatgtttgtaagcattgtattgtgcttgggcagtccgtggaattgtaatcttagcagcttttttgtaaacataactcgtaaaaccagagcaatcaaatgagtaaggaccagttgcgccccaaacatatggatgacccagcttacttttagctgtagtataaacggtgctgtaagttgcgtccgtgcttgcagcatgtgctgttgttacctgtgcaccagcaactgcgaaactaaagaatgccacgatggcaataatactcttcgtaattaaattcttcattgaactaaaaacccctaacttatccgtcttttatgtacaataattagtgtacgtgttaattatttcagttatgtaacaaagtagtgtcaatgacgttaaacaatctatttcaaattgtaatttacgtaataatttcacaataacaccccaacttttctgacaattcaagattttgaggtgactaactttgctcattaagtcagaatgtgaaataataaggttgcaaaacctgagaggcggttatgaaatgaagtatcaaattcctaatatagttgatttcgacaaatttgtatttcggattggtgaactgagccgaatgacgggtgtctcgtctcgtcagctgcgctactgggagcagcgggattatatttcagccattacccgtgatgatcaaaataaagcgcgcgtctacgatttttatacttttcttcaagttagtattattaaaaagttattggatgaggggtaccgacttcctgctgccgtggaaaagatgagtagtattgaaaaagaactttcgttgtccagaaagttctttcatgccgcgtttaatggcgtggaggtagtagacggccaggtgtttttaaatctggggtattttgataaagctaaaacccaaattttgtatggtcagtatgaaaacgggcaggctagttatgaagttcgaccagctaatgatgattaactaaatatgaaagcaaaaaacaagcactatcccgataatttcgagatagtgcttgttttgtttactgattcattattttgcatgtcgtttcaggtgaggccgttttgaaggcaacgtgatggttaacttaccaactgacgtgacgataattggtaagataatgtcgaagatagctgttgcaaacaaaatgatcaggcctgcttgagtcagtggtgcaaagttagcactgaacaggactaagcagattactagtactgtaaagacttggtaacgaatgatctggcctaatgagctgacgcccggtaacagccaatccatcattgtagcctctttgaaccgatagctgattgccagttgaatgagcagactaacactggttactaataatggaacagcagcgatcagcggtacttgccagttaaagcttggatcgcctgacataaagtggctggtaagctgtgcaagctgagtgccgcccataacggcaagtgccaaagtaatcagccagtagattggctgtaagactgagccacttagcagtgccacgatcaagaaggtgatgacaccaatggttaaaatcagccaaccggtgttagctctgacagaatgttcgatggtactttgaacaactggctggccagtataagcgattttagccttgcccagggtcgtcccttgcagttgggtgttaacttcagactgcaactgcttgatggtagccgaattgttatggctagatgcagaattctttaagtaaacttgtaactgagtagtcttatagtcttgactggtgttgcttagcaatgactgctggaactgcatgccagttaactgttcaggggtaatgtaataaaccttagcagcatccgaagcctgtaaagctgatagataactgtagatattgttataagacttgatcagaccgttcaaactggacgtggttttctttaaactgtcttgaacggaggatacttgagatgcatagtctgaaacgtttgactggacagcttgaccgtcattaccagctgaagttgcttcgtcgtttaagactcgcatgttacttgcaacggtctgaagctgactattaaccaagttaagtaagcgttgatagtttctcacacggctggaagcagatgaactttgcgaaacactagctcgaccagcaacttcagagacttgtgaacgaactgtgctagtatcatctgctaactggttcgttttggaaactaaactgtcaagcttgtcggcggattcgctcaacttgacttggctaaggtcggaacggttgcctttaaggtctgattgaagttgagagagctgatcagtggcacctttgagtgtcatgttcatctggttcaactgcgtattgacgtagtattcgttcattggctgaccgttcggttgagtcagtgaagttacgcctgaaacaccaggcattgattgtaatttagaagttaaattatcaatttgaagcagggctttttcgttatcgacccgattattgctacgaatatagatggtgactggtgttgctttaccttcgccaaagtgcgcattgaggacacgcataccggcaatagcttcattattaggggcgactgttttagcagccgagaagttcaagttgtcccggtataaaatggcaaatggaccgacaacgtacagcacagcaataatcgcaacgaagggttgccagagaccaaaacgtgccatccaattccagaatcggtgtgggcgtgaaggcaagtcaacggctggccagaagaaccgttcgcccaagagttgcataaagattggggcaatggtgtaaagaccaatgatagtgataatcgtaacgaaggctaaaccagacatggcacgaatggttgagaaactgaaggcgtaaaagctggcaaaaatgacggtcagtgtgcccccaagaatcaacaagaagttacgtacagaatgaacactatgcgtggttgcttctaccgcgtcttgcccagcagctacgttttgcttaaacgcgttaaagagatagtagtggcctagagtacccaatattaatgtcagtaatagggtcaataatggcaagtattcagaatacgggaaactggtacgactggccaaattattaatcaaacctaaggaaacggcgtacatcattagcatggataacgttgaaattagaggtgcaatcaaggatttgaagatgacgccgatgatcagcaggcttagtatgaaaccaataatagctgcaaaggtcgtgacgtggctaatattttggttagcagcatcgttaaccagttctgggctagtcaaataagttgatagaccaacagttcgaatctgtgatcgtagctgtttagcaagtacgcggggattcccctggttttgagcaattgccagctgaacggtttcggtggagccgtctttagagtagaactgacttttggccgtaggattcgtggtcatagtttgaatcgactgaatgccataggttttttctttttcagtcaaccgttgaacagtctgatcaattttagactgctgcgtggcagtcagcttaccgttggggttattgaaaaccacggtgacgtgtgatgtaccagattggcttcgtccccaagtgttttgcatgcttcgggccaccataggctgactgttattagccaactgcggctgacctttagattgaatcagatcagaggtgttaggcatcatcacaattgcaacaaagattgcaatgagccatagcagcaacgaaaagattcgttgtttgtgtaactgacgtatccgctctttcattgaataatatctcccttaaaatgtcgccactgatggcgcatatatataactactatattaacatagccgataggggtttgtatttcaattcttaaaattgaaataattaaccttttaggctgtccgacacctgataagtgcaatttttagtctgatcagccattgtgaaaatgaattcaattcaaaatactattaattgggtcaatttttgcttataattaactttcttgaaatgaagggtgtgaaaagaccatgtcaaatcaatatcaaagtcgctttgccggattaaatacaaatcaacggttttcaattgcaaaacaattagctgctgattatcatttggatatcagccaaattctgtttacctatttaaaggttgcggaaccaattctcaaagaagcacaacctaagcaacagatttctgaaaatgcacagaagcaaattgacgaacaattcgaaaagatcttaaagcaactcagtcaaccaaaggagcggtagcatgtgtacgagtatctatcaaatcgcgctggatgggacacatgtattgggaagaacaatggattggcattcaacaggtgctggaccggtatttgttccgcgtcaatatcactggcgttcagtatatgataatcaagcttatcaaaatcgttacgccattgtcggtagtggtggtgctcacgatgaggaaatcgatatttctgatggtatcaacgagttcggtttaagcgtccaaaaactgacctttgctaatggggcactttttgatcaccaaccggatctgaataagcactccattgcgcccttcgaattaccactgtatcttctgggtcattttaaaacgattgcggaaatcgaagcacacatgaatgaaattcagttaatgagcggtgaacgggcgtttaaaccctatggctatcctgaacttcacttcgttgccgcggacgctacgggtcgaatcgttgctattgaaacttcagaaaaaccgctaaaaatatacgagaatcccttgggcatcttgactaatgcctatgatttcgagcgacagcttaaccaactaaaagattatatgacctttacaccagaatttgaggctggtacggtgccgttgaatacaccacgggtaactacaggcaacttttcgggtaagaaggtaccagccggatcatacacaccaggttcccgctttatccgggcagcatactacaaagaacgtacggaccggccagcagatgaagaagcaggtatcatcagtatgtggcatctgttgaatggcgtatgcgtacctaaaagtaccgcttatcagcaaaattattcgatttaccgagctgcgacggtgacggaatcgttatcatactactttgagtcctataaccggttaggtgtcgttaaattacagctgacaccagagatgctggaacgaacagcaccggtgatttaccaaattccagatcagttacagacattcagtttaaattaatgaattattaattcttagtcaatgaagggacatgttaaactaagcttagtattaacaataattttgatgaatggagacacagtttttggccaagaaaaaacgccgcagtaaaaagaataattcacagggtgtagcaacattagtctttttgttagccttatttgtcatcggtggcggactaggtgtacgctatgtcatgaataattatctggctaaccagcagactcaaaccaacaagacagctaatacggagacccctgaacagcgccagcaacgtcagtttattgattcagtggcaaaacccgcaatcaacgtttataaggataaccatcaagtgttgccgagtatcgtagttgcacaagccattatcgaatccaactggggccattcccagttgtaccaagacgccaagaatccgtttggtatcaagggaagctataacgggcaaaccaaatcgtttccgactaccgagtacgttaatggtaaagaagagcgaatcaatgctaacttccgggtctatccgaatttggaggcggcaattttggaccatgacgcggtggttgcccagcagtttttgccagcccacgtcactaattaccgtactgcggcaagactattgcagcaaaacggctacgcaacggatccttcatacgccaagaaattagttaatgtcatcaatacttacagtttgaatcggtttgatggttactaaaatattaaacttcccgcttgatacccttgggtgatttctgtatgatacaaatattaagaccacgataggagagatgtttgagattgtttgatctaatcggaaagctttacgggccattttttgatttgcataattgggaaaccgtcatcagttcaggtagcgactggctggtgatcttttcactggtactgatcgagtgtttactttcagtggataatgcggtggtactggctgcacagactcaagcactgcccaccaaggaactgcgcgaaaagtcgctgttttacggcatctggggtgcctatattttccgctttctgattattggaatgggcgtttacctgattaatttttgggaaattaaagttttaggagcgggttacctgctcttcttaacggtgcaatatttctccaagtcacgagttaagcatacgcgtaaattagtgtccggcaaaaaacggcgtatctcgctgttttggtccgtggtcatgcaaattgaattgatggatattgtcttttcaatcgactcggtactcgcttcactggcgatttcgtctaatccagttattgttttgattggtggcttgatcggtattttagctatgcgtggcgtggctgaactgattatcagattaatgcgtttcattccagaactcgaaccaatggcatatggcttgattgctttgattgccgttaagttgtttgtaagtattccgatgattgatattgaaatttcagcgactacctttggacttgttgtcctgggcgcagtcgtactcacagtgatgattcactttattcgaagaaaggggaaacggacagcagatggcagtcacgataacgaaggataatttagctgaagaaactgctactggaatggtcctcgttgatttttgggcggactggtgcgcaccatgtaaaatgatggatccggtgcttgaacaattggaatcaacgtatggggatcgcatcaaatttggcaaattaaatgtggaacataaccaagatttggctatgaactacaaagtgatgagtattcctagtctagtccttttccgcgatggtaaggccgtcgaaaaagtgacaggcgtgtatcctaaagataagttagccaagtatttagataaaaaattagcaaccaattagggggctttatttatgaaattaggatttatcggtacgggtgtcatgggtggtgccattgcgggccatctgttagatgccggtcatgagttagtagtttataaccggaccaagtccaaaacggatgcgttggtggctaagggtgcaacctgggctgatgcgcctgccaaagttgcacaacaagcggatgtcatcttttccatggtaggctatccaactgatgtagagtcgatttatttcggcgatcaaggcatcttcagtacgttaacagcaggtaaaacggtggtggatatgaccactagtaccccaacgttggcagaaaaaattgctgcgaaggccgaagaacttcacgctcatgcgctggatgcaccagtttcaggcggtgacgttggtgctaaaaacgccacattgacggtgatggtcggtggtgatcaggcaacctatgatgcaatgaagccgttattcgagttggttggccaaaaagttcatttgttcggaccagcaggcaagggtcagcataccaagatggctaatcaaatcatgattgccggtaccatgactggaaccgttgaaatgatggtttacgctcagcatgccggtttaaagatgacggatgttttggacacgttaagtagcggtggtgctgataactggagcatggacaactacgctccccgaattctgaagggtgattacacacccggtttctttgctaagcatttcctgaaagatttgcggatcgcgttagatgaagcggataaaatgaaacttgatctacccgcaactaagttagccaaacagctctacgaaaccatggttgacgaaaaagggctcggtgatgatggtactcagggcctcattaaactgtatgaaaatctttaacgcaactaaaaaagctaatggacagttcaactgtccgttagcttttttggtttacgtactattcttgtaagtcggagaagaaactatacagcttttcctgtgtcagttgctgtttttcgtcaccagaaacgtcgtaagtaatcttcccatcactgatcactaccagtcggttaccatacttaagagcatcatccaaatggtgggtgatcattaagcaggttagattttgagcaatgatccgttcgttagttgcggtcatcaactcctgcgaggttttgggatctaaggcagcagtatgttcatccagtaataaaatatctggttttttcaacgttgccattaagaaactgagtgcttgacgctgaccaccggataagctgccagtgggtgtggttaagcgttcattcaacccgttgcccatgccactagtcatttctttaaactcagccatgtgctgcttgagatgacgtggcgttaaatggcgatgttcgccgcgcttagttgctaataacaagttttcagctacggtcatgcggggcgcggtgcctaactttggatcttggaaaacccggctcagaaaacgggtccgccgttcttcagattcgttagcaatactttcgcctcgaagtaaaatgtcaccggagtcaatggttaaattacccgcgatggtgttgaacagcgtggatttaccggcaccattagaacccaaaattgtgataaagtcaccctcattaatactgaggtttaaatcttttaatagggtaagttcttcaggtgtgttgcggttaactttagtcaccacgtgttttaattctagaattggtttagtcatgagtagaaatcccccgtttccaaacgcgctttaaattgaacatatcccggaagactggcaccatcatgcaaagggccaaaacaacggacgagaacaactttaaatcgttggtgttgaagcccaactttaagacgactagcaggacgaaacggtagaggatcgaacctaaagttacggcaaccagtcgttgattcatggtcaattcaccaaaggcaacttcaccaataatgatagaggccagcgcaatgacgatgaccccaattcccatgttgacatcagcgtaaccgtcgttttgagcaaccaaggcgccacctagaccaatcacaccgttcgacaccattaagcccatgattttcatattatcagtcttgatgcctaatgaccgggccatcttctcattatcaccagtggcgatgaaggcttgaccgaggtcggtttgcaggaagtaaattaggactaaagttaagataacaatcacggtgaagccgaggaacacactgtcaaaatacattggggcgtgtgcgaaaataggtaatttcagtagtgagggtttatccaacagtgtcaggttagaccggccgtgcatgattcgtaagttgacggaataggccgcggtcatgactaaaataccggctaacaaaattggaatacgtcccttggtgtataacaaaccggttgctaaaccgcagagcatacctacaccaatggcaatcagtgtggcccagattggactgatgccgttattgattgcggcaacacaggcagcggctcccattgggaaagtaccttcaaccgtcatatcagggaaatctaagattctaaaagttaggaaaagtcccagtccgagggttgcccagagcagtccttgaccgatggcagaaacgcctaatccaaatgtcatttgatgatttcccccttcttttgtgcttctttaactagtgagctagggaaggtgattcccagccggttagcttctttcatgttcaggatcaaatcaccgtggcgaatgaatttaatcggtgttgtggctggctttttgccctttaaaatatcagcagtcatgtggccggttaagacgcccagcttgtattggttgatactgtaagtggccaaaccaccgcttttaaccatggtatctacggctggaaaaacgggaattttagcagcgttagaattcttgatcaaggtctgcatagctgaagccaccgtgttatcggtaggaatgtaaacagcgtccacgttttgaaccatttgctgtgatacttgatccacatcattggtgttagaaatggaataggcttttaagttgatgtgctcgtccgcacataactgcttgaactgcttatactgagcggcagctgaatcgtcgctggacgtataaaaaatacccagtgtcttcatcctcggtacaacttgtttaatgaggccaagctgttcttttaagggtgcctggtcggacacacccgtgatgttatgccctggttgctggttgttcttaaccaggccggcacctttaggatcagtaactgcacctaacacaatgggaattttagaagttgcgtttgctaaagcctgtgctgaaggtgttgcgataccaatggttgcgtcagcatcttcgttaacaaaacggttactcatggtcatcagattactctgatcattttgcgcgttttgaaaatcgattttgatgtttttaccaggatgatagcccttttcttccaaaccgtgaataataccgtgatggatagaatccagagcaggatgggacatgagttgcaaaataccgaccgttggcttggcaactttagcgggcttacccgttccaccttcaccaacgaaagcgaaacctagaaagataacaataatagcgattaaagcatatagtcgcttcatgattcgattccccaatctaaaattaatttgaaataaaaaaggcgaccccctcgcagaagtcgtctaggaagcgcgacgtgcaaggttagtcatgcagcgtcactcatatggcaaagcaaccggcaagacacgtgtattgaacatgttgttcaaaccgcatcaaatagggcggtttggttaccgggattgccaggaactaagttgcttagcgtactttgtcatttgaattcctccgaactagaatatctactattataatgaccagactatcgatacgcaagcgtcacttgtgtttcagcggtcttgattttgatgtaaaaaatgtgaaacaaaaggacccaatcctgtaaacaagattgagtcctttcgcgcttgataagctacattagtagttatcgtgactatattatacaccatgctttgtcatatagaaacaaaaatatactttttccgcctagagaacggcccacagattattcataaaatgcagcgcaatgctgtatctgagatctttaaagtgtaggtaggtaccggctagtacccaacccaatgatgcataaaacaaagtggttacagaaaacgtcatcgtgtgcagataaccaaatagcaatccgctgataaaaacgccgaaaacgttgctccaaggcgaattttttgaaaagaagaagttgaaaaagaaaccgcggaaaaggcactcttccagtactggcgcgatcaggacaccgtaaactgtattccaaaaaggcagttgctggatttgaccatccaaggctgattgattactgggcatgggtagcagatggcgtgtaattaactgtgaccaagcaatctgaatagcgagcatgaggacaaaaagtaacagtagctggctaatacggtgccaattaaaaggttgacggccgaaatgccgtgggttataccgtttaagctgtcgatggtataaccacgtgtataaaaccaatatgactgccaccattatcagcatagccccaatgaacctgtcggctagcccaacgtttttattggcatacttagttgcaaactccaatagaacagagtttgctagatacgccgcaagtaataaaataaaagcgccgatacgtaagccttgacgtctgatataagccattttcggcacctcacttctagttgatcctaataggtaatgattttaatgagattttgatctggatcgcgaacccatagggcagttgctgaaccctttgcaccctcgtaaggcacgggtccgtctgcgatttctaccgcgtaattcgtcaggtgagacaaggtgtcttccagcgcatcgtgggtttctaacgctagttcagcgctgcctggcgtaaccacgtgagcggtgataacatctttatcattaggtgttcggaaggttaaacggtggtggccaagctgcaaagttggctgtttagcgttcttaatgattggcaggtcaaacacttcatggtagaaacgcatggcgtgattgacgtcactcaccgttaatgtcagactatcaatatctttaatattcaattttgtcatcctttgtgtgattattgtatgggcattattataccacagacttgaaagtcgccagttcagtactattcgataggtacttccaaaaaaattataaattcggttgtaagcgtccccatctctttcacaagtataattaaacgatttgggaacagtgtttgagaaagcccgatatcatgccttgtttcggcttcatttcttgctattaaaatcgtttcgtgatagggtgaagtgttgtgaaaaaatgaaaatgaacttaaatttagcctttaaaggctgtttaaatgatggtgttccggcaagctgacaattttggctaggggacttttgacgaacttgttagatcagtttgttggaagtcccttaggtatcctgtttaaaagcctacctctgcaccccgattaagggaggtaaatcgaaaaatgtctttactagaagttgaaaaccttagtatggcttttgctgacaaacggctgtacgatgatgcaagttttcagctaaataagggtgagcatatgggaatcgttggtcaaaatggggttggtaaatcaaccttgatcaaggttctgaccggtgacgaattgccattatccggttccgttaagtggcaaaaagggattcacgtgggttacctggatcaatacgctgatattcctgatgggatgaagctgattgactttttgcacactgcatttcaagatttgtacgataaaaacgcccgtatgacacaactgtataccgattatgcggaaacggctgacgataaactattggaacgagctggcagaattcaagaagaattggaagccagcaacttttacgatattgaaaccgaaatcgaacggattattactggccttggtcttgatgatattggccgtgatcatgaagttgctcaaatgtcgggtggccaacgttctaaaattattttagccaaattgttactacaaaacccagatgtgattttactggatgaacctaccaactatttggatgtggcacacattgcctggctggtcgattatttgaatagtttcgatggtgctgcaatggtcatttcccatgattacgattttttggaacaggtgaccaactgtattatcaacgtggcctttggaaaaatcacgaagtatcgtggtagcttcaagtcagctatgcgtcaacgggctgaacgtgaagaagctcagcgtaaagaatacgaaaaacaacaaattaagattgagaaaaccgaaaaattcatcgctaaattcaaggctgggacccggtcaaaacaagctaagtctcgggaaaaacaactttcacatatggacttggtggatccgccttcgagtaacattcaggccagttttaactttccgtatgaagatactggttcacaaaatgcgctagtggtggatcatctttccgttggttataatcgaccactgttaaagccagtaacgttctccgtgaatactggtgaaaaagttggttttgaaggctttaacggggttggtaaatcaacgttgatcaagacgattcttggtctgatcaaatcaaagggtggttcggcacaattctctccttcggctaaggtcagctattttagtcaagatcttgaatgggaaaatgatcaggaaacaccactgaagattattcaggccaagtatgaaaaacttcctcaaaaagccatccgaaccaagcttgctaaatgcggcttggatgcagccaacgccatgaagccaatcggccaactttctggtggtgaacagacgaaggtcaagttagccatgatggaatttgaaccaagtaactttttaatcttggatgaaccgactaatcatttggatgaagaaaccaaggaagccttaaaggacgctattaacaagttccctggtaacgccattgtggttagtcatgaggtcagcttttacgatggtttagccgataaagtgctgaacgttgaaaaactaagtcttaagaatcagtaaaatgttgaccgtttcgctaaatgttatccctttgaaacattgacatgctacaattataactattaagatatgtttggagagagattatgaagcgggttttgcaattcattaccgtcattgttgcacttgttgtactgggggttacagcgcatcatctgatgacgccaacaccaaccaggagcgatcagacagcgcgtacgacaaaaaaagtgacgacaaaaaaggctaccccagttcagatcaattggcgtaagccttctgaaaataaaccgtatccgaagtgggaccaactgaaagatccgtgggttcacgtttcggtgaaacagcagcgggtctacattaaggatggcgataaaacggtttataccatgtttgcttcaacgggtgtggataattccacgcctcgaggcacctttcatatccaggccgaacgcggtaagttcttctataacgcgcagtctaaagaaggcgctaaagattgggtgtcatttaaagaccacggcgtctatcttttccacaccgtcccaactgatcagtacggtaactttaatgtcaaagaggctaatatgttaggtcgtacagcgcattctcatggctgtgtgaggttagcggttccggatgctgaatggttttataataatgtcacttacggcactaaagttgtgattgattaaataatgcaaaaaaggtttcgaactcgtttgagctcgaaacctttttgtattgtttgagatgatgtttagtcgttaaagttgttgccctcaacatcacgaataaaggttgccaaatgatcgtaataaactggcgcgttatcgatcatgtgatggtgaccaccttcaggagtggttactaaccgtgcgtgtgggatttctgttgccatgcgcttggcagtggcaattggcatcgtttcgtgttcaccaaaggtcagcaaagtaggtactttaatttcctttaagtgtgactcgaactgccattcctttaatttaccagtgatgacaaattcgttatcaccttggaaagcaccgtaaacgggacgtgacatggttggaatcaagtgggaaatagcagctggctttttccggtcaacgtaaccgtcatttaagacatccacgtacttttggtattgtggatcatcgtagttgttggcggcttcttgcttcttcatgtaggccactgcgtcagctggcaaagcttcttcacggacttggttgatgtgagtgacgtattcatcgatgttatcgaccattgatgaaatgatggcaccctttaaatgttgaccgtacttagcagcgtacatttgtactaaagcgccaccccatgattggccaattaggtagaagttgtccaagcctaatttttggcgaacttcttcaacttcatccaagaagtagtcgtaagtcaggtacttttcagcaatttttggatcgctgtagtcgggttgatcagagtaccatgagcctagttggtcgtacatatgaacctgaacgtttaatccctgtttcttaagttgctgagcagtgtcttcccagtattcatggttgccaccggggccaccgtgcagtgcaagcaagtgaatatcgccttcgccctgcgtgttggtccacagatgatagccgttatctagcgtaatgatcgtggtgccttgtctcatgtgaattacctcgtttcaaatttgaagttaactaccataatatcacgaactctataggtggggaagctctagccagctattagccagcgagattgtgtaggtgatgttttggttaccgcgaacggtcatgccaaagtccgtggcataaacgatcagccctaattggtgacccgcagtaagtcgataatgagtgggttgcagttccagtgtcactggataaacttcgcctgatgtaatggtatctacttgggtcaaagcagttcgattctgtaaattcatgtgggcttttgaaatcagctgataaggcgtttctttcttgctgagttcatactcccgcaaatcttcttttcggaagtggtctcccaccgccatggcttgccgtgccagcacggttggcagtggattcagccgcttgaagttacctaagtcaactaattcggcactgatcaggccaacggattgatcagacgacacgctgaggtgtaagactgggcaaccatcgattactaggtcatcagtttgggcgggtgcctgaaaaatttgacggtggcctttaagcggggacgattttttaaccaggtcacgctgccactgggcgttgttcttagcatactgttggaaatgttcatcatctaattgatcgttaaactggatcgtggcttgatcagttgtgccagtggagagcccgtcagtggttaaatgatagtgagctgtgtggttagtggttgcaccccaatcgggataagcctgccaggactcagcactggcgttatcttgaatcaatacatcaggtaagattttttctgcatgattatcgagatcatagagttcgtgcgacagccaaagattgaccatgtcggtataatccagtgaacggaaattattgatgtagatgtgcggtccttgatgcaaaataagtttgcgacggataggcaggtcactaattgcgcgccagagcttttccgcgttgcgcggtttgacgttccagtcgttaagtccatggacgatcatgacatccgctttgattttcttggcgtttttacggtagttgcgtgcgtcccagaaatcgttgtagttacccgtatcacgatcttgttcagttgtaatggctgccagttgctgttgccacttttccttgatgcgactgtaatcacctgcttgttgctgacgggagaaggtctcttctgccaggacatcggcatcttcgccagggaacccgcctggggcaatgaccaaaccgttttcacggtagtagtcgtaccaactggaaatcccagcttcgcaaataatcgttttgaggccgtccactccggtagttgcggcagcggtagccagtgtgcccaaataggagcggcctgtcattgctacgtgacggtttgaccaggtcgcagcgatggcaacgttagatgtgcgattagtgaaggcagttcgtttgccgttcaaccattcaatgactgcaatggttgacgttgtttcttccgggtcgccagtggttcgtagaccgtctgattccttggttccaataccggctgcgtataccacggcaaaccctcgagcaagaaagtagtcgtttaaactataatcaaacgtattaccgaaactttcatcagcttgattggtgtgagtattgatcacccgtggttccggcagtttagttggcactgattggttgtcactcaaggtgttgggtgttgcaggtttttctttcaacgggacattgacgttgtgtgtcaatgcgtcaccgtcagcatcgttagttccttgattgtaaggtgaagccgtataaaggaccggtactggttgctgatttgattcactgggacgagtaatttccaccttcagcaggtctcgcagattatcgtggtcagtatcctgagaagattctacatagacgacttcatggatcagcttggtggtgtcaaaaacgggctgagccttaccattaaagaatagcggtttgggcaagtcgtcgagtcgatggaaataaccgcgtccggctagctgatccagaaaagtttggcccgtggtggtatgggtaatgagtagttgataccaggcgtgaagcaagtcatcgttagtcaacgaatcgtgttcaaattcaggtaaattaactttggaattcagtgttgctggcgagtcaatctggaaatctctgccagcttcaaagcctaagagttgcaagatcagattataaatatgtaacggtttgatgtcaccactaatttgggtcagtgacagcgcgtctaactggtcagcagccagcaagttagcaattttggtatccgcagcttcatgactggtgacctcggggaaactttgttggagtaaacgacgtaataaccggtgaggtgtgagttgtaaatcagcttgacggatgaactgaatttgcagtaattctttcttttcgtcagccaaagttgtgggtgcaattgcaaattgattaattttcataaggtcattcctcctgcaggtgagtattgtttccattataccgcagccatgccatataagccgagctgatagccaggggtgtttgagtcatgatacactgtaataataactaatgtgaggacaaggatagaaaggaacgttgatgtgaactatattggcgaaatagcgctaattttatttgccactacgattgctggcgcgcttagccagcgaatcgggatccccagtgtgattggtcagctactggtgggcattttactcggccctgctttactgaactggattcggccaggtgagctgttaacggctggagcagagattggcgtgatcattttgatgttcatggctgggctggaaagcgatttaaaactgttaaaaaagtactttaaacccgcaatcagcgtggcaactatgggtgtcattttacccatgatctgtttttatatctacggtgtgttcatgcaccaaaactttgaacgtgccatcttttggggtgtggttttcgcggccacttcagtttcgatttcggttgaagttctgcgggaattcggtaaattaaacaccaaggaaggtgcgaccattcttggcgccgccgttgtggatgacattatggcagtactgattctgagtgtttttgtcagcatgttttccagtggcagtcgtagcgaacctaatttactgctcagtattggtgaacagctcgcttattttgtggtagtttacgtggtgattcgctggattgcaccgcttttgattcggttatttgaacacttacccgtaccgcaatcagtgccgattatgtctttgattatttgtttaggcatggcttatttagctgacttaaccggactgagcgctgtgattggcgcctttttcgcagggatcgccgtggcgcagacaactgcaagagaagaggttgaaaccaatatcagtcccattgggtacgcgtttttcgtgccgattttctttgttagtatcgggattgaaatgcgctttgatcatttctggagcaacatcctgctgattctaggaatgaccatcgttgccgtattgtccaagctgattggcggcggactgggagccaaaattttagggtttagctttaatagttcttacgttgtgggagctgggatggtttctcgtggtgaaatggcattgattatcgcccaaattgggtatcaggctaaacttttagcgccagagctgtattcggagttgatcgtggtgatcatcttgtccacggtcattgcaccgttgttgttgaaacacgctattgctaggctggattcatagttagttgagaagatataatttgtctgttttgatatgtgaagttcaacgtcttcttaactgacatcttgctaagaatatacggatgctcgatactttaatggggtctaatcatgttccgcaactcagattccggccatataagatgaataacccccattccaacaaaattcatcggaatgggggttattcatcttatattctggaatctaccgaattgctgcacacactattctgcattatccggattattcaaccggctgtggtgcataccataactgaagtacaacacgaggccaaacaggaaccagatgccagaagcaatccaagtttcagcttgcagctgagttaacatgaataggcacagaaagcctgaaacgattggtagtaccggataccaaggcacttggaagccttgattattctcgatttccttgttatggcgcaacgggatgatgccaaaggatacgaacaagaaagcaatcaacgttccaatgttaaccagattggtcaattgatccagtggtacgaatccacccatgacggcaatgacgactgtaatcgttcgaagactgttgatggggttcccatgacggtctaatttacccaagaacttcggcagtaaaccatcacggccgacagaataaattaaccgtgacgaactgtagatcatggtgaccatcatggtaaacattccggctaaagcgcccagtgcaatcacaccggcagcccagttttggtggaccacttgcagcgcgaaggaaacgggatcggcaacgtttaacttcgtgtagctgatcatcccagtgaggacgatagcaaccagaacgtacagcaacgtcgcaatgatcaatgtcccgataataccgattggcatgttacgcttggcattcttcacttcagcagctgagctggaaactgcgtcaaaaccgaggtaagcgaagaagacggctgatgacccggccaacacaccgtgaaagccaaatggcatgaaggggtgccagttacctggcttaatgaagaaagcaccgaccacgacaaacagcaaaataatagcaattttgacgaaaacaataatgttgtttaatcggacggatgatttcaccccgtgagccagcatcaacgaaatgatcagcacgatgataatggcgatccagttaccataggaaccatgagcgatgtctaaaggaccgacgattgacgatggaatatcaacaccaaagccactcatgaaggacttaaagtaggccccccaggcactggaaacggcggccacggccagcacgtattctagaatcaaagcccagccgagaatccagccaatgatttcaccgtaaaccagattgccatatgaataagcactcccagcaaccggtagggcagaggcgaactcggcgtaacacatagccgcggtggaacatactacggcggctaaaacgaaggatagaataatcccaggaccggccttagttgcagctacagtaccaggtagaataaagatcccggtaccaataacggcaccaatcccaagtgagatcaagtcaaccgctgacatggttttgacaaatttcttgtcagtttccaagtaacggtcaactttttcccggcgaaaaagacgcgaaatgaatgatgacatataacttcctccaaattaaatattgaaaagaattttaagtccatcttaaccatgttagtcgttaaaagcaatgcacagccccagtactggcatgttcatccccgtcaagttttggagaaatttgtctaaaatagaatttcccagtttgcttgccacactgattaggctaaaataagagttattaatattttcggaagaaggatgatttaataatgacaacggaagtagctagcggtgcagtggtttatcgggttcaaaacggtcagccagaatacttgttgcttaagagtgctaccagtgatttctggggcttccctaagggccacgtagaaggtaaggaaaagttagacgaaacggccatccgagaaattcgtgaggaaacccagcttcacgttgaactcgatacgaattatcatgatgaacttaaatatgaactacccaacggcaatcataaagaggtccacctgtttgtcagcgaagttcccgttgacgttcgaattaagaaacaagacgttgaaatcagtgattacggctggtttaacgaagatgaagcggttgatcggctaacctacgataatttaaagcagttgatgaaacgggcacaccagtatatttctgcgaaaattacggccaataaatagtgggggaaatcatgaagcacgtcattgtcattacgggtgcaacgggaaccggtaaaacaacggtgagtacctatttaaaaactaaatatcagattccacggatcatcacgcacaccactcggccaatgcggcccggtgagaaggatggcgtggactattattttgaaacggatgccagttttgccaagaaccattacctagagtcagtgacttacgccggttatcagtatgggtcgtcgtatgagggactccagcgggcgtttgaaaagtccgatttagttagtatcgtccttgatactaagggagctgaaacctacgttcatgatttgaaggagcaggcgtttattctgttcttaaccgttggcaaatcggtggtgctgcatgaaagactcaaagatcgcggtgaccagctagagatgattcaatcgcgaattaaaagcaaggagtacagtcgcgatttgactttaccagaggatttaaaggggattgcaacggtgctccaaaacgacgattggacgaagacacaagaacggcttgcaacaatcgtgacaaagttgaagacaccctctttgtaaaaagcaacggacatatgtgttattgttcatatatttgtgatacactgtcttaagcgtaatcattattgtttaagacggaagtcacgtttaaagaggtgtcattaaatgccggcagaactcgcccgagcgttaacagaattaaaaaagaaccatttaaaggtcacgaaacagcgtaaagcactgttaagctatttacttcaaaatcaagatcactaccacgatgtgaccctcgttgatgagtatatgagaaaacagtttcccggaatgagccacaataccatttaccgcaatatcaaggaatttgaagaagcggggatggttgaacagcaggttcagggggaacaggcacgggtcaagtaccagtgtgatttcagccacctgcaccaccatcattttatctgccagaactgcggtaaagtgacggaacttaaagagtgtccaatggatgttttcgaggctcagctaccgggctataacatcgttggtcatcggattgagctgtatggtatttgtcctgattgtcaaagattacttgcaaagtaatattggtaaacaaaccttattcaatatttaaggtttgttttgttgtttattaataataatttgagatactaatggttaataagaaagttttgaggaggtatttaatatggcataccggacaccaccctttatcaccccgtttgcaattgtttcaattgcactcgcgctgggtgcaactaacgtggtggttaattcagtcagtcactctaaagagggtaagccggcaagcgctcgcgtgatctctaataattcggtgactgattcaaccaagcaatcggtcagttctgatagtaaatcttcgaataaaaaagattctagcagtgatagttcgaagaagaaggattctagttcacaaagcagtcaaaacgatacgagtacaacgacttctagtccgcaaacaggaacgagtaatgccaacggcacttctaccaataagtcgaagtcgacgggtggcaatacgactactaataacaataacacgggtacgaacgattctaagtcaacgacgacatcttcacaaactaatgatacgcaaacaaataatgagtcagacggaactggcgctaccagtaatactggaagtactgaccagacgacggctcaataagggggtggcaatagttgtttagtttcttagatatgatcaatcactacttggggtatgtgaacttaaacgttaaactgaagaaccgaatttacaccatccttggcgtcattggggtggtttacttactgtatgtttcggtgcgctggattcaaaacggttttgggttgcgaggcagcttgatcctgttagtcgccattatcttagcttacttttcagtcatgaacgttttctactacttcactaataaacaggcaccatttgatatttcacctaaaattgaaaaaatgcttggcaaaacactgggtgctggtgatacagcggctgaggacggtcagcaatctagacgtcaacggggtaataatcttctaaacggtgccaatattccggctaacggttattttgacagtaagaagattttacccggtaaagtggcggtcaatgcagaacagagcagcaatattgcacaactggctaatcaattgcagcagatgaagttgatgacgcctgattatggtggcctcggttcacgtgaattagctcagcagttggaaaaaactaaaaagccggtttatgctattggtctaggtgttaatattccttactttgagttacagcaggatggtcagcagatgatcgtttacgctgggatgaaccaagcacaaaaggcaccaatgggcaaaattaccacggttggacttcagcccatcgaagacgtttatgataaggtaaaactgtatcttgctaacgtcattttagttggtggtccatacatggaaatggggcgtaacgaacctatcgaaaaacaagcgccttacatgatccgcgttcaattggcttatgagcgggataagcaggcacatcgggttcagcaaaatgaagcactctctagacaagagggattttctcagtctgaatcaatgacaaatacaccaacttcacccactgcgccaacttcaaggatgagtcggtatcattaaccagagtgtgaaaacaagcgtttaaagagtggagtctaagggctcgaaacagaaattccctgaacctggggatttttgtttcgagcccttagacataactctttgcttgtttgaacacgtttagtctaggtaaaagcaaagcaccggataaatcccaaacttggatttatggtggggtgctgttctgtgcaggtctctgccttggtgaacacgtttagagaacatgacacaatttattgttttgtgaatttaagatgaataatgcgtattccagggatcttaccgggaatacgcattatttgcgttaaatggctggtttccgaggtatgaaatcaaactagacttggttgttctttatgatgatcctagttggttgccatttatattatttgagctgtaatgagaatagcattagaacgaagtgaatatttctaaaaaagtgaatattttaccgtttgatgaaaaaattatcgtagtcattaatgtgttgatttagcgccatttctgctgtgatatgagcctatatcacgaacttgaagcggtgaattgctttgaccaatggctgaatatggtttaatatttatagtgagtcaaaattagaagtagatgaaattgaacgaaatatttcagtacttcaagacgtgcacttgcagtatagtgcatctcatatgaaccaaatatctaatgaatttcagccgtctaagcgagcaggctgtatgcctctaacagaccatgcagcttgttcgcttatcttgttgtagaatactttagagattggtcactattttcttaaggcggaggggaaaaacatgtcaatgattgaatttcacgatgttcaaaagtactatggcgatttccatgctttgcatgacattaacctgaccattgatgcaggtgaaaccgtggtgctgattggcccatcaggttctggtaaatcaactttgattcgaaccattaatggtttggaacggattcaggaaggtaagctgattgttaacggccaggatttagccgataaaaagactgatatgaaccggattcgtaagaacgttgggatggtgttccaacactttaacctctatgcgaataaaacgattttggaaaatattatgttggcaccaagactggttttgaaacggccagaggaagagaataaaaaaattgccatggacatgctggatcgagttggtttagctgaccaagcacctaagatgccatcgcaactttctggtgggcaacaacagcgtatcgccattgcccgttcactagctatgcggcctaaggcactattgtttgatgaaccaaccagcgctttggatcccgaaatgattgacgatgtgctgaacgttatgaaagacattgcgcgtgactcatcgatgaccatgttagtggttacccacgaaatgggcttcgctcgtgaagtggctaaccgggttattttcatggcggatggtcgcattctcgaagacgatacgaaagagaaattctttgatgggcagccaagtaatgaacgtgctcgtcaattcttaagcaagattatcactcactaaagtcaggagatgggagcatgaagaaatttttccgattggtcggcgttatcatctctagtcttgcattagtactggtattgtctgcctgtggatcaaaatcactggcagatcaaaacgtggttacccgtgctaagcggactaacacgattacttggggtgttaaagctgatacaaagttgtttggtttaatggacgtgaagaacagtcacatcaacgggttcgaagttgatatggctaaggcgatcactaaacagattttaggacccaagggtaaagcagagtttgttcaggtgacgagttcaacccggatgccgttactgaaaaacgggaacattgatgccattatggcgaccatgaccattactccagaacgtttgaagcaagtcgatttttctcggtcttactttgatgctgggcaatcattgctggttaaaaaggggagcccagttaaaaacgtcagggatcttaaccacaaaggcgctactgttttaggtgtggttggttctaattccgttcaaaacgttgccaagtttgcaccaaaagcaagggtgctgcagctttctgattatgcgcaagccatgacggcgttgaagtcgggtcaaggtgaggcgctaaccactgataacggtattttagccgggatgtcagttgaaaaccctggctacgtattgactggcggtgccttcaccaaagaaccatatgggattgccattaacaagaatcaaccagaatttaagcgtgacttaaatcaggctttaaccaaggtcgaacagagcggtcagtataatcgccttttgaacaagtggtttggaaacgtacctggcatgaacattaaggagatggaacgatgatagctatttttcataattacggcagtctattgctccaaggattcggtcaaaccttactgtgtagtatcatcgcactggtttttagtttgattattggatcgatgtttgccatttttgaaaccacaccaatcaagtttttacgagtcattgcgcggatttacattgaagtattccgaaatattccgttgctggttatcacaatgtttttctttgtggtaattcccatgtttgttgcgaagatcaacgggtttaccgccggaacaattggtctgaccatctatacgtcagcctttattgctgaaacggttcgttctgggattaattcagtggatcccgggcaaatggaaggtgcccgtgccaacgggttatcttggtggcagtcaatgcgctacattgttttaccacaagcctttcgttacgtgattccaccactgggcaaccagtttatcaacttagttaaaaattcatcagttctagccttcgttgctggctttgacctgatgtatcaaggaaatgtgattgcgtcagactcattgaataccatgagtacctacatttgcattggtattttatatctgatcatcacgttaccgttaagttactggatgcgttatctcgaaaagaaattagcctaggggggtgcagtcatgaaggactttattaatgcatactcatggatcaacattcattacttgcttcagggcctttggattacggtggctgtatccgtagtctcgattctcggcagttacgttctgggctcgattttaggcattattcgttacgttaacattaaaatcgtctcaccaatcgtcggtttgttcatcgatattattcgtaacttaccgttgctgctgattatcttctttacctactttggactgccaaacttaggttttcgtcccagcagtgtatgggcaacgattttagccatgacggtctttgaatcaacgatgattgctgaaatcgtccgttcgggtatcgcagccgttgatcctggtcaaatggaaggtgctagagcgaacgggttatcttatggacaagcaatgtatcatattgtcttgcctcaagccatgaaaaagatgattccagcgctggtgagccaattcatttcactaatcaaggatacatcactggctaccattatcgtgttgccagatttgatgcataacgcacaaatcgtttatgggcaaaattcaacgtatattctgccaatgttcctgatgattgccattatgtacttcattgtatgttatgcattgtcgctgttgtcacggtcgttggatagaagaatgagttaatgtaaaagagtgtgaaaacaagcgtttaaagagtggagtctaagggctcgaaacggaaattccctgaacctggggatttttgtttcgagcccttagacataactctttgcttgtttgagcacgtttatgaaagagtgtgaaccaaggcgtttagagaccgtaatagaatgagcccccaccttaaatcccgaacttggatttagggtgggggctcgttctatgcaggtctctgtcttggtgaacacgtttagtctagataaaagcaaagcaccagataaatcccgaacttggatttaaggtggggctcgttctatgcaggtctctgccttggtgagcacgtttaactgatatattttgaaatagttgaagatttttaggtattatagatggagagacattttgtgtttgggagaggatgtaatgtgatatgagtaaaccaagaaaactgatgttaggagccatcgcttttggacttgctatgggcgttggggttgcgcagtttagacaaaataattcacctttgagccaagctattgtggcgcacgcggatcagagtgttaacgtgaaagaccaggggatggtcggaaacggcaaaaccgataatagtaccaagctgcaacagatcatcgataattccgatgagaacgtcacgattcacgttcccaagggtaactacttatttacgaatgctgagctagatgccatcgtgttgcattcacatatgacctttgattttgataagggtgctgagtttacaatcaaaaatggcgatcggatggcttttgtttatcctagtcccaaaggtggttacaacggtgggattagtaacattacgtggaataacgcaacctttcgtggcgattacaataagtcagatggacaaagtgttttcgtacaatcaattcatcatgctcagcatgtgaactttaataactgtacctttgataacgctgaatcaccaacagggcactaccttgatattgatggcagtcacgatgttaacgttaagaattcaaccttcactgggtttaacgcgcaaactgactataaagaagcgattcaagttgattattctaaccataaagccatgtcatatcacgaaccaggggatgtgtatgataacttaccgtcttatgatgttaacgtgactaagaatagatttgtaccgctttctaataagtcaggttcagtaaagtcatttggaccaaacccgattgggcagcacgcactctacgctaatggtgcgggtggcattattcacgatatccactttacaaacaattacgttcaggatgctaaaccgcaattgagtgccgacggagcaaacattcacttcgtctgtgtttcaaacttatatatcagcaatatggtcccctgtcaataaaatagacaatttaaatagagacttttttgtcctatgccacgactaaattttgaatttgagtttgatactcatcttcaagttgctttggtgatttgactccccagggactgtgaattcctgtgttgtaaaacgtttcaatgtactgaaaaactagtcgtttagcttcggagtatgaatggattttaaaccgatttatccattcacgcttaatcaaggcatgaaacgaccaatgcagcattatcccaaggataagctttctttgaatagcttaatgtcatgttagcgtaacttgattgtaagcttcagacgtaaacgactaccacgatcactgtgcatgattaatggcttgctaatatggcgactgtgcttagtcttttcaataagtgggatgacattcgatacctccaaggtttcagataagtcccaaccaatgatccgtcgggagtacaagtccataatctggttaaataaacgaatccgtcatgaagaaatatagtggtgtcaatgcacccacggcgtttggtcgcaatggattgaactgctcgtctaaaattttattagctgtttatcaaacttagaattgcgagtggtagtcgtccaaggggttggtaacggcgtgaatgccaagttcacgcatatacttaccacagttcgttcagcgatcttatatccttttgagcgaagttcttgggtgattttgccggcaccgtaaatacaaaggttttgagccaaattgctttaatttcaccttgaataaacttcttccgaagctttcgcggtgattggtgatatgagttttctcgttgatagtaaccacttcttgagattccaacataatatcacacataccattgatggaagggtgggattccaaagcgtgctgaacgtcatttcttggtatacttttcggtagttactgtcacgaatcccgattgattttttaacacttcgacgctccttcagcgtcacgaagttgacgctttagtcgtgcaatctccttgtcctcgctggcaaaattaccagagccacggccaaactccccagtctcagtaaacagcttaatccatttatgtaatgatctagccccaatacctagattcttactatttcattcatggtcatgtgatccttgttatctaagtaatactgaaacggcactgttccttaaattccttgtcataactgtgcttcgtcattatttgatcctccaatttacttccttaattatactaaatcaaagtctctatttaacttgtacactttttattctaggcccaataatacctttgaaaataagggtgctttaggctcaggtaactacattcgaatttacaacatttcaccaatcgtgaagatgtcaaatatccagattacgaacaacaaattcgttaacctagatccaaataaccgttacgtttactttgataattcaaagggcgccggaattaccggtgtgaaggttacaggtaataaaatcaccagttcaaagagtaagattccgtttgtgttaagcgctggaatgaattctggcgatatgacagtaagtgccaataccaacaataaaaatgtgacagtcaaaccttctgacatgaagaacacctcgaaattacaaaaattgacgggtaagtacaaagccaataaggcgactaatacgaaagaatcatatacttccggttataacggtcagtacgccaagttaaccactcaggcagcccaaaagtacagtttgtatagtcatatccgtggccatgccggctggtacatctatagtcagcgggatggctggtctaacgccaagaaatcgggcatcgtctacgttgatatgcgagctacggctgacagcggcaaatggtaccgaattcgtttcagctcaagtccaaacgcccgggagtactgggttcgttcaggcgcactgaaatttgattcgatcgagtatgccccctatgtccggtctctgatcccaatcaagaagtatacgatgtatactaaagtatttaacgatccgcaattggctaagttagctgggacaacggctgacttaggttctaaaccagttagcatcacgcaacgggcgacccgggtatccgtatcaaatggccaaacttcaacctactatttggttaataataagtactggacgaggtcaagtgccttttattagaaatatggagacgagtagttcacccgttaatatagcccaattacgttccaagactcagatttcgctcatgtaacaaaaacaagccactccgacaaaaacgtcgaaatggcttgtttttgttacattctggaatctaccgaattatgtcgcacttttctttttattgcataaaatagtgctggtgatttctcaccaacaccaaacattactgaaccattatttttctacaacatactgttcaaagcgctgataatcaacgttggttacttcggcttcaatcttggtgccattttcaagatagtctgttgccttaacgctggcgtgttcgttcagatacgaaacaatgtcgcccttttcaaatggaatcaagaaagtagcagtcacgtagttcttgaagaccttttccctaatcacctgaacgagcagatcgattgaggcgggatctttagctgaaaccacgatttcgtcaccagctcgtgacggataatcgttgtccgtcagatcggctttgttgtaaacggtgaccattggcaaatcagggacgccaatttcagttaaggttttctttgtagtagacatcatgtcgattcggttagggctagagtagtccacgacttgaattaacagatcagcattggcagcttcgtacaaggtagacttgaaagcttccaccaaagtggttggcagctgggaaacaaaaccgactgtgtcgctcagcaataacttctttgagtcatcgaattgcagctgccgaacactggtatccagagtagcgaagagcatattcttaaccataacctgcttatcttcgttcatgccgtagcgtttaatcaactcattcataatggttgatttacccgcgttggtataaccaataagtgccacgttaggtaattggacccgttcgcgttgctgtcgcttaacggttgctgatttatcgacttctttcagttcatgacggacatgattgatctgtcgctgaacggttcgccggtttaattcaatctgagcttcaccggcaccacggttggtaaagccaccaccagcattggtacccgtttgttggtctaatcgctggttcatcgcggtatgcagacggggcatttgatactgtaatttagccaattcaacctgcagtttagcttcacggctttgcgctcggttagcaaagattgccaaaatgagtccggttcgatccattacgggaaccttcacaactttttccaggtttctgatttgactaggggtcagttcatcgtttgctaccacgatttcagcaccagtatcaacgacgatatcacgtaattcttcaactttaccagttccaaagtaggttccggcaactggctgactaagattttgtacggtggtttctaccacgttcatatgattagcttctgacaaggcctttaactcttccatggcataatcaaagttgtagcgtcctgtattaaggccaatgttaatgaccggcacaagttcgctgttatccatgttgtcaccatccttaattgtttagctttagtataacatgagagtgtgaagcaactcgttaaattctaaaatctgagttgtgaaaccgatttaggctagataaaaggattgaacaaaaccaaattttcatcgtacttcagataagaagctaaatatgggctgatgtcacagctctaatagtcattgtgcaataatagctttcacacaattgatttttggcagcggtcagtttacaattatgagagttttttattcactgaggataaatttcaggtcgcttcaattaacttattgaacgaaaagatattcgaatgagcgaaaatatatgcaatttttgcaagaaaagtccccaaggttacccgtgttaaacatgtaagatgataaaacagcattgattttaatgcttttctaatatacaatatatatcacgaatctttaataattatacttgcacgttatccataatttgagggagtgaaatggctatgcagtttagtaagactttaacattagcagctatttcaggggcttctttactgttattttccgcttgtgggtctaaaagcaaacggcagctagccgatgaccagaccttacactgggttgagacagcggatctgccaaccatggatccctcaaaatcaacggatgtcgttagtggtggtgcactgaacaacgttgatgaaggtttacttagaattggtcaggggtcaaaactgcggccggggattgccaagtcttaccatgtatcaaaggatggcaagacctggacctttaatttgcggcattctaagtggagtaatgggacaccagtaacggctactgactttgtttatggctggcgccggacggttaaaccaagtacggcagcgcagtttgcttacctctataatcacgttaagaactatgacgctgttaataagggcaaaaaagccccttctcaactgggggttgaagctcatggtaagtatcagttagtggtaacactatcacggccacagagctattttaagtatctcgtggcgtctcaggcgtttctaccgcaaaaccagcaggtggttaacaagtatggtgccagatatgcaactcgttctggcaacgccgtttataacggaccatttaagctaactggctggaatgggactaacgatacctggacgttgaaaaagaatgatcaatactgggacgcgaaagcaactaaattaaaagcagttaaataccgggtgatcaaggatcaagggacttggctgagtcaatatcaaactggcaaagttgacgagttgatgacggacggcacacagtaccgacaccttaaaacttctccggatatacatatcaggggttctgcttccatgttttatctggagtttaatcagcgcaacgggttcttcaagaataatttagatgcaaggaaggccatttcgttagcaatcgataagcaatccttaacgcataatattttagccgatggttctcaagcgcctaagggactggttccccagaatctggcaaaaaagaatggcgttgattttgccgatgcagcctacgtcaaatcaggaacgacttatgatttaacccaagcacgagccttgtggcgacaagctctgcagcaatctggcaagtcaagtatttcgttgaatctattagcggatgacacgcccaacggtaaaaaaaccgttgaatttattcagagtcagttaggtaagctaccagggttaaagctgacgacggctaccgtgccgtttaacgttcggctttcccgttccactcagggcgattttgacatggtggttggtggctggatcgctgattttccggatgccatttcgttcagttcgttatttacgtccaacaatgcttataatcgtggtcgctggcaaaacaaggcttacgataccgatgtgaaaaacgctgagggcaaggatgcaaacaatccagatgaacgttggaacgacttggtgaacgccgagaagacgctgatgcagcaacaaggcattgtaccgttatatcagcgaactcaggcgcagttgctgaagccttacgttcacggcgttcagtactttccgactggcgcgcaatgggacttcagtcgagcgtatatttctaatcatcagtaacccgttattgagtgaaaataaagctgagcagatgcccacccttgtttttacatcttttagaaaaagtgtaatgatgttaaatagtaagtagaatgagaggtattttcatggcgaaatatttagtaaagcggattttttatctgctgttaaccttattcatcgtcatcacagtcacgttttttctgatgaagctattaccagggacaccgctgcaaaaccagcaaaagctgtcaccatcgcagcaacacctgattttaaagcagtatgggttaacaaagcccgtctggcagcaatatttgatttacgttggcggtgttttccagggtaatttcggaacttccttccagtttagtgatcaaccggtttcctacttgatttcgagccggatcggaccgtcacttctgttggggattcaggcgatgatcatcggtgtgattcctggtatcttagttggtgctttgggcgccattaagaaaaacacctgggtagatactactaccacgatcgtttctattctggggatctcaatcccaagtttcgtgctggccgttttactgcagtactttgtggggttgaaattacagtggttcccaattgccgattggggcggtttctcctataccgttttgccaacaattgcgttggccgcgtcgccgttcgcggatacggcgcggtttacacgaacagaaatggtggatgtgctgaactccgattatattgagctggccagagccaaggggctgagtaagtggggtgtcatttatcaccatgcactgcggaatagtttgattccagtggtgaccatcatggggccattggccgttaacatcatgaccgggtcaatggtgattgaaaacatcttctccattccaggtattggtgaacaattcgttaagtcgattctgaccaacgattacccgaccatcatggcggttaccatcgtttacagtgtcatgctgatggtagtgctgctgatcaccgatatcgtttatggtattatcgaccctcgaattcgaatttctggcaagagtaattaattaggaggtaaataaatggctgatgaagtaaagcttcctgcagatagttttgaacctcttgataagtcaaaacatctcgacagtgaaaaaattgcagcgcctaacttgacgtttatgcaggatgcatggcgtcgtttaaaaaagaataaaagtgccattattgcgatgatcatcctcatcatcttctttgttttagcgtttggatcagcgttcttctcaccgcataaccctaatgctgttaacccgcaactggcaaacttgccaccaaaatggccgggagtaaatattaatggtcttaacgggacactggttcaagctggtagccgggtgaatgcttatcaggccgctggtgctggtgctggcgtgcactattggctaggaaccgattatctcggtcgtgatatgctttccagaattctctttgggacgcgtatttccctgacagttgccattgttgccactgccgttgacttgttaattggtgtcactttcggtctcttttccggctggaagggcggctgggtcgacaactttatgcaacgtgtcattgaaatcattatgtcaattccaaccctagttgtggttgtgctgctgattttaattttgaaacctgggatgtcgtcaattacgttagccattgcgttttctagttggacgacgatggcgcggctgatacgagcgcaaacgctagagttaaaggaacaggaatacgtgctggcggcaaaaacgttgggtgaaagctcaatcaagatcgctttcaagcacttactgcccaacctttctagtattatcatcattcaaaccatgttcaccattccaagtgctattttcttcgaagccttcctgtcattcgttggtatcgggatcagtgctccgcaagcttcacttgggacgttactgaacgatggtcagaaaaacttccaatttttgccatatcaaatgtggtatccagctatcgtactgtctgtgatcatgattgcctttaacatcttcgctgatggcctgcgtgatgcctttgatccgcaaacgaaagggtaggtgaagtgaaactatgcaaagcaaagaaactattttgaaggtcaaccacctcaaaatcaacttcaacacctacgctgggacggttaaagccattcgtgatgtcagttttgatttaaaaaagggcgagaccttagccattgttggtgaatccggctctggtaagacggtaacgacccgttcaatcatggggttgctggctaacaacgcggtggttgagggtggcaccattcaattccacgataaagacgtgctaaaaatgtcacagaagcaactagaaggtttacggggtgctaaaatcgcgcaaatcttccaagacccgatgacctcactggatccaaccatgcgaattggccgtcaaatcgccgaaccactgatgattcataagggtgtcaaaaaagataaggccatggcgcaagctctggaaatgatgaagctggttggtatcactgatgcagaaaaccgaattaacgactacccgcaccaattttcaggtgggatgcggcaacggatcgtgattgccatcgcgttgatcaactacccagaaattctgattgctgatgaacctaccacggctttggacgtgaccatccaagcgcagatcctgaatttaatgcgtgaattgcaagacaagatttcaacctctattatttttattactcatgatttaggggtggttgctgggatggctgatcgagttgcggtgatgtatgctggcaaaatcgttgaatacgggaccgttgatgaaatcttctataacccaaagcatccttatacttggggactattgagctcaatgccaacacttgataccgacagcggtgagttagcctcaattcctgggacaccacctgacttactcgatccgcccaagggtgatgcgtttgcagcgcggaatccttacgcgttaaagatcgatacggagcaggaaccaccgtttttcaaggtttctgatacccattacgctgctacttggctattgcatccagacgcaccaaaagtgacgccaccggaccagattatccagcgacaggctaagtttgcggctatgcaaaaagaagctaaacagcagcataaaatcgaagaagaggaggaacagcaataatggagcttgataacgctaaaaaagtgcttgaagtgagtcatttaaaacagtatttcaacgttggcaagcgcgatgaagttagggctgttgacgatatttccttcgatatttatgagggtgaaactttcgggctggttggcgaatccggttctggtaagacgacgactggtcgagccattattcacttgtaccgcccaactagtgggtcgattaagttttatggtcaagaaatcattggcatgaaagataagaaaaaaatgcagcagtttcgccgtgacatgcagatgatttttcaagacccgtatgcttccctgaacccgcggatgaaggtcaaggacattgtagcggaaggtatcgacattaatcatttagccaaaaatgatgccgaccgcagcaagcaagtggctgatttattggcaaccgttggcttgaaccgagaccatgcgagccgttatccccacgaattttcaggtgggcagcggcaacggatcgggattgcgcgagcacttgctgtgcagcccaagttcatcattgctgacgagccaatctctgctttggacgtttccattcaagcccaggtggtcaacctgcttaaaaagctgcagcgtgaacggaaattaaccttcctgtttatcgcccatgatttatccatggtgaagtacatctcggatcgaatcggtgtcttgcattacggccggatgctggaagtcggcacgtcggatgaagtctacaaccacccgttgcacgactataccagaagcttgttgtcagcggtaccggtgccggatccggagtatgaacggacgcggacgcagatcaagtatgatccgaagtacgaagatggttctaaaaaacgtgaattagttgaaattgtgccccatcactatgtccagtgcagtcaggatgagattccgatgtatcaggagagagcgaagtcaatgggactgagcgtgaaagagcccggttagagtccagaatgtaagccaaataaagcaggttcccgtgaactttgggaacctgctttatttggcttacatggccggactctgggctcttgagcgcgttacggctacgtaaaagtgaacggcactcattcaaactgcgcatcatacaacttcttataagcgccgccagtcttcaacaaactttcatgcgtcccaatctcaaccacacgtccattttccaaaacgataatctgatcagcatcgtggatggtggacagccggtgagcaatgaccaaagatgtccgagatgccagcaggttattcagggcgtgctgaatggctttttcagactgattgtccagactagcggtggcttcatccaaaatgatgatgggtgcatttttcaacagcgcccgtgcaatcgagacgcgttgtttttgaccaccagagagtttgaccccccgttcgccaacctgcgtatcgagttgatctggcaattcacgaataaaggtatcaaggtcggctagttttgctacttgccatatgtcctcatcagaagcgtccggacgaccatacagaatgttgttgcggatgctgccatcaatgataaagatatcctgtgaaacaatggcgatattttgacgtaacgaaacaatgtcgatggactgaatcgggaggtcatcaatcgtaatgctgccgctgtctaaatcataaaagcgatcaatgagccgagtaattgtcgttttaccggaacctgaccggccaactaacgcggtggtcttgccataaggaatcgtaaagctgacatcttttagggtcgtgtcatgactttcagggtgcttcgcgccgtcgtagttaaagttaacgtgactgagggtgattctcttagaaaactttgggaacggtttaggatccactgcatttagcacctgtggtttctcctgtaagattgactggattcgaccgtaggaaaccagtgattgctgcagttggttcagcagccgggtgaaagcctgaatcggtgactggaccatggcgacgtagctgaggtaggcaactaacgcccctaccgtaagctgacccttgatgataaagtaagatcctaacgacaggacaatcgcgatgcccagcgtgttgatgccgtcaatcaacggtgagaagatggcttgattccggccggcggtgatcatgtctttccggttagtatcggcaaagtggtcaaaccgtttagcttcggtatcttcactgttgaaactcttaatgagatcaatttgagtcagggtctgctgcatctggttcgacattctggcttgagaacgtcgcgcgttcatgaacgcggtgcggatgcgaacccgaaatacccggtagacgatgaacattagtgggaaggtgagactgactgccaatgccatttgccagttgatgtagaaaatcagcgctagtacgcccacaaacgtaaataaattaccaaccatgttcagcatattggctgagataagactttgcagattattgatgtcactggtcagtcgggtcattaagtcaccggttttactggattcgaagaaactggtatctaattttaacaagtattcgtacagttgatttcgcagatcggtgatggcgttttgactcatgacgctcatatagtaggtggagatataggtgaagatgcccaggataatggctgccagcaagaggatagcaatggcaccaaaaagccactggaagttgcgctgcgggattactttatcgataatgaactgttcaatctgcggcatcacgaactgcagtaaggtaatcacggtgagcgctaagatgtttaataccagtaaccagcgttttttaagcactttactgaagacaaaacgaaacatttccatcaatgatccgtctgtttgtgacgctgcttgtttatcggccatggaactcccccccaatatttcgagctgatttaatctgtccgctaatgtagcactcaggctgactgggtgcaaacaaatagattggtgattgctatcaacattgtacttgaaaagcggaagtgtgattgacttttcatctgttttctaatatgattttaataatctaataaaaggagtggtgagattgaacttattacctatgcatcagtttacgaccagtgatggcgcgacgttagaatattttgatgaaggagaaggacagccgctagtcttcattgctggttaccgagccagcgctcagacttggctgccacaagccgaatattacaaggaccgctaccgcgtgatcggcatggaacgtcgcttcaatggcaacactgtttcacctacatataataagaccatggcgcgacaaggcgaagatctgcatgatttaatcgagagtttgaaattaaaaaagcccatcgttgtgggccattccatgggtggctcaaccgtgatggcttacttatctttattcggcgatgcacagttaggcgcttttgtgaacgtggatcaaacgccgaaaatggttaatgatgatgactggcagaccgggatgtacaagttaaccacggcaaatatgggcactttctttgacgcaccgctggatagtccgttttacaaagatgtcactccggaagtgatggctattatgaaggcggtggcagccgagaccaatgacaatacatataccttagagatgactaaaccgttgctactggaccacgcgtgggctgactggcgtggcattctgcaaacggtgacggtgcccacgttattcatggccgcagatcacagtccgttttggccaagtgcgcatgcaactgaatcggcaaaattagtgaagaatggacaggccgccgttttaacggatgttggccatgggatggagtatgaagatccggaacagtttcaggctgtgttagatcaatttttagaaacgttaaagggttgacaggaaaaagctcccgtcgttaaagcaatttctgctttaacggcgagagctttgttttgcattaatctaattggtcatcaacccgattataatacgcaacggaaatatcactaccgcgtacttccaacttggttacggaaccgttgagtgcggaaatcgcaacgttgatatccggttggaaacgggaaacaatgctgcgtatggtggtgctatggctggtcactaacactttgtcgccgtcaacgcagtcccgcattaacatgtcaaagccgggttgcagccgtgcccaatatcgggcgttatcttcagcatcgttaaaggggtcttgagctgcaatacgatccttgacgccttcgatggtgtaagcagcaatcatggcattaaaggtatcattgccatcaggaccaccaatcatgtgccaagtttggttttcgtcgttaccttcgaagtagccgaagttttcttccttgaacgctggggcaatggtggccttttttaccgtgccactgttgacagccagaatgtattcagccgtgtgctgggcacgctcggagtcgctggtatacgctttagtgaagggaatgtgagccagtcgttgaccagcagctttcgcatcttgcacgcccttatcagtcagtgcggcgtcgatccagccttgaatccggtggtacttgttcaaaatagtttgtccatgacggacgaagtaaatgtcaaaattagccaagaaattgcctccaaaaataagtgtcttaaaattaatttagtttacccaattcacgacgaatttgagcggattgctgtttgctactggtgaagaggatccggtcattgagcttcagtggagtgtcaccactaggccgaacgaaccgtttttcacggtagatttgcgcaatggtgatgtcgtcaataaagggcaggttgcggatttgaatatccacgtatttgtgattgcgtagctgaacctcgtaaacgccagcttcggtagaggtgagcagctccaatgtcgacggggtttcaatcaaactgcgcagcatactgatctgaacatcgggggtactgtagacttccacccccatctttatcagggtatctttccgctcgtcgaggatattgggatcttcaaagcgagcaatcacccgtggtacgccatactgtttggccgatttagccagtcggtaattttccttagagttactctgacccaaaacaacaatatcggtgtcgaaaacgtcagcgttcaccaagtcatcgggaaccaaattttctagtaaatgcacgtcgatctcactgttaaaagcacggtagttgcgttcctgatccgtgtacatgtgaatgtcgtagccgtgcttcgtcaactgctgagccacgggcacggtgagtaagttagtgccgataaagtggacgttcagtggtttgctgtcggcggcttcggcccggtatagccggttgaaggttatcggtccaatgatacaagtgaggatggcagccagcaggaaggcacccgattgctgagctgtgatccggtgcaagtgctcagcaacctgtaaaatcgccaaaacaacggttaaggtggtggtgctcatagcggtaccggcaaaggcattaccgttggtgaaccgcaatcgtagaattggccaaatagcggctttggcgacgagataggcaatcaagaaaacgggaatcaaaatcagcgttttcggatcagccagcaaggttcgcaagttcaagcccacaccactcataataaagaagatggggataaagaagccgtagccgatggaatccagtcgcaccttagtttcttcgtgaggttccagtaacttgatgacgataccggctaagaacgcacccagaatgccttcagcaccaacggattccgcaatggtgactaatagcacgatgacgaaaaacgacagccgaacgtccaattgcgtagtggacttattgatgcggtcaaaaaatttgaaaaagcttttaaaccgcaccactagcaagccggcagccaacagaatcaacagtaatagccaaagtgatttggcggtgggactgtaggcggatgcgtagaaggtcaggccaatcatgggaaccacttcacccagcgccgaaatcagcaggatcgtttgaccaaagggtttgcttagcagttccttttcctttagcgcggcgatgacgatgcccaaggaaatggtcatgaataaaatcatggctaaccagatgtcggagaacatgcccgataatttgagcaggaaagcaatcacggctgacattaccacgattgaaccataggacaagaatgccagtatgacaggtgaatacttaggtgcattggcggactgtttttgctctagtggcgtcaggtcgttacgtttgcggctgaacagactaaagtcaatttccagaccactcaggaacaacagcacgatcacgccgacgtccttcaacatactcaacgtatcattgctatggataacgttaagcagactagggcctaaaacgaccccaacgatgatttccaccactgcagtaggcagtaaagtgagtttgaaccgcgccataatcagcggaatggctaacgcggctaacagaataataactaatgaaatttgatccatgataatacctcgaatcatttacgtaataatgaagctagattgttcttatcgggcgcaattagtgatatactttaatatcgaatttacgactggagggcgctatggcagatacgattaaacagcaagaacaagcacacttagatgtggtgattgataaaatcaagattgctcaggttaagtcgcaagaacgaatcgacaatgcaaagtcaggcgaagagggtatccgtaacaacctcgttaacgaattacggcttaaaactgattcgtacgaaggcattatggaaaccggcttgtcggttcatcagcagcaacagcagcttaatgaacgtcaaaatagctggcagcacgctaccgacgaattgaagacgctgaagaaaatggaaaagacgccttatttcgcgcggatcgattttcatgaagaaggcgaacccaaaacggagtcgatctatatcggactggcttccttttcggaccaacctgatcgatttctagtatatgactggcgtgcgccgatttctagtgtttattatgatggcggtttaggcgatgttacctaccagacgcctgatggggaacaaactgtcaatctcaagttaaagcgtcagttccagatcgaagatggcaccatcaagacggtgttcgataccgaagaagccgttggtgatcagatgttgctggatgcgttgagtgaacaatccgatactaagatgaagagtatcgtcaccaccattcaaaaagagcaaaaccagatcatccgggataccaagtcggacttgctattcgttcaaggggcagcgggttccggtaaaacggccgctgttctgcaacgggtagcttggctgctgtaccgttatcgtggaaaattaacgtctggtcaagtcatcttattctcacctaaccagttatttaacgattatatcgaccaagtgctgcctgaactgggtgagcaaaacatggtccaaatgacctattaccagtacactggtcaccgcttgccaaagatgtcagtagagaccttagcacagcggttcagcgaagattacagtgacgctgaaaaacggattgatgccttaaagggcagtctggcgttctacaacgctgtcaccgtctacgctaaccatttggaaaaagaagacatgattttccggaacattaattttaaggggaaaccgttctttaccaaggaaaagattcacgaaatctactatagttttaacgaaaattatcgcttatttaatcgtctggatggtacccgcgagcagctgatcaagatgctcaatcgtcgaatcagttctgaaatgcgagccaagtgggttgaagaagccgttcaggatttaagtcaggaacaaatgaaccagatgaagggtgaggacccgcaagaaatcgaagacgctgacaaggaattcaaattctacgccagaaagattgtcatgaaggctttcgcacccattcgacaagcggttgtccgtaaccggttcttgagtatcaacggtcagatgattcacatgctgcgtagcattccagcaattatcaatcttgatgagtatggcattaccaaggatgattggaaggccagcgttgaacgcaccattgctgacatcaagcagtctaagatgactttgagcaacatttcaccgtacctgtatctgtatgacaagatgacgggtcacaagggtgaaaaggatatgcgctacgtctttattgatgaaattcaagactacacgccgttccagttagcttacctgaaattcagtttcccgcgtgccaaattcacgttgctgggtgatctgaaccaagccattttcaccaaggagaacagcaaaacgctgctgagtgaactgagtaccatgtttgatccagaaaagaccacggttgtacaattaacgcaatcttaccggtcaaccgcgcagatcactgactttactcgtcatattctggtaaacggtgaggcagtgaaagccttcgaccgtgacggcgctttaccggttattagtgtccagccggataaacaggcgacgttacaacggctgatcaaacaactgcaggccaacaataacgaaaaggaaactacggccattatcggtaaatcattggctgattgccgtgatttagccaacgacctacacgacgctggggttaaagccaccttgattcagtctgaaaatcaacggctggcacctggggtaatcatcgtgccgtcgttcttagctaaggggctggaattcgatgccgtcatcgtctgggaggcttccgagaagaactatcatgaagatgatgaacggcagttaatgtatacgatttgttcgcgggcgatgcatgaattgacggtgttggcgaccgataagttgtcaccgctgtttggaaatgtgcctgaggatgaatatgtgaaagaataaagagtgtgaaaacaagcgtttaaagagtggagtataagggctcgaaacggaaatttcttgaacttttgggaattttgtttcgagcccttatatgcaactctttgcttgtttgagcaggtttagactagattgaagtattgtgcaaaagtagatttttaactgtctttcagttaagaaaccagatatgatttttatcaacatagactcatagcactgctctttaatttatacccaacaagattcgcccgagttatagcgcttacgagatagctcgtgtataatgaactcaatttagtatctacggaatttgatgaggctgacttgaatgactgatttaatgaattacgatgtttttagtaaaaatgaatggcgcgacttttatcaggacgcctcagtgccactgacccaggcgagtttgaaacagatcaaggcttttaacgaccggatttctgttcaggatgtacaggatatctacattccgttgattcactatttacggttgctgataaagcattttgatgcttggcaagaatctaaggcgcatttcctacggcagaaatcgcggcacgttccctacatcattggaattgcgggtagtgtggcggtgggtaagagtactacggcgcgcttgctgaaagtcctgatgaatcacttctttcctgaaagacgaatcgagatgctgaccacggatgggtttctgtattcaacagctgagctgaagaagcgcggtttggtgacacggaaagggtttcctgagagttacgatatgaaggcgctgatcacgtttttaaacgatgttaaatcaggtaaagaactcatggaggtgccggtgtattctcacaagaattacgacatcgtgccggatgaggttcaggtgatcgaacggccggatgtgctgattattgaggggatcaataccttacaattacccagttcggaacagatttacgtttcggattttaccgatttttccatctacgttgatgcgcggccaaaattggtcgaggaatggtatttggagcggtttaaagccctactgaagctggctaaggatgatccggataactattaccattcctatactaaagtgccgatagaggccgctgtggagtccgctaagaatatttggtacagtgttgacctgccaaacttggaagattatattttaccgacgcgtagccgtgcagatatgatcatccacaagggtgaacagcacattattgaccaagtgatgctgcgtaaatcctaattggtattgggaagataacgcaagatggtttgtgaatacaaacttgtttgagtcgaatgacttgtttttagaaaagttattcgataaaatccgaacgattaaactttcctcattttgattgaccggcattagaagaatctgtatagtataactaatggtttcaagttctgtttaataagaaaggtgtgaatggattggcaaaggtggatttatcgtcctttgataagatcattgtgctggacttcggttcacagtacaatcagctcattacccgtcggatccgtgatctgggtatctactcagaattaatgtcccacgaaatcacggctgacgaggtaaaagctctaaatcccaagggtatcatcttttctggtggcccaaacagtgtgtatgctgatgatgcgctgcgggtcgaccctgagattttcaagttaggtattccaattctgggaatttgttacggaatgcagttgatggcttacaatttaggtggtcaagtgaagtctgataacggccaatacggtcgtgctgcgattacagtgaccagcgatgatgccaagttatttgccaacacgcctaaggaacaaaacgtgtggatgagtcacggtgacttggtgaccaaagtgcctgaagggtttacggcggttgctactagtcctgaatgcccaatttctgctatgcaggataccgcacggaacttctatgggattcaattccatgccgaagtgcgtaacaccgattatggtaacgatattctgaagcacttcgctttcgacgtttgccatgctgaagcaaactggtcaatggatgatttcattgatctgcaaattcagcatattcgcgaaactgttggtgacaagaaagtgttgctgggtctttccggcggtgtggattcatctgttgtgggtgtgctgttacacaaagccatcggcaatcagctgacctccatcttcgttgaccacggtttgcttcgtaaaggcgaagctgaacaagtgatggctagtctaaagggcaagttcggtttgaacattatcgaagtcaacgctgctgaccggttcttatctaagcttaaaggtgttagcgaacctgaaaagaagcggaagatcatcggtaacgagttcatccaagtgtttaacgatgaagctcaaaagctgaacggtatcgacttcttggcacaaggtacgttgtataccgacgtggttgagtctggtaccgataccgctcaaaccatcaagtctcaccataacgtgggtggcctgccagaagacatgaagttccaactgatcgaaccattacggactttgttcaaagacgaagcgcgtgaattgggtgaaaagttgggcatgccttcagacctcgtttggcgtcagccattcccaggtccaggtttgggtattcgtgtgatcggtgaaattacccctgaaaaactcgaaatcgtccgtgatagcgactttatccttcgtgacgaaatcaaaaaagccggcttagaccgcgacatctggcaatacttcaccgttctgccaggtatccgttcagtcggtgttatgggtgacggtcggacatacgactacacagttggtatccgtgccgtaacttctatcgatgggatgactgcggactttgcacacattccatacgaagtgttagctcaaatttcaacacgtatcgtaaacgaagtaaagcatgttaaccgtatcgtgtatgacgttacgagcaagccgccttcgacaattgagtgggaataagacgctaagttaacttggtgctggaagaccgctcgttaataattaaaaatcagttggtagtctgctaaatggccgccaaaagaaaagtcagtcctgagaaatcggggctgactttttgcttatggtaataaatcgatattttccattatgaaattaatgaagtactgactggcaatcggtagcatcactttcttttgactgattataccaattcttcgtgtcaattctggtttaatcggtagaatcgctacgttataggccgttttctgcaaaactaattctggtaaaatactaacgcctaagcctagttcaaccattgaaagaatggaataatcatcgtggacgcgcagtttgatattgggctgtaagtgagctttttcaaaggcagctaacggttcgctgtatgaaccctcctctaattccagaaaaggctcagaggttaggtctgctaatgtcacgaaaccgtgctgaactagtgggtgattgggtggcagtacggcttttagtacgccagatttaacaaactgaacatctgtatgaggtagggcgtcaggactcacaaagccaaaatcaacttgattcgttcgcacccattcgggaatagttgtgtaatcgccttgatgcaaaatgaactttacttgtggatattgttgctggaatttttgaatgaggagcggtaaccagtgtgcagaaatactggaaatcgtgccgatcctgatggtgccggaacttaagcccttaatttcttgaactttttcctgcatagcttgatattgacgtatcgtgttttggatgagcgggtacacctgcgcgccttccaaggtgaactgcacgccggtatgtgagcggtaaagtagtttaatcgcaaattcgctttctaaagacgcaatcatgtgactgatcgccgattgcgtataaccaagtgctaacgcagccttagagaaactctgtagctcaatgactttttgtaatgctaggagtcgtttcatcactattaattcccttcatattagtatgactattattcgttttactaatgaacgaatttaatatacattattcttatcgggataacaaggcgttcacgtaattaacgcttgttgttcatgtggtgtgatgaacagaaagggagggtctgatattgaccaaaagttatgttgttgatgcgtttacagatgaaatttttaagggtaatccagcagcggtgatgtttttaccggagtatccaaatgataccttgatgcaaaatattgccatggaaaataagttatccgaaaccgcgtttgctgttaaaaaggacagcactcactatgatttacgctggtttactcctggtggcgaaattgatttgtgtgggcatgctactctagcaaccggctttttagtttttaaatttgctgctcctgaaaacagtaatacagtgacgtttaatactaagggcggtgagttaacggtgactaagaaggacgacttgtacgaaatgaacttcccttcttacgatttaaaacaagtgccagtcactgaagaaatgacgacggcctttggggaacaaccagcagaggcttacatgggaagagacctgctatgtgtctttccggacaggacagatattgaaaatcttaatcccgatatggataaattaagtcaactggatggcttgctgcaacatgccaccgttgccagtgacaagtacgactgtgcttcacgttcttttgcacccaagctggcagttcccgaggatccggtttgtgggagcggtcactgtcatatcgtgccttattgggctaaacgcctaaggaaaaatcatttaacggcttaccaagcctcaccacgatccggtgttttgtactgtgattatcaaggtgaccggacgttgttgagtggcaaagcggtgctgtattcggagagcgagacctttatttaacttagcaaggtaatgagaaagtttaaacggtgtacgagatctatgactttcaattcgattgatatgtgactgtggtacgtagatagtaattataaaaagccagattctaaattgaatctgactttttataatatgatattctgttcgttttggtgtgctaaatgcattaacaattgtaccaagtaatgatggcgcatgaggtttagtggcttacataataatagtattttaactttgacaccttatgaaaatacttgccagcgtatttaaatttattgtgtgcatagtggtcgagtttgtacgtaacatgaatagtattccccatgttgatactggtgtggattcgataaatatgtccagtatgaatcactttatatacgtgtgcagatgaagcgtctgcacgtggaattgcaatgattactgtgtgttttctaattatcattgctaaattgttagatgaaatataatatcccctaagtgagcttggaatcgaacgataggtgcttgcttcggcttttgattgtgtaaacggggcgctaacccctagtgcaagtccagtagcacctaataagatatagtttcttaacttcatttcaatatcctcctaattacagctctaaaagttgtttttatatacttcaaaactctgcttgtttaattcttccattatctacaagttagttagtcatcgctgacatcggttgtgcctttgttaacccatttaccgccaatatagcggtagtcggttagaagattttgatcagtgccatgaaaccaagtccacacatggtgagttggcataacttgtgagccgcgttcaaaaattactttagatttttgggtggggcgatagtcggacaaagttgcatgactatctttatcataaaaagtattgtacgtataatcatcttttgaggttgctacacggtagccgtgaaatgacttgtattttggtgtgctttttttagatgcatatcgtttatgccagacaacaacgtagcccatgttctcatagttgattaattctttcttaccattttttgtggttagtcgccattgacgactgctttgataaccatatttggcgagcaaattgaaagtataaactttatgtttgtgggtgattgcatcgcttgaactaatacgagcaaatgagagcttacgccagccactccaactactcttgtacatagttttaccgttaagaacaattgagtatttgttaacgttcatcgtgtcgccagaagtggtgtagtaggttcctcgccagctactaggtgtatgatgagtagcagcatttgcactagtctgtttcaattgaaacccgattcccattgatacgatagcaatgcctagtaacaaaatttttttaaaattcattttgaatatccccttagttgccactttcaatttgagattcacctaattaaaaattctaatgctgctgttttgatttagaaaatattatttcttctctacaagttgtcggagtaacttattggtttcatcttgctgtttaatcagtacccagttttgctcaatttgagtttgattaagagtaatctgataccgttccagtacactgttaagcgtagcgacaacacgagcatagccaaatgaagacattttacttatgattttatttaccgcatcttgagtatctgaatctaagttttccatgttaaagcgcttgatataatcttttaaaaatttttcatcaatgaaatcttcttcggtatcaccattctgtgcacgcttaacgtctttttggattacttgtttagcgtgatttgggtcaaaagttgcgtggttgttcatcagttgtcgtacttcattaagagtgtaagagtgtgctgcagcttcggaagcagagtcacctttctgaaacccaacttttttaccacaatttgcacatatttcgccatcttttaaaacccagccacctataaaaccaattttgctgccatcgattgggcattctgccatattaaaatacctcctataattattgtgatgataacggattacacgtacctttgagctttgttagaactatcgcttaatttgaagatctgatataagtttattgttagtatcaattatgtaaacgtatcaaatggatcagttgcggttgcttaatagtttttaataccatatatttttttgtctgcgtgtaatggctttgattcagcggtaccacattagagctcagaaattgtattggttttattagccatctcaaaacttcaattcgtttacatgattataatattacaagtgtatggttttatatatagaaagttaaaaagtgtaccgtgcttagagatattattgatgtacaaaagcgtaaagaaaagagctacttaattgaaatcaagtccaagttaaaagttagtagtgctagagaacaaaaaaatgtaatggctaagcattcgtttcaacactcagttcaattttttaatgttagattaccaaacgatgacagactaacgtagttgatatttatctaactattgtgataaattagacatgttgaatgaaattatctaagttggttgatattaatgtgctgggacaataatctagacttagatgaatgattcaagaatacgtttcgaaagaattgattgttttagcccctgtgattgctgattttagctaatgtgtcaggtaatatctcagaggccgaaattcctatgaaacggtcagtgagttgcacgaaaatttaagcgcttacaattaatcaatctacaaacatttaactgattaaaacaaatcagtagaaattgagggatataaaatggctaaaaataagaacgatgtcttaacgaaggctaatcgccaattaaaagaatttgcaaagattgtgaatagtgatcatgcacttcggaaagtaaaacctgacgaaaagctgcgtgttggcgtagacttagggacatcgtcaattgtactcacggttttagatgaaaataataatccaatatacggtgcttttgaatatgaccacgcggtacgtgatggtatggtggttgattaccttgagagtattaatattttaaaacggttaaagcaaaaagctgaatccgttttaaagactgagctgacgactgcttgtggcgccattccacctaacactggtgaaggtggtaagaaagtggttgcaaacgtgattgaagccgctgaacttcaatgtttaaacgtggttgatgaaccaaccgcagccgctaaatttctgcgtatctcatccggaacagtagtcgatattggtggtggtaccacgggtatcagtatttttaagaatggcaaacttgcaactgttgtggatgaagcaaccggtggttttcatatgaccttggtacttgccggggcacagaagattgatcaagagaaggctgaactcttgaagcgtgataacgctaaggaagctgaggtcttcccaattattcggccagtggtggaaaagatggctacaatcacaaagaacgctgcacctaatcagctacaaaagcccgttgtcgttgttggtggggccactaacttcaaagatttcatcaaggcattcagtaagacactccagatggatgcagttaagccagcctttccacagtttgtgacgccgctggggattgcgatgtatgatcatgaggattaggtaaagaaagggacgtgaaacagaggtgttttgtggacttaactttagaggataagtgattttttgttagatagcctatcattgcaagaaagtcgtttgaccagtaccccccaaagctgtaaacaactttgaggggtacttttataatcgacttttcgtggaacaaaaagaacaattagagcttaagaacggtataaacacgggtttaattgttttaaacagaagggtataattaatttattaattatttataaggagataaaaatggcaaaaacggtacactacaatatcggattagatataggaaccaattcaataggttgggcgattattgatgaccattttaatttagttcatgttaaagggcacaatggtattggaacgagaatatttagggaaggtaaaacagcggctgatactagaaactttcggacgactagaagaagactgagtcgaagaaagtggcgtctaaattttctgagagggatttttgaaccccatatttcaaaaattgatgaaaacttctttatgcgtcaaaaggaatctaatctagttgatcaagattctagtaaacacttcaaagggagtattttgtttaacaataggagcgataaggatttttatcacgactatcctacaatttatcatcttcgttatgctttgatgacgaaaaagcaaaaatttgatattcgtgaagtctatttagcaatgcaccatattgtaaaatatcgaggacattttttaaatgaagcacctgtgtctgcatttaagcggcaaaaatttaatttaaaggatgattttagcagcttaaatgaattatttagtcgctttcttccggatgtcaactttgagttaaatttgcaatcattgagtaaggttgaaagtgtgttacttgatacatctcgctcacgattagatcgtcaaagagagttagttaatgaaatctatgataaacctgatgataaagctaatgataaaaatcttgaaaaactaaggaaatcaatagcaactgaaattttgaaggcaatgctgggtcttaaagcaaaatttaatgttattacaggcgttgaaactgacgatactagtacttggacgattacctttgaagatgaagaaattgaaactaaagttgctgaactagacgaacaactagatgatgatggccgagatgtaattgatattttaagaagaattaattcagccattaccttatctgggattgttcctaatggtaaatccttgtctgaagcaatgattagtaaatataatgcacattgcaagcaattagagcagttaaaaatcttagaaaccaaagtagaccataaaacagctaagttacttaagaatgcttatgacggttatattgatggcgtaaaaggtaaaaaacttccacgggatgacttttataaaaaaattaaagctattctgagcaaagtcgaagatcctataaaagaggatattttcaagttaattgagttaaatcaatttttacccaaacaacgaactaaggaaaacggagtaattccccatcagttacagcaacaagaaatgcaacagattattgaaaatcaaaaagagtattacccttggctggctgaagaaaatcctaaccaaagagacaaaggaattgctaaatataaattagaagaattagtggtctttagggttccatactatgtcggacctatggttgatccaaccgctgataaaaatggtgaaaatcgcgaacaaaatgctaagtttgcttggatgaagcgaaattctgaaggtgaaatcacaccttggaattttgatcaaatggttgaccgtgacgaatcagctgagcggtttatcaagcaaatgacaacaaaggatacttatttgatgagcgaagacgttttacctaaacgcagtttgctatatcaaaaatttgaagtgttgaatgagctgaataacgttagggttaatggtcaaaaattagatatcgatgtcaaacaagcgatttatcagaatctttttaagaaatttgcaagagtcactttaaaacggttaaaagattatctcattgctgcaggaaaatttagtgcagatgaggcaatagaaatcaaaggcttggcagcagaaacacattttttaagtgggttaactacagaaaacgatttacggaaaatctttggtgacaaaatcgatgattcaagtttaactagtgattttgaacaaattattgaatggtcaaccgtttttgaagactctaaaattatgttgagaaagttagatgaaatttcatggttaactactgatcaaaaacaaaaacttgctggtaaaagatatcgtggttggggacgtttatcccgaaagttgttaaaagatatccgtgatgtcaatggcgaaagtattatgaatttactgtgggatacagataataattttatgatacttgttaatttgccggtatttaagcaaaaaattgagaaggccaacagcagtttcttacggaaaaatcttactcaagatgttattaatgatttgtacacttcaccgcagaataagaaagcaattcgtcaggtaataaaagttgttaaagatattcaaaatgcaatgggtgatattgctccagataagatttcaattgaatttgctcgagaaaatgaaactaatcccaggagatcgattcagcgtttacgacaactaaatagtgtctattcgaatatttcccatgaaattatagaaaatttagaggttagaaaacaatttgcaaaggtttcaaatggtgaattgaaccgtgaccgcttgtttttatactttttacaaggtggacgtgatttatacacgggtgacagattaaatatcgatttgcttccaagttatgatattgaccatattttgccacaggcgttcattaaggatgattcattagataaccgtgttttagttgcagcaagtgataatcgaaataagtctgactcattgcctgctgacgcgtttacgagtgaaaaatatgctcaaagaaagtcgttatggctacaactttacaatgccgggctgattagtaaacgaaaatatcgtaatttaacgtttaatccgaataatattaataaatatagctctaaaggttttattcatcgtcagttagttgaaacaagacaggtgattaagctggttgctaaactactagatgatatgtatacagatgatgggactcaaatcatttctgtaaaggctgggttaactcaccaaatgcgtgaagatttcgactttcctaaaaatcgggatgttaataattatcaccatgcatttgatgcctatctatcagctttcgttggtcaatatttattaaaacgttatcctaagttgagcccgtattttgtctatggtgattttaaagcaggaaagcttgataacattagtaagtttaacttcttaggagatttaaagaatgaagaaaaagttgtgaattctgaaaccggggaaattattgtaactaaagcttcgcagttaaattatatgaataaaatttattcttataaaaaaattctcgttacgcatgaagtctatgagaaccgaggtgctttatttgcacaaactatttataaagcaagtgatgataaggctagtggcaggggtactaagaaacttattcggcaaaagaataataggccaactgagttatatggtggctatagcaattctaatgacgaatttttgactattgttagactaaagaaaaaagatgttgcttattataaggtaattggaattcctgttagagttgccaataagattcggttagacaacgataaagtagatattaataagctgtcagaatatttaaaaacggtcttttctaaagtaaaaggcaaattacaagtttaatccgaacaagcccggaatctttcaatggcagtctgttgatgatgtatttttaatggtcgttgattaattagttcaagtgctgctaggatctcatcagtcgttacttggcctaaaattggtctttttcggaagaaccaccgtaaccgtctattaaaatattcattggaactcgctcccatggtgaatatggatggcaaaaataaactttgatctgataatcctgtttctaagcctgataattggcaactctttaccatgatcaacactaatggattttacttggggaccgaaggctcccataaacttgccaaaggcggtgttagagcctttaggccgttctattaggggctttgatggcccagaagtcgggtgtctacgttctacgaacatgtaacccagacatgatcgtgactcactctgactagaaagccccgtatcctacttcccatagaccaaagctacccgttgattaacagttgttggccgttgttcgatggaagtcccacttgtaaattcccacgattttcgctcactcgtgtgctggcggacattccgattgggtagatcgctcatttgaaggggagccaccacgattaagccattataattgacgcagtgctcaagttataagcgtgccgcaatggtttctggtgaccaggttaatcgtaagtgattggtaattaaagtgcctaatgctgtccgtcagcatcgaacgacgaccgcaattcgccttttgcgatctgcatcttgctgaggctaattctggatcataaggtttaaaaacccgatccaaactcatagctaatcgtagcttggccgcctaaggcggcagccatatccttggtaagattgattttcccctcattgaccagttgtgctagtgcgccacgttgagtgataaagtagatgtacccaaagtaatcactccctatattggttggaattagctactaccattgtaagtgattgctttgggctttttaatttctgttcggattaattatagaatttgccgtaccgaaaaaaaagaaccggagataattaaatctccagttccttttgttcgattaagattgaactagtttattccttagtaaagtcaacaaccatacggccagtgattttaccagctttcatttcgtcaataatatcattgatttcgcttaaacgacgggtctgaacgattgggtgtaccaaaccttcagcaccaaattggaaagtttcagctaagtcttgacgggtaccaacaagtgaaccagccacttggataccatccaaaacagtcttagcaatgtttaattccatgttaccttgtggaagggcaacggcgactaaacgaccatctggacgaagcgcattaactgattgagtgaatgctgcatcgttaacagctgttacttgggcattgtgaacaccaccgacttgtttttgaatttcttcagaaacgttttgggtcttacggttgattaagatatcagcgcccatttctttagcagccttcaacttgtcagggttaccatcaacggcaacaacgtgtgcgccaaagacgtgcttagcatattggatagctaagttacctaaaccaccggcaccaacaacttcaacccattggcctggttttgtttcgccgactttaagagctttgtacatggtaacaccggcacaagttaaactagtggcttcaactggatccaaaccttctggtactttaacagcgtagttagcatcaacaataacttgttgtgccatagcaccatcaacggtgaaaccggagttcttaacgttgcggcaaagagtttcgcggccagtcaaacaatattcacagtggccacagcctttgaagaaccaagcgatagatacacgatcgccgacttttaagttctcgacaccttcgccaagtttagaaacgatcccaacaccttcgtgaccaatgatacggccaggaactttaccaaagtcaccagcagcaacgtgaaggtcggtgtggcacaggccacagtattcaacgtcaactaaggcttcaccatagtttaaatcacgaagcttgacatctttaatatctacatacccatcaactgggtcgcgtacaacagcagctttcatttttacaattacctctttcgtatgtgtgtatgttttcacaatgtaatttaaacacacagtttcaaaaagttcaagtgattttttgagcaattgcaaatgtttgcaaaatcatgttcaattaagaaagcttgattaaccggtaccatggcgattttttgaattgtttataaatttgattgttgataaaaattttttcactaagtatttttactgataatttttttcaatgaatcagaatagattcgccaaattttaatttatatagtaagatggaaaagtaatttgattgacagtatggtacactattagcgatgtgccagaagttttttctaaacgtaaataagaaaattataagtaagaggagttcattaaaaatgagtcgaattttaattattgaagatgaaaagaacttagcccgtttcgtggagctagaattaaagcatgaaggttacgataccgaagtccagtttaacggtaatactggcttagatgctgctttggctgaagattttgacgttatattactggatttgatgttacctgaacttaacggtattgacgttgctcgccgtattcgtgaagtgaagaatacaccaattatcatgatgaccgcccgtgattccgttattgaccgggtttctggttttgatcatggtgctgatgattacattgttaaacctttcgcgattgaagaattgttagcgcgtgttcgggcattgcttcgtcggattcacattgaaagcgaacaaaaagactttaagcaaaccacggtgacttacaaagatttaactattgaaaaggaaaatcgggttgttcgtcgtggcgatgaagtgattaacttgactaaacgtgaatacgaactgctattgaccttgatggaaaacgtcaacgttgttcttgcccgcgatgttctcttgaacaaagtttggggctacgaatcagaagttgaaactaacgtggttgatgtatacgttcgttacttacgtaataagattgatcgaccgggtgaaaagagttacattcaaacggttcgtggtactgggtacgtgatgcgttcatgagtgaaacagatacctcagttaacaaaaatgaatcaactttaaaaaagcatcatcgattatcgatgaagtggaagtgggcgctgggtagtgcaaccggcgtttttgttatctttgtcgttttttccgtgttgatgtttcaaggcctatcaggggtcttgcttcaacaggaacgaacgcacgtcagcagtacgctggacacggtgattagccgagtcgataccttgcaggggcattttacggctgattcggtcagtaatgctttgcaacctaatctgaatcaacccagcggatcagtttcggatcacgcaaatatctatcaaaattccgtgatcacagatttatctcgtgatagtacgggggtttctgtttataacgctcagaaaaaagaaatttttaattctcgtaatccgcacgttgataatagtcgattatcggaaaaacgtgagatgaaaatggaaaagacccgcagttttgatgggctggttggacgagcaccaatttatagtcagagtggacataagcttcttggctatgtacaagtggctaatgccatgacagagtataaggctgcccgtcatcgtttctcgttgatcctgattgtgctcgtgatttcggttgtgttcgcagcgtctgtgttcagttatttcttagcagatttattgctaaaaccaatcattgacctcaacaagaccatgcaggcagttcgttcggacccccagtctgatgaacgggtgcctgaaacgcgtcgaaatgacgaactatctgatttaagcgagttgtttaatgatatgctggatcagatgcagcgttatatcgatcagcaacagcaatttgttggtgatgtttctcatgaactgcggacgcctgttgccgttatccaggggcatattgaattactccagcggtgggggaaagatgatcctgaagtgctgaatgaatcactttcagcggctatgcaggaaactaagcggatgcagagtctggtcaccgaaatgctggatctgacccgagctgaacagattcaaatcacgatgaatcacgaaacttccgatattaaagaagttgtgaaccaagttttcaacgattttaagatgatccatccagactttacgttcattttagatgacgacgtcaaaaaacacgcctattcgcagatttatcggaatcaccttgaacaggtactgattattttactggataacgccgttaaatattcggttaaacgtaaggaaatccacttgtccttatcatctagcgggcacgttgctcaaattgccgttcaagactttggcgaaggcctttccgaagaaaaccgtgaacgagtgtttaaccgattttatcgggtggataaggctcgtagtcgaaataaaggtgggaacggtttaggactgtccattgccaaacgtttggtagaggcttatcacggtaagattagtattgaaagtgcacttggctatggttcaatttttcagattgaattaccgttgatttcagaagatatcaagattcaactggatcacgccaaggaagaagacgaagaggagcgaacggttagtgatcctttagccactaatttaggtgctaatccaaccagttcatcagctatcccaggcgtttatcgtgctagtgatcaagccaactcggaaccatctaaaccggatagttctgagtcgcaggatgatgagtccaagccaacgcattaacaaaatcatacgaattaaccattaaagcaggttcctgtaatcaggagcctgcttttttaggttcgtttaatttaagtcgtctacaatcacatttatgcaatgaaagcagagataaaaggtcggcagtttaccagctgatctgatttctaaaggatgaaaaacaattcggataattagtggggtgagttacttctcgttatggatttaagcattaatcgaaaaaatcgctatttaacgtctaattcaatgattggtgtttataccagaactgataagcaacgatcaaaaaattcggtgcataaacggttaacttggttagatattgccaaaggaatcgggattcttgcagtcatttgcggacataacatgcccgattatattctcaatgttcaagctaatcggtactggtacgattttatttactggtggcatatgccgttattctttttaattggtggttttttcttaaaaccgattaatttgctggatttaaaaacggttactactttcttaaagaaaagggttagaccattattatctagttattttctcgctggcctgttgcttatcatcgcgtatatgttgattcataaaacgtctgtcacatacagtttgacttatcttttaaaattactttatggcggcaaaactttaagtgattacaccacggtattctggtatccagaaacctatctattaggtgtaatggggacaacgattattattagtgctattcgtttgaaaccgatacaacttatcattgcgggtagttttgtttattggtcgactagctatcagcaattgaccaattttaaagcgtttggtgtggtgacagcaccttgggatatggacgttgctgtgttggtaatggcgtatatgctgattggttacaacttattttatttcggtaaacagtacctgacaaaatggtatatttttttaccggctttactgacggttagttggctatttcttcagttgaaaaatcaaaaactgtcattctcactgtttatgcgtagtcaccaattttctggtgcttatcagcatctctcggtaggtcacaatgagttagcgttaatggtaggaatcatcccagtgttgtgctgtttagtgatttttggggtgagtcagattgttgcttattctttggaggccacacgttcagtggcaaaaatcggtttatttccggtgagattaattgcccgaattttatcagtagctggtaatcatacgctcattatgatgtatatgcataaaatgattttggatctgcttgatgtgagtcatgtgaccgattcatattggttacaggttctcattgctgctacaataccactcatcattggtgttttctttaaacaatatcaattagcaagactggtaaattcgaagttatcaaacaaccggtttaatatcgctggcttacaatttattttttcttcccaaaatttttgatatttcaaatagattaactgttcatgccatcatacacaaaaatttcggatagtggtaatatatttagtaagctattcgcagatcggagtgaaaaaaatggcaacgattatttgcccaaattgtggtaaatcaatccctgaaagttctactatctgtccaaattgcggttaccacttaaccccgaccaaagcagaagatatttcgcaaaaatcaaaggataagggggaatttcaggggcagggccgctttgcccatctcaaaaaaattggtcgttcattagtaaaacaaaggtggtttatctcactatcaggtattttgtttttctgtgtactattcggtgtttcttatcagtatcagttacacaagcaggaaatgcgcattcaaagagagctgtctcaggcgattaagagtttgagacacgaaaatcaggttgccgcaacgcatgggcagtccattcaagaacctgcttcaaaagtgccacagaattcaaaacgaccaattttactgctacacggttttggtggttcgtataactcagagaggtatatttcggccagcctcgttcaaacacatttggcaaagcagcaattaatggtttatgtggatcggtctagtcgtatccacctcattggtaaatatcaaccaagtgccagtcataaagtggttatccccattgtcattaagaataatcatgccggtgagatttactatagtgcgatgctagcaaagattatgccaaggcttaatcggagatatcatattaagagctatgatgcggtggggcattcgatgggttcgtatgcttggatcaattattttgaaacccatcccaaacaagttgctcagatcaagccacatcgtgtcgtcacaattgcggggccgtttaatggtattttagaccgccacaaacctgatcagccaatatttaaatcaaaagttggtcgtttatgggatgatcaagtaggcgaaaattctttagataagaatggccgtccgaaaatcgaacgagcggaatttaagcaccttttaaagtataaacatcgtctgccggctggtttagatattttgaatatttatggtaatttgaaagatggtaccgacagtgatgggcttgtgacaacgactagtgccagatctttgggttatttagttaaaaccagtcacgtcaaagttggctatcaggaaagccaagttactggtccaaaagcgcaacacagtttgttacattataataatttgaaagttaatcatttaattaaggactttttattatataaataatttaatctaactacctaaccgttatgggtgggcagcatatatggtggtgaataatttcttattatgaatcctactttagatagtaaacgtcaatttttatcgttagaacgtaacagcgattcaaatcaggagactgatcagcatcctatcaaaaagaagcggaaacgaattatctggttggatattgctaaaggaattgccatgattgcggtggtctttgggcataatatgccagattatgttctgcacgttaaagaaaatcggttttggtacgattttctttattggtggcatatgccgctattctttttaattgccggttttttcttaaagcccattaatttgagagatattcaaagggtcattgcctttttaaaaaaacgcgttacaccgttattacgtagttattttatcgctggtcttttactgattactggatataagtttattcataataagtcgattacatatagtttgatttatgtcctaaagctgttttacggtggtaaaactttaacccattacaccactattttctggtatccagaaacttatattttagggattatcggtacaaccgtcattattagtcttatccgatttaaacccttgcaactcattattgcagcttactttgtttactggtctaccagttacacgcagttaacgaggtttaaagcgtttggtgtggtgacggcaccttgggatatggatgttgctgtgttggtgatggcttatatgctgattggctacaatatgttttactttgggaaacattatttgaccaaatggtacgtttttctaccgtctttcgtcatcgtagggtggctgttcattcagcttaagacacttagactggcgtttgggctttttatgcgtagccatcaattttctggctattatcaaaacgtgcctttcactcatgttcaattggccttaatggttggccttgtgccaattttctgtagtctgaccgtgtttgggataagtcgaataattgcgtattcattaggtttcacccagttatttgcaaagattgtgttgtcacccgttcgattaattgctaaaacattgttcgttactggcaatcacactttaattattatgtatatgcacaaaatcgttttagatgttttagatattacccaggttgtcagttcgttttgggttcaggcactgatagcggtggctgttccgttactaattgggatggcctacaaaaaatttcagcgcactcaagttggtgaacagttgaaaagcatgattcagtcaccggtggctaaaccgcaagaaaatgataagttgtagtcaaaacaatcgctattaaactgaagaacgtgtgatacaactcggtagattccagaatttaacccgaagaaacgtcattccgatgctttttgtcgggatggcgtttcttcgggttaaatggccggaatctgagttgtggagcatatttaggctagattaaagtggtgcacatgagcaaattcttagttatctttcagtaaagaaactagataaaacttttatcaatatagacttatgtcacagtcctttagtcactggttagactctttcgtttcccttaattttccgtcttttagtttcatcaactgtctaaattgcttatagtatttgtagattcaatgacctattcgtagatcggagtgacgaaaatggcaacaatgatttgtccaagctgtggccacacaattcctacagaatcaacattctgcccggattgtggctttaagctaactgaaaatgaaacacacgggtcatcacgtttagctgaagaggagggtactcagctacatcgacgtcagcgggtaactaattcttggcagaggcgattgattcctaacgtgacaaatttaaaacgggttggtcggttcattgttaataacagctggtttctattattcatttacgtgatcagtttgatattcaatcaatggcgctgggaaatatttgctttgtttattctgagcagttatttgtatccgttattgactggtcaaaattcttttgggcgtccgcaacgtcatccatcacgccgacacgtccctgctgatcagcagttcgatgaaccagaacaagtagtcaagaatcaatcaaagaccacaacgcaacagaatcaatttcgaaaaccagctaaaacagttcgttttcattttaagtctaatctagagtttcgaacagggagtatcttgattattcctagtttagtctgttacctagtggccaaacaactcatcagtaagcgcggcgttcaaagtgatcaaattttcaatcaaactagcctgggaatcactgcggatgtttatttcattagtttaggtgttttaggcattgctactgcaatgattcttggcggtttagtcaaatcaatggttcaccatccctttggtggacagaaattcaagcggtggggagtggtcaccgctgtattaaccattctgttggctgtggccatgtatcaagatgccgttactgcgacatcggcaggagccgtagtgagtgctgttggtgcgtttttaatgccgttcttgccttggttagcagcatttttttatggattgggcatcgtgaaaaatctgcttactccgcaaaaaatgatttagaaccaaaaaaactttccccaattacgaggaaagttttttgtttgatgcacgtttattaatggtgccgttgcttaccggcgttacgattccggttacggttatcctgagaaacggtacttggttgaaccgtcgacttcgcactagtagttgaggttgtttctgcagcaactaccggtctaggtttaacaacctttggcgggttctttttcatttcggcttcaatctcacgacgaatccgtggccgatagagattaataatcagcgtttggacacaggcgaaaatcccaccgatgaagaagtagagacctaagccagcagaggtcgaaatggtgaagaacagaatcatgacggggctggcaatcatggtcatccgcatggtcttcttctggtcagcaggcataccaatcatcgagaggtaaccttgcaggagatagaccaagaacgaaagtatggccagcaaaacggaagacttcccaagtgggatacccatgaaagttgatgacgatagttctggtgagtattgaattgcagcgtacaatcctgcaaaaattggcatttgaatcagcaatggtaaacagccgattccaccagtcatactgataccgttatcccggtaaagtgccatcatttcttgaccagcagcgttttgttcttccgtagtggtagctgctttttgacgtttttgaatttcagtcatttgtggtttgatagctgcaattttttcttgctgaatcgttgagctacgtaactgtcttaccatcagtggtaacagtaccattcgaacgaccacggttaccacaataatggcccaaccgtatgaatggcctaacatattggctaaccattccataatgtgctgtcctggcacagcgaggtaatcatacacgatcccgtatggcttaccgctcttggttcgttgcacacagccgcttagcagtggtagcagtacagccaccacaagacctaactgtaaaggcttttttgatttcattgactattactcaaatcccttctaaacaaattcatgatttataatatagtagcgaagttctctaaagatgacaacaagataaatcttacttgatatggaagggtttttcaatcggtaatagtaaatttcttaaagtcttcaatattactaagagtaacctttacgtcatttactcgggcgtaaggtgttggtgaatgtcttatggcctcgatgaaagcgtttagactattatcgtcagcctgtgcgcgaaccgttacagatccatctggttcatttttgacccagcccacgacgtgcattcggttagctaaatgagcagtcgtccagcgaaaaccgacaccttggactcgtccatgaattgaaattgttactgatttcatcattacactccctaatcgtgatactatatataatagtatcaaaaatcggaaagaagaggcagttcatgattgaagaaattacatcaactcaaaatgcaaaggttaaaaaatggcaacatttaaccactaaaaaggggcatcaaaagtatcatcagtatttggtagaaggttggcatatagttggcgatgccattacagctgaacagccggtggttcaaatcatcgcaactgctgaacagttaaacctgcatcaacatcaatttccggaaaacgttgaaacgtttgaaattacggatgagattgccaaaaaactatccgatacggtgacaccgcagggaatttttgccgttctggatattttggctgctgagcacgttgatcctgaaacggcaaccggtgcatggctgttattggaccgtatccaagatccaggtaacattgggacaatggtgcgaacggcagatgcagccggttttagaggcgtcgtatttggcaatggcacatctagccagtatacgccaaaggttgttcgcgcaatgcagggcagtcaatttcacattcaaatcactcacggtaaccttgaagaatgggtaagtgctttagaagccagaaaaatcccagtttatggttcagcgctcaatgcggaggccaaagattatagtacggttacgccacaatcagaatttggtttaattttgggcaatgaaggtcaggggatgtctgaaaaactaatgacgcaaacaacaactaatctatacattccaatcaaaggtcaagctgaatcgttgaacgttgcggttgccgcgggtatactaatgtttaaattaaatcaaaatttagcttaaatccttgtctttagagtattttgcttgcaatatgatggtatattcagtatagtttattcagataaacttacaaaaagtaaaggaagcgttgtatgacacgaaatgattggcgccaagactcggaatacgttgctttagttgctgatttgttggctaagccagaagttcaaaaattggctaattatacccagcatcatcactccaatcggttagatcattccatctccgtttcttacgatagctatttaattgctaaaaagcatcatttaaacgttcgtgcgactgcacgggcgggcttgctccacgatttattttactatgattggcggacaaccaagtttaacttggggtctcacgccttcattcatccgcgagtagctttacgaaacgcagagaaattaacggaactcagccctatggaaaaagatattattcttaaacatatgtggggcgcaacagctgcactaccaaagtatcgcgaaagcgttgttgttagtttggtggatgataaggatgctgttgtggaatttttatcaccgatgaaaaagcgcgccatggcttggcggaaacgtaatgttgaccgtgtattgaatttattagacaagtaagttggattagattaggggtgcgtatatggatcaagttgcagaaaagaccacagacgccattgacttcgagctttgtccgaagtttgaatggacgttttcaattttagggaaaaaatggaacggcctgatcattgatgttttattaaaccttgggccacaacggtttaaggacatcgccaataaggtaagtaggtgttctgatcgggtattagttgaacgcctgaaggaattagaaagtgacggcatcgttatgcggaagacttaccgtaactcagctctgattgagtatgcgttaacggaaaagggtcaggatttagcaaacgtgatgcggtcaattcatggctggtcggaaaaatggtgtgacaatcaaaccacatcagaggttgaccaatgtcaccaaccgctgtaaactagtgattgtgcaaattgaaaaatgcaatgacgagagatcagtatttccgacacaatcatagagaagcgggtgtttggtggaaacccgcagtttgttaagaatgaattcactctttaagcagaggttgggcgttactcaggtaacaaaaaatcttccggttgatgaccgttatcaaattaccgagtgtactttattaaagtaaacaagggtggtaccgcgaaagcttcgtccctttatattaggggcgaagcttttttattttgttaaggaggatcagacatgacactgaaagaccagctggataaaatccggcaagaacgaaaagaagacatcaaagacgtagtcgatctaaagaaactggattcactacgagtggaactgttaggtaagaagggcccgattacgcaggctttgcgaggaatgcgcgatttacctgctgacgaacggccaagttttggtcaattcgctaacagtgttagagatgaactgcaaagtgccattgagacccgccgtgatgaattaaagaaagacatgctcaataagcagctagagcacgaaaagattgatgtgacgttgccaggtaagccagttgctcaaggccaacctcacgttattcaacaaattattgatcaaattgaggacttgtttattgggatgggctaccaagttttatctggtcctgaagttgaagaggataaatataactttgaaatgatgaacttgcccaaagatcacccggctcgtgatatgcaggatacgttctatattacaaaagaaattcttatgcggacgcaaacttcaccgatgcaagcgagaacgctggaaaagcacgattttagtcagggacctttaaaaatgatttcaccaggtgttgtttaccgtcgtgatactgatgatccgactcattcgcatcaattccatcaagttgaaggaattgtgatcgacaagcatatcactatggctgatttgaagggcactttagagctggttgcacatgaactctttggtgaccgatttgacattcgtttacgaccaagctacttcccatttactgaaccttcagttgaagcggatattacctgctttaactgtggtggtaagggctgtgcagtctgcaagtacactggttggatcgaagttttaggagccggtatggttcatccaaacgttctcgaaatggctggtgtagacgccgaagtttacggtggttttgcctttggccttggtcctgatcggtttgcaatgctgaaatatggtgtggatgatatcaggaacttctacttaaatgatgttcgcttcctcacccaattctcaaagaaaggataatcagccaaaatgaaaatctcttacagttggttacaagaatatttagatctccaagtctcgcctaaggatttggccgaaaaaattgaacgttcatcagttgaagttgactctgttactcaacccagcgatggcttaaagaaaatcgtagttggtaaaattgtatccatggaatcacaccctgattcagatcatctgaagatttgcagcgttgacatcggtgaggacgaattgtcccaaatcgtttgtggtgctcctaacgttgcagcagataagaaagttatcgtggccttgcccggttcaagaatcggtgacaacgttaaaatcaagcgttcgaagatgcgtggtgtggtgtctaacggcatgatctgcgcccttgatgaaattggcttttcaaaagacgttgtccctaaggaatgggcagatggtatttacttcttacctgatgatgctaagattggtgatcccgtttttccttatctgggaatggatgatcatcttattgacgtcgatgttacgcctaaccgtggtgacatgctgagtgtttacggtgttgctcgagatttaggtgcgatttatggtcagacgcccaaattaaatcatcccaaggtcgaagaagtagcaacatccgctgctgataaggttgcacttgatgttgataaagatttagcgccaatctataagatgcgtatcgttgaaaacgtgaagattcaaccgagtcctgtatggctgcaaattaaattgtggaatgctggcatgcggccaatcaacaacgtggttgatgtcactaactacattttattgaagtatggtcaaccattacatgcttttgattacggtaaggtttcaggatcaaccatcaaagcacgttatgcacaaaagggtgaaaagctcaccactttggatgaagcagagcacgaattaaacgaaaaagatattgtgattgctgatgaccaaaagccaatcgcgttggctggtgtcatgggtggtctcaattctgaaattgatgaccaaactacaacggttgccattgaatcagctgtcttcacaccaacgctgattcggaaaactgctcagcgtcaaaatctgcacacggatgcatcacaacattttgaacgtggtgttgaccgtggcggagttgaagaagccgttaatgcagctgcccaaatgatgcatgaacttgctgatggcgatgtcttgaaaggaattgtcactggttcaagctatgacgttaaagatgcagtggttgaagtgacgttatcacgtgtgaaccacgtgctgggtactgaattgacccttgaccaagttgaagacattttcaaacgactaggatttggcgttcaagttgatggtgaaacctataccgtgagtgttccttccacccgttgggacattcatattccagctgatttactggaagaagttgctagaatttatggctacgacaagattccagttacattaccgagtggtccaaccacggttggtgctttaaccgaaaagcagaaactgattcgtgattcacgtcacgtgctagaagcgttaggcctcaaccaagcgatttcttatgcgttgacgactcaaaccaaagcaaatcaatttatgatgcgtgaaagttcggaaactgagttgagctggccaatgacggctgaccacacgacgctacggatgaatttaatcagtggtttgctggatgatgtggcctataataacgctcgtcgtgtcaaagatgtggcactgtacgaacagggtcgggtcttctacaaagactcagctgatcaggtacggccaagcgagcacgaacacattgctggtgcagtaagtggacaattagtcgttgatccattaaaaaacgccaagcataatgccgtcgatttttaccaattaaagggaatcgttgaacaatatttggataacttagccattaaaggtgatgttgagtttgttgcaacgaatcgttatccagaaatgcatcctggccggacagctgacattaatattcacggtcattacgttggctttattggtgaagttcacccaacaatcgctgaggcttataagatcaatcagacctacgtgtttgaattagatttggacgccctgattgagatgccaaaggatatgaaccagtttgaaccaatttccaagtatccggtgattacccgtgacgttgccttgttagttgataaatcggtaactaatgcacaggtattagcacagattcagaaaaagggtggcgcatacttgaagtcggttgaactgtttgatatttatgacggtaaaaacttaccaggtggtaagcagtcgttggcttacacgttgacgtatcaaaatcccaatgcaacgttgactgatgatgaagttaaccaggcctttgaaaaggttcaaaagacactgaccagcgaactgggagctcagattagatagggcttcgtcagtcttttttcaaaaaacgctagaacttgcctagaaagctgttctaacgttttttgctttgagccagccagtggatggtcaacgagattcagtctatttcaaaattcttaagttcaccatatttttactgcattgatacttaaaatcttgtataatggggcagatattgaaaaatggaacggaggaaatactttggataacgacaagcagcccacttccaaacggccagggaagaaaaaaatgtcgaccggacaaaaaattattgcgggagtcgtcagtattttagcgttattgctaattataagtggcgtcgttttctataattacttccagtcggcgttaaagccactggatcctaagagtcaagaagttgttcaggttgatattccaatgggggcttctagtaaaaagattgggtcgattttacaagaaaagaaaatcgtcaaaagtggttcggtttttaactactatgtcaaatcgcataactactctgatttcagagcgggttattaccagctaaatgcttccatgacgttgaaccaagttgctaaacgcttgcagcagggtgggaccagcgaaccgattcaatccacaaaaggaaaagtacttgttaccgagggtgctggcatcgcggatattgcggataagatttcttcaactaccgattttagtaaggctgaatttttaagtctcatgaagaatcaatcttacatgaagaccctggaaaaacagtatccatcactgttatcatcatcaatggcatctaaagatgtgcgttatcaccttgaaggttatttataccctgcaacttatatcgtaaacaagaagatgtcgctaaagtcgttagttaaccagatggtggcgcatactaatgctgaactgacaccgtactacaaaaaaataaaaaagcagaaactatccgttcaacaagttatgacacttgcttcactagttgaacgtgaaggtgttagtcagtcttatcgacgtcaaatttctggtgtctttttcaatcgaatcgatcaagggatgccacttcagtctgacgtggctgtcgaatatgccattgggcatcataaacagcatctttctaccaaggatcttcaatccaattcaccttataatctttataagtttgctgggtatggtcctgggccttttaacaatccaagtatgtcagcgattcaggctgtcttaaacccatctgaccgatctaagggttacttgtatttcgttgctaatacgaaaacgggtaagatttacttttcaaagacgctgtctgagcacaataagcgtgttgcgtcactatctaaggttaataattagttattttatattgaagggatcaactaaaacatgtcagtacaacagtcaagaccagtcatcatcggtgttaccggcggttctagcagtgggaaaacgactgtgagccgtgcaatttacgaccagttacaaaacgaatcaattatgatactgcagcaagatgcctactacaatgatcaagctaatatgcctatggctgaacgtaaggcggttaattacgaccatccattggcttttgacactgatctgctgattgaacagttaaaacagctacgtgataatcatgcaatcgaaaagccagtttacgattacacgcagtatacgcgtagttcgcaaaccattcaccaagaaccaaaggacgtcatcatccttgaaggaattttaattttggacgatgaacggttacgtgatctgatggatatcaaggtgttcgttgatacggatgatgatatccggatcattcgtcggattgaacgagatattaaagagcgtcaacgggacttagatggcattattaaacagtacctaaccacggttaaaccaatgtatcaccagtttgttgaacccactaagcgatatgctgatttaatcgtgccagaaggtggcgaaaaccaggttgccattgacttgttgaccacaaagattcgttcaattttgattcaaaagaaaaacggccgtcctaatatttaattctaatattcgaatttaaagcttgcgtgaaagactgtcgcatgctattgtaagcgacagtaaactataaaaatgtaatgaggtgctattttggctgaacaaaaatcatatccaatgactgccgatggtaaggttaagttggaacaagaattagaagatttaaagatgaacaagcgtccggaagtaatcaaacgtatccagattgcccgtggttttggggacctttcagaaaactccgaatacgagtctgctaaggacgaacagagtatgcttgaaagccggatcaagacaattgaacatatgttgcaatacgctgatgtggttgataataataatacggctgaagatgaagtgactgttggtaaaaaagtcactttcaaagaattacccgatgaagaacctgaatcatataccattgttggtgcagctgaggctgatccaatggctggtaagatttctaacgactcaccaattgcaaaggctttgttgggtcacaaagtcgatcaggaaatcaccattgcaattcctgcaggcgatatgaaagttaaaattttaaaagttgaaagtgcttcataatttcacaaactttttaatcatcatgctaaagagctattccccagtggagtagctcttttgttaatttaacgcgctttatttcgtttgatttcatagcagtgaggacaaagacttgcacttttgtgaaatctagggtataaatgaattgaatgaaagcgcaaacaatttgttgcaaatgaaggagacacgcatcatgaaaatgattattactgatcaggcaagtaaatggtttcataacgaaatggggctatcagatggccgtggggttaggttttatggcaaggtttacggcaacacacctgtgcatgagggcttttcattagctatgacgccagatgatcatcctgaaaagccatatgcgatcaccaaaaaagatggtgtcaattattttgttcaagaagatgaccgctggtttttcaagggctatgatttgatcattaattatgatccgagcgttgatgggccgaaatacaattacgttgaaaatagtgagttgcagtagaacagttctatggacacaaaataaggatagctgagttatcgtgttgataattcagctatccttattttgtatttttaattaatcatttcgtcgctgtttgtaaatcgtgaaataacagataccaagactgactaaggtaatgatcaaaccagtattcagcattggtggccaatatttaaaatgaatcgtgtgatagccatgctgtagtttcaacgcagtgaagataccggctgctttaactggtttggttgaatgaccatcaacggtgatatgccagcctttgctgtaggggatggtcgtcattaaagtagcacttttgggtttaacattagttgaaccagtcaagctgctttgactgtgctgtgtgatttttagcggactggccgcaagctttttctggccagtgatgaattgctgattgttgaattgataaagggtaaagttttgcagccacaaggtcgatttctttaaagtgagttgtagcttaacgggtttgcctttttggtgatcagcaatgttaaccacaatcgtattacggtaggtaggatattgtgccagcgggtgattgtttaagttgattgagacgttatcatcgttcaggtttgatcctaatgtcaggtaatatgcatcgttggttttaggcgtgaagttaaaagtgatcataccaggtttaattaaattattcttttgtaaaatagcaccagtcagtttcgtttgctgtttcacgttttgaaaaatgacgtgatcgaagttctgagcgctaaatagatgttcgtcctgaaggttcccggttaaactggcccacaggttagcttgatattgcgttggatcctttgtcgtgttattcaaagttcgaattttattgctggcaagaaaaccaattggtaaggcatagggattacgatacgttgaaatcaaaccatctttacgaacacgttgataatcagtaaggtcagcacgagtagaaaccggattgacgatatttgaacctagggtacctgaatttgtttgtcggtcaatgacgtatttcatattaaataatgaatcgcttaaaagggtcccatttgtgtaggttacaaaaccgtcgccatcaggattacccatggcacccatgaaggttggcatgtccttttccagagttgacgaaaagacggagccaccattgaactgcccagacagcggatcgtttttagtccgcatgaaagtcggtgtcattcggtaccaaccgctatcatgatcagtcactttggcggattgtgaggctaagacctgctgataattttgaaattcaggtttagtgacgtaactaatccgattcaagctggtagcggcactgctggtcatttcaatcacagcgaacaggacgaaagcggtctgataaaaccatggctgcttattgggtaatgcaattaagcaaaatgctgcgattaatagaagggtaccaatcagtatctgattttgactcaaaaaggaaaagtggttcacgttgacccagacataaagcactgttcccatacagatgagaattgggacaatcagctgttttagcgttggtgtaaattcaggctgcagcgcattagcagctagccaaatgagccaaaaactgacaataaacgagaaacggtaggggtaccagattggaaattgcatgccatgccatagcaggtctaatggctcaaagcacagtgatagggctaaaatggcggtaactgctaaggctagccattttgttcggcgcgaatggttgttttgcaaaaaatagaagatcgcacctaaaaccattagactaccaataaacagattgggggttcccttcggcatttgattaaaattaaaactgcctagaaagaacttagctaacattttgggtggaaaatattcaaattttgccgaccagtctgtttgggtatactgatttttactgattcccaatgagtaccaagttggtaatagcgtcacagctgaaataccggcggctagtagtgatccactgataaaacgaagcaaagaagaacgggcagcctttcctgaatgggattgtgacagccagtaccacaggaagaatagtcccgcgaatatgcaaaccatataagccatgtaataattaatgatgagaagtgccgctaaccagccaacgtaggttctgattttgcctgtgtctaccagttggataatgccccagacaattaatggcagaataatgacagcatccagccacattaagttaagttgattagcaatcatccagcccattaaggcatagctggttgaaaaagccaaaactggcaggtgcttttgaaccttggttttcattagcagccaagcaaaacttaatcctgcagcaccgtacttaaggaccgtaatccagaagatggcgcttggaagtgatttatcagggaataagagtaggataaaattaaacggactcatcaggtaataagtccagacaccaaacatctcaccgcccaatgctttttggaaagtgtagaaaaaaccactaggatgactgagtaaagtgtgacggaagtaagcaaaaaaatcgacgtactgctggccaagatcgactgttagtaatgtcgatttgccaaatggtcccatcccgcgatagcaaaagtaagctgccattacagcagctggaataacgaagcttaaaaacagtagtgataatttttcgtgttgacgcacccattgaacaaataatctcaagaataaagccctccgatagcctcgtagaatggcatccatttacgagtatgtaagtattgatatatccatggtaatctagtgacaagtttctggtcatctaagttgcgtaatcgcatgtagttaattataccgtatgttgattgacaaacaatgcaaacaaagcgcaattaaacaggtcttaaaaacaatgagctgattgcgcggatttaaaatcataaaaagttttaaaaccgttcagtgttaatggtttcgctattgaaattctggtagaataatgaagttagataaggagcgtttaggacattgaaaaatttctttagtcgagttacccagcaccgagcgtctcgcagtaagacgtcaactacagctcaaattccatttagaatgaattttctattcattattgtaggactcttatttgcagcgttaattgcacaattagcatatttacaaattctccacggtacccagcttaaagctgaagttagccggacggatagtaccgttgaaacgaacaacgttcagcgggggatgatttttgattctactggtcgtgttttagttggtaataaaacccatcaagcaattagttatactaagggagtcaacgttatggctccggatatgtatcggatagctaatcgcttaggaaaatacctaacagtgccaaccggatcattgactcgacggaatagggctgattatttcttagcttcctcaaaacgggcgaagcaggtacagacaaatattccgggaatcaaaaatgccgcgcagtcggatgcttacgataaggagcttcaatatctgtatgctcatcctgctgactttcagttaaccaaacagcagaagaatgatgccatgatttacgctcgaatgagtggggcgtattcattgtcaacaacttatattaaggaaacgggtgtgaccagtaaggaactagccgaagtcggcgaacatctgggagaaatgccaggtgtaaaagttggtacaagctggactcgtgattatccttatggcagttcactcaagagtatcttagggaccgtttcttcagagaagattgggttaccagataataaggttaatcagtatctggctcaaggttattccagaaacgattcagtgggtcaatcctaccttgaagagcaatatgaatcagttctaagagggagtaaatcgcagactgatgtggaagtttccgggactaagatcatgaaggaagttaagcgttatggtggtcaaaaaggtgataatctgcagctgaccatcaatgctggtttccaaaagaagttgcagtcattagttcggcaagctgaaagtggtgccggtggtgtttcaactgggacttatgccgttgtgatgaaccctaataatgggagcatcattgggatggcgggtgttgaccgcaatccaagcacgcaaaaaatcactaataacgcgctgggcgccatcaataattccatcactatgggatcggtggttaagggtgccatggtttctggtgctttaatggatggtgtcatcacaccaacgaacaacaccttgactgatatgccaattactgttgggggaacgaagaaggcatcgtggttcaacaaaaacggtggtcaaaatatggccgttaatgcttcgactgccctagaagtttcttctaactcgtatatgatgcaattggcaatgaaggaagccggttttaagtattctgaaggcgcagcgctgaccatgaatcctagtattttcagcaaaatgcgtggctacttcaaccagtttggacttggtgtcaaaactaggatcgatctaccaggtgaaactactggtattcaaggttcaacgtctaaagcacatattgggaatgccttggatgaggcctttggtaactacgatgcgtacaccacgattcaagttgcgcagtacatgtcaaccatcgctaacggtgggtatcgaattcaaccgcatattttatcgtccattcgtggcaccaataaaaatggcgggctaggaacggttaaagattcagttactccaacggtgcttaaccacattgacatgacgcctgctcaacgcaaattagtcactgaagggctttatgatgttgtccatgggactaacacctggaagaccggtggtgaactggatacgattaagccggagatctctgccaaaactgggacagctcaaacttattataaagggactgaaaccgttaccttgagtttggcttcttatgcaccttcaacgcatccgcaagtggtcgttgctttagcaatgccaaacttggattacaacgctgaagataataacatgaagttggctaagtcaatttatcaggcctattggagttcggttcagtcgacatcgactttgaagtctggtagtacgacgaccaacactgccacagcaggaaactaaacttctatcagttttaattttgcctgtaaagtaaatttacttaacaaatataacatttagactggtaattactttgaataaatgataaaatactacgagttaaggctatttgccaaatcataaaaacgtagggaggtcacaagccatgcgcgtacacattacattagaatgtaccgaatgtcacgaacaaaactacttatcaagtaaaaaccgtcgtaacaatcctgaccgggtagagcttaagaaatattgcccacgtcaacacaaggtgacgttacacaaagaaacaaaataaaggcataggcgatgagcctgcgccttttttatttaagacaggaggaaacgaccagatggcaacaaaaaaagcagttcgtgaagagattattgcagcattgaacgccatgcctgatgatgttcgtcattttcaagctggaacgttatatgaacgattatttgaatccgaagagtggaatcacagtcaaacagttgcaattacactgtcgactggttttgagttggatacccagcccatcattgaggctgctaaacaggctcgaaaagagattgttattcccaaaacatttaatactgatcgcagcatgatttttttaccgttaactgacgaaacggtgatgaaagaatccaactttggtattatggaaccagaaaatggcactgcagtaccgaaagatcaaattgacttaattgttgttcctggcctaggtttcactaaaaagggagcacgtcttggttttggcggtggttattatgatcgcttcttagccgattaccaaggacgaaccgttacccttgcatttgaagcccaaatgtttaaagaaccaacttggcaagtcgccgatactgacgtacttgtccaacatgtcatcacgagccactaagggggcaaataatgcagcaacaactcaaacgctggttatctgggccatacatcaccgtaggattgatcgttgtgatgtttctggtgtacggtgccatgacgttggctggtggcagtcaaaacgctcaggtactggtaaattttggcgctaaatataaccccttgatccttgcaggacagtggtggcgttttataacccctatttttttgcacatggggtttgaacacattcttttcaatacggtaacactttattttattggtattcagattgaagccattttcgggcattggcgctatttagcgattttcttattgtctgggattggtggtaacttagctagcttcgcatttaaccctaattcaatttctgctggtgctagtaccgccatctttgggttattcggtgcttttctgatgcttggggagtctttttgggaaaatccctatattcggcagatgaccaaaacttttgtcctgttcattgttcttaatttggcctttggtctattcagtcctggtactgatcttcagggtcatattggtgggttagtcattggttttttggcaggatatattgttggtgtcccgaagctaggaaaaattagtaccgtaaaaagaattttagctgtaatcgttgccattcttatcatgattgggctatactattccggtataacgttgtaaaataataaagtagttgtgtgaaatttcggaggatatcgaaatgaaaacgctctatgatgtacaacagttgttaaaacagtttggtatatacgtttacgtagggaaacgcttatgggatattgaggtcatggcgttggaattggatcatcttcatgacgccaatgtaattgatcataaaacgtttgcacatgccaagttggttttgacacacgagcaccgtctcgaagaaacgcgagagaacacgaaataagtctggaggacacaagttcatggcaaagagtttgattggtattgatttaggtggtacaaccactaagattgcattcgtcacccaagagggcgatatcatgcaaaaatggagcatcccaactgatataagcgaaaacggtaagcatattgttcctaatattattgcttcacttaagaagacaatgacggactctggctataccaaagatcagtttatgggtattggaatggggacgccaggtgctgttgatattgaaaacgggactgttattggtgcctataacttaaattggacaactacccaacgtgtgcgtgaccagattcaggaaggcgtgggcttgcagctcgttttagaaaacgatgcaaacgtcgctgcccttggtgaattttggaagggtgccggtgaaaaggattctgatgtgatcttcgttacactcggtaccggtgttggtggcggtgtgattgctggcggccaattactgcacggtattaatggtggtgctggtgaacttggtcatattaccgttcagccaaatggttacctatgtacttgcggcaagcgcggctgtctcgaacagtattcttcagcaactggtattgtacatgttgctaaggatatggcagctgaatttaccggtaaatcacggttaaaggaactcttcgacaataacgaagaagtaacttcaaagatggtcgtttacttggctgataacggtgatattttggctagccgaattgttgaccgtgtgtcattctaccttggtttggcattagctaactgtgctaatattttgaacccagctaacatcattattggtggcggcgtgtcagcagctggtaacactttattatcaccaactacccgttacttccaagaaaacacgttccctgctgtccgtgactcaacacggatcaagcttgctcagcttggtaatgatgctggtgcaatcggtgcttcatcattagcactccggtttgaaaacgcaagcgcataattagtttggaaggacgagacagatggttattgcagcaatttcaacatcgcaactttatacgatcattttggtcgttttactgattgcttacttgctttggtatctatatggtatctatcaacgtaatcaagcagcaactttaattgacgaaaaaacctttagagaaggtatgcgtaaggcacaagtcattgatgttagggagaaaaaagactttgacgcgggccatattcttggtgctcgtaacattccctattcgacgatgcgtgcatactaccagggaattcgtaaagatttgcccgtttatctgtatgatcagggtaaggctatgagttctcgtagtgcggttttattaaaaaaacacggttacaaagacatttacattttaaaaacggggtacgcacgttgggatggtaaaactaaaaaatcctaagtgtgtgacgaatcgttgtgtaatcaaatttttatgaagtaacgtgtatgaaaaaagggacttaattgctgttaaatctagcaattaagtccctttttatgtttactaactattctctcagaattaaattttctaaactttagtaagcaaacccattgtcattttcacaaagtgtggtaacatgggatttgttgatggcgtatttgatataaatgcagtgtttctaaattggcattttgttgattggcgtcatttgaaattcattttaattacattttaatcttgttttatagaggttacgagcaggaagagtacttaaatccgctaggcaaagaaagttccagttgatgaaaagggaccttagcgttttaaggaagtgcgtctgttttgagacctatttgcgtaatggcaaatcgtcaggacacgttatcgtcctcaggcttgaaaacgagccgtaagcacacatcacacagggtggaatagcgatttcaatcgtccctatcagtttagaaataaactgatggggacttttttgttttcagaacattgcgatttcaaataggtcagtaattaaaacgaatattttagagcaggaggcaaaatcacatgagtagctggcaaattatccagcaaagtttaccgctttttgaaaaggggttcgttctaacactttggctgtcactgattggcattattggatcaattatcgttggtctgatttgcagtttgctgaagtatttccaagtacccgttcttggtaagatagccgccatctacgttgaaatttcccgaaatacaccgcttttggtacagctcttctttctgtattacgcttttccagtttttgggtttaagttgaatgcggaaatgtgtgggatcgttggtttgatctttctgggcggcagttatatggctgagggattcaatggtggttttgacggcgttagcaagacccaggttgaaacgggtaaggcaattggtttatcgcgtttgcaattagctcgctacgttgtttttcctcaaggttttacactgagtgttccggcattagcggctaacatgatttttttgatcaaggaaacctcgatttttacggttatcgcaattccggaattaaccaacactgcacttgatttgattggcatgtattaccgatccaatgaatatttgttcatgctagttgttgggtatgctattattttgattccattgtcaattattctcactattttggaaaagagggttcgttatggctcattcgggaattaacgttttatttgaaggccgtaacctcattcgtttgtttggcggattatggacgacggtcgaaattgcagcggttgcgttagtgttagggctaatcttaggtgtcgttcttggggttttaagaacctttcctagtcgtctgttgcgatttgtattgcgattatacttggaatttttccgaattattcccacggttgtcctgcttttcctgttttactatattctgccaaagcaaatgggtgttaacctacctgcaaatcaagtggcaacattagtatttgcattgtggacagccgctgagatgagcgatattgtccgtggtgctttaatttcagtgccaaaacaccaacgcgagtccggcatggcgattggcctcagtcgctggcaactttatcgttacgtgctgattcctcaagcggtttcgctggagttaccagctaccatcaacttagttacccgtgtgattaaaacaacctcgttgctgatgctgatcagtgtaatggatgttattaacgtcgggcaacaagttgtcgaagccaataaccaaaaatatcctactggcgtcttttgggtctacggtatcatcttcgtgatgtactttgtaatcgactacccactatcttggtgggcaaaacggatggataaaaagagattggagcgggcaaatggctaaagaaatcgtcaaagtcgaacatttggaaaagttctatcaaaagcgtcacgtgttgcacgacattaatttctcagttaatgaaggtgaagtagttgcgttgctcggaccctctggttcaggtaagagtacattgattcgctgcttgaacggtttggaaccttatcaacaaggtgaagtcaccttcaatggcgaaaaaattgtaccagcagaaaagaattggcaaaagattcgtcaaaaaatcgggatggtgtttcaaagctacgatctattccctaacttaacggttctggacaatattttgttgggacccgttaaagttcaacatcaatccaaagaggcggcaacagctagtgctgaaaaattactggatcaagttggcttacgcgagtatgaaaatgcgtacccgcggcaattatcgggcggtcaaaaacagcggatcgcgattgttcgggcgttagcgttgaatcctgaattaatgctatttgatgaagtcaccgcgtcacttgatccagaaatggttcgcggtgttttgaacattatttcaaatctagcacaagattctaacatgaccatgatcgtagtgacgcatgagatgaactttgctcaacagattgcagatcgcgtcttattcctggaagatggcaaaattttggaacaaaccaagggtagccaatttttcgaacaaccacaaactgatcgggctaaggcattcttggatagcatggatttttaagttttaaaactggtcatttcgttttgattcagcttgagaaaacatcgtttattaatttactaaccagactttttataaaaccaatcatatttagggaggaatcatagatgaagaaatttgggtttaagaaacttggactgtttttgggcatagctgctagtttagcgttggtattaagcggctgtggtagcagtagtaagagcagttcgtcagcaagttccaccaagagaaccggtcaaagtaccgtccaacaaatcaagaagcgtgggacgattcggattgccgtctttggtgatttaccgccatatggctgggttaataagcaagggcagcgtgttggttatgatttaactttagcacgccaaattgctaaagatctcaaggtaaagccaaagtttgtgcaagttaatgctaataaccgagtggatgctttgaactctaataaagttgatcttgtgttggctaactttaccgtgacaccagaacggaaacaagttgttgactttgcttcaccatacatgaaggtttctgttggagtcgtttcaccaaaatctcagccgattacgaaagctagtcagcttcaaggtaagaacctcattgtgactaaaggtaccacggctgaaaactacttcacttcaaagcagcccaatgttaagctgctaaagtttgattctaagacccagcaattcaacgcgttgaagaataaccgtggggttgcactggcggatgataactcttatctttacgcttgggttaaggaccagcctaaatacaccgttggtatcaaatcaattggaccaaagcaatacatcgcaccagctgttaagaagggaaacaagtctctcctgaactggacgaataaagaagtaacatcattgaataataaaggcttttttgacaaagactacaactctcaattgaagccatactttggtaaagaagtaaaaccatcagatattgttatcaagtagctgactgatttgatgcaataagcgaaaaactcgtagcttgaattccgttacaatactttacggaattttcggctatgagttttttgtttagatgcaatataaaatcccacaatgatttgaattacgaatcattatgggatatctaaatggacattgattgtataaagcttagtggtgagctgaacgggatttacgagctgcccgtttgcggttttcttcaaaccgttcttcttcgtcttcaattggttcgacaacttttttcttgaatgagagtgctgcacctgcgactgcgccaatagtagctacagtgccaaataaaaatcctttgatgaaatgcttcattgttaaaggccccctaacaggttaaaatatgatttgttacctacattatgcaggttttagggctaaatttccagtcattaacaaaattatagtggagtgatcagtttgaaaaaagtactggccatcattgggccaacggcggtaggtaaaaccgctttgtcattggaattagccaaacaatttcacggtgaaattatttccggcgattccatgcaagtttaccgtggtttgaacattggcaccgcaaagattatgcctgcggaacgggaaaatattccgcattatttaattgatatcagaaacattgatgaacgctactcagtcgccgattttgtggcagaaagtcaacgtttgattgacgaaatttccaatcgtggtggattacccatggtagtgggcggtacgggtttttatctaaaggcactactgtatgatttgaaccttggtggtgaccattttgagccatcagaaaaagttaggaataaatggcatgattatgcagcacaacacggtcagcaagcgctgtgggatcatttaaaccagattgatccggatgcagctcaaaatattccggtcaccaatgaacgccgggtagtacgtgcgttagaagtttacgagcgaacggggacgttattttcaaaacagcagaccgtcctaaaaccaaggtacgatgcgtatgtgattgggcttaataccgaccggagcaaagtgtacgaacgaattaacaagcgagtggatcaaatgcttgacgcagggttagtggatgaagcacgtcgtttatatgaggctgggggtgagcaatggcagtcggggaaaggcatcggttatcgggaactgtttccttactttaagggtgaaatttcaaaggataatgccgttgagaaaattaaacaggatacccggcactatgcaaagcggcaactgacctggttccgacatcaaattcctgtacattggtacgatatcattgctgatccaggcatcaaacgcgagattggtacatcagtttcagagtggcttgaaaaatgatgtgataaaacatgacatgaagtgttgacaggcaaacagatagtggtatgattaaacatattagagggaggtgagtgcaatggcagaaaaagaactacagcgatctaagtcagttttgccaattggtacagtcatgaagttaaccgatttgactgctcgtcagattcgttattatgaagaacaagaattggtgattccacaacgaaccgacggaaaccggcggatgtattctttaaacgatattgataagttgctcgaaatcaaagattatttggatgacggtatcaatatggctggcatcaaagcaatttatgcgcagcagaagaagcgagctgatgatatgaagaacgaatcgttgactgatagtgatgttcgtcggattttgcatgatgaatttctcaatatcagcggtttcgaacctaattctggtccttcattgcattcacagcgacctctaaaataaccacaattactgactgttaacacaatctatcattcaaggagcgattttatgccaaaacacgattacaccaaagacgatattcgtcaaatggctaaggacgagaatgttcaatttttacggttaatgtttacggatctgtttggaacgattaagaatgttgaagtaccaatttctcaattggaaaaactactcgacaacaagttaatgtttgatggttcttcaatcgacggtttcgtccgcattgaagaaagtgatatgtatctgtatcctgacttatcaacttggatgattttcccttggagtagtgatcgtggtaaaatcgcacgtgtcatttgtgaagtttacacgacagaaaacaaaccgtttgctggtgatccacgtaacaacttgattcgtgtgttggatgatatgcgtaaagctggtttcaccgactttaacattggaccagaaccagaattcttcctatttaagatggatgataatggtaaaccaactactgatttaaacgatcaaggatcatactttgatatggcaccaatggacatgggtgaaaattgccggcgtgaaattgtgttaacccttgaagacatgggctttgatgtcgaagctgctcaccatgaagtggcacctggtcaacatgaaattgatttcaagtacgctgatgcactacatgctgctgataacattcagactttcaaattggttgtaaagacggttgcacgtaagtttggtctttacgcaaccttcatgccaaaaccattagctggtattaacggttcagggatgcatctgaacatgtcactcttccataaagatggtaacgccttttacgatgaaaaaggtgatttgcaattatcacaggatgcttactacttcttaggtggtttgctgaagcatgcacgtagctttacagctatctgcaacccaactgttaactcgtacaagcggttagttccaggttatgaagcaccagtctatgttgcatggtcaggttcaaaccgttcaccattgatccgggtaccaagttctcgtggtttatcaactcgtcttgaactccggagtgttgacccaaccgctaacccatatctagccattgctgctgttttggaagccggcttagacggtttaaagaacaagatcgtgcctgagaagagtgttgatcgtaacatctatcggatggatgacaaagaacgtagtgacagtcatatcactaatttgcctgatacattacacaacgcacttaaggacttatctgctgatgaagtgatgcgtaaagctatgggtccacatctatatcctagctttattgaagctaagaacttggaatacgatgcttatcgtactcaagtttctaagtgggaacgcgatcagtacctcgaattatattaatgaatctctgattttttaaaaatgacggatagcctgtttaccagtcgatatgattggtagacaggctattttgacggttaaataacagtttagcggttcttctgggtgctgtgcagttgctagggatgaagatttcttttaaatatcgactttttctttaaaactgctttattaatcgtaaattatcatttaagattaagtatatacagcgagaaataacaatcgagggataaatatatgccgaataataatgaagaaacaaatcaggaagtaacgccgggtcaggctcagcttgattcgtcacttactcaaaaaattaaatacttgcagacactgcagtctgcgttacatgaacacgatgatcgtcagatttatgaattgatcgataagccacgttatgatcgtgaagttaagaaatcgagatcgacaactaagactcagaatttggcggacttggtagccaatgatcatgaacagctcagtcattatttaagtgagaatttaatcgattatctcggaaaaacttacccatttttctattatgatgaagttcgtaatggtgagtttgatatctactttggtaattggtgggatcgccgtaagtttggtaaattggacgtcttaaatgttgcctttgaatttgacgaaactgaatatggtaagctgaaacgctcctttgagttagatgcgcttaatcagcgttacaataccgataatatcgctgagatttctgctaacagcgctcaacttcaaaaactcattgatggtcaggatgaacgtgaccaccaaaaagaaacgctccgccagcagctcaaagaagttagtcaaaagagcacgttgccatgggattctggtaaagtcaaagaagaacgtcaaaccattgtggatcagttgtcaaaattagctgatgatgacgaagaagcaatcaatgctaataagaagatcaaggaaaacgatgaaaaaattctgagtctgtcaaaagaagataccattttgacgtatgagaaacagagcattcagcaaagatttgaagatttttcacactttgaatctcataatcaaagtttgtatacggactacctgacgagtttgattggtaaagggcaggtgaatgttgatgattaacgagaatgatccatcgacgctaagtacaagcggcagattactatcctacaataatgcagttaaagagggattaaagattggtcagcaattcaccgaactaatggaccaactgattaacactaaggaccctaaagaattggtggctgccgcacaaacgttatcggtctttgaacttgacagcgattacgtgacttttcctcaccagtacaataatgccgattactatttggtctttatgagccgattgcttgaattacatgaccaaggcgaagcaatcaccttagactcgcacgaggacaatcagcacttaactcagcaaatttcagcgttaggtgatctgggtgtgtttgcttttgtgtcagctaatgacaatactggtggcgtttactatcaagataaagtcacgggtgaaacactgttttacctgaatctcaaacgtcgaatgatgcgtattaatagtagtgcgattacaaaattgtttattgaaacgtatgcggacaagcttgaaaaagaacatttactgtcggcaactgacttgttaattgcatttgggcaagcgcttaaagctgacttcggcttcgatgttgacttcaacttgttagatacaagtaataacgaattttacgcctttcaaactagtaatctatccggcgaaatcgtcgataaactatttgtggctgcggcatcagaaaattacatgttgaagcacgataaagacggtgcggtgttggaattggcgccagacctcaagcttaagatagccagtcataacgcaactgggggagcagcctggggactgtatgtttctgatgaagatcagacggtttcctggttcaaagttttgttagaatatcctttcttgcgtaagtggtatcttgaaaatattgatgacttgcagattcgttcagacaacttagttttttagaggtgatatattgacgttagatttagctaatttattacaaactgctattcaacggcgtaatcagtttaattacgagcatcaggttgcagtgagtcctgaagaggggttacgggttgattacgtggcattgcacgtctcgttaggtcatttagccgatttaatgggttggtttaagttggtacaagaaaagcctgctatttcacctgatgagctgcttaaagcatacgttgaggtgattgaccatacctttcaagttgctgctaggcagacgtggtctcacttaattgtgatgacaccggatgatttagaggctttaaagcaaaaacggccggctaagagtttaagccaacaatacttggcaatttctcattttattgatcagtcgttttttgatcggcagcaagcggcctttcaacatgcttggcatttaattttaaaatggggatttgttgatttaggtttcactgaggaacaaatccaaaccgcttacttaaaaactaataaataaaagaaaagggattgtttatccaactcgataaacaatccctttttgaatctaaaaacgattaactgatgtgaagtaatttgaaaaataattgcacgtaagcgcgcttcggtgatgaacctaaatgctttgactgagctcgctgacgacttgcgctgagatacaattcccatacgcctgcaaatacaaacaagccgataataaatgagatgaaaatcatcgcaatccccccataaacttagatttcaattacgttacaagtacattatggttttatgacatcgaatttgcaagttattttattcaaaaagtttgggtgtacagacaattggttgagaggggcagatacctcttaaaacattatttgtatcgtacaataacacgttagtaaagcatctttattgacactgattttatccattaaaattaattttaatggataaaaattttcaaaaaaattctaggtaaactaaacccacgtgatcaaaacaatcatcacgggtagtttacctagaaaagactaatcgtttaattaaatagtgcggcaagagagattcgaaccctcgacctacggtttagaagaccgttgctctatccagctgagctattgccgcataacaatgaaacaacacgtataattatatgtgaatagtggggttaagtcaatcacaaaagcgatttattggtgactaaaactaatatttattcgattctgatgtcagcaattattaaatcagtttttccaactgtgttttagcgatagcttaaagaaagctggacaaatttccaatatattcaaataattggtagcgttttcttacaatttaatcgaatacaattgaaatactgtagcactcctgataaaatagggacaagttgatcagctggaattaatcatacttttggaggagtattgtttaatttcagattctaattttttgattgactaaacgtatcagattagatatttgtacggaataggcagttatatttcagtgaagtgatttgattaatggagggacgtcacttttattaaaggatggggaaacgttatgagtagaatgattgagatgaaaggcaagcactttggtcgtttgacagtaattcgccaaaacggtcaggatccaaagaatgctgatttattgtgggaatgtcgttgcagctgcggcaatatcgttacagtggatggttcacgtctccgcggaggctatgtcagaagctgcggatgtttgcgtcgggaactagcgcgtgaacgatatacaaaaaatgagggcttcaccaaaaacatgggaaatccgcagaatttacgcactagtgatggcattatggtttcttctattaaagagtctcagcgcaacacatctggggtggtcggagtttcctatgataagaccacggatcgttggttggctcgtttgatgtatcagggacactatgtgttgcttaaaagctttgaaactaaggcagaagcaattgatgcacgcaaagaagcagaaaaagtatattggcataaatcaaaaaagaacccacaaacagctatgtagaattgagtaaaaaattgggttaatacaactgactattggttacatcaaaaagagcgctgaatgttcagcgttcttttttagtttaaagattgaaaatttaaatctggttttgatgagtgaatctaacagcggtaccatacgcggcaacagactgcatgtcagtaccgattgaaccggagtcaaagcgcatcatgactacggcgtctgcgccaagttcaacggcgttttgtctcagccgttcaatcgccacgtctctggcctcaatcaacattttggtatagtctttaatttcaccaccaacgatgtttttcaggcccgcgccaatatttctgacaacgttttttgactgcgtggttaagccaaaaacttcaccaataatttcgtattctttaccaggaatttgctcagttgttgtgacaataatttctgacacatgaataccccctttatttgaagtcagtgtatcatgaatgattcgaaaataccaaattgatcagagtaaaatcttcgtaacttcaccagcccgaatgatgcgcttcttggcagtggcttcatcaacgataactaactgacctaaggcatcgacatcaatgactttgccggttactgaagagtgtccaatttgcatttgaattcgcttattcatcaggatcaaaagacgcttatattcaccaataaatttcgaattggtataggtggtgcttgagtaatatagattgctggctaattcaattaaaaagtttgtacgatcaaatgccgtaggtggttgtatgagcagatttccagcaattgtttcaagttcttgaggaaaattaggctggtataagttgatgccaacaccgataattactgactgtttggcaccttgctctactagtatgccagcaactttacggttgtttagataaatatcattgacccatttaacctgaactgaaaggttaaagcattttttgctcgctttgacgatggccattgccagactcgtagtaaataggccagttttttcaggctcaacggttaagcttggtaaaaccaatgaaaaatagagaccaccagcggacgagtaaaagcgacgagcacgcttgccgacaccggccgtttgctggtcagcccatatcaaacagggattttggatggtctcttgctgggctaatgtttttgcatattgattggttgaaccgattgagtcaacgtgcaataagctgattttagttttcgttcgatcgcgtaacttgttttcaatatccctgtcgttcattgttttacctccaagatgtgattattataacatatatcattttagtcatcatttggttaattagtttgataatcaaactattaaaacgattggaaacgctttcttaaatagtgcagatacgtgtaagaaagcgggtcgtacgtagtcaattttggaaaattacttgacagtgactctgattttagaatatgataacgccatcaaatactttgatgtttgaaatagttttgaaggaggtgctttgcgacctatgcaattaacttctcaagagattcaagagcttattcctaaccggttcccgattttttacatggatggcgttaaagaacttgttgctggcgaatcaatcactgctatcaaaaacgtcaccgctgatgaaagctttgttaacggctatcgtccaggtgaatacgtgatgccgccagcgttgattgttgaatcacttgcacaggcagcttcgattctgatcttgaaatcgccggcttttgagcataaaactgcttacttaggcgggatttctaaagctgaatttctgaaggacgttcacgcttcagatcagttagagcttaaagtcaaaatgaaaaaacagcgtgataatatgggcgttgtttcgtgtgaggctgtggttaacgaagaagttgtcttgaaggctgagctgatgtttatcgttgaacccgaagaaaccgtacgttaactaccgaaattctcactggtattgtttggaaatgggatcatttgcgaatcaaaataggtgatgaatagatggattattctacggccaaacgggtcaaccaattattaacaacggtatatggcgatattgtgagagtagaggaattggctctgagaacgagtcagtttaaagatatttccctcaaagaagtacacgctgtagacgcgatttcaatgtacgaacataagaccacttcggaagttgctcgtgagttacgaattactccaggaactttgacaactatggttaatcatttggttagaaaagactatgttaaacgtcttagaagcgatgatgaccgacgttttgtccgtctagggctgacgcgtcgtggtcgtttagtttatcgtgctcatgcgtcttttcatcggcaaatggttgaaagccttgctaaggggatggatgatgagcaacttaaaatcattgaaagagcactgttaaatttggaagcgtttctcgaattcgcttcaccaactccaaataagtgaggggttacttaatgacaggtattcaaattgtccaaagtgctagtacggtcccagaacgggtagttcccaatgacgagctgaatgcctacatggatacttcagacgaatggatttccacgcgaacggggatcaagcaacgacatgtttcaactggacagaccactagcgatttgtgtactcaagtcgcacagaagttgctggatcaaactgattggcaagcttcagatttagactttatcattgttgccaccatgtctccagactatatgacacctgcaacagccgccattgttcaagggcggattggtgccaaaaaagcgtttgcgtttgatttaaacgctgcttgttcgggttttatttacggactaaaagtggcagagggattactgcagactccaggtacgcgaggcatgttgatcggtggcgaagtcttatccaagttaattgactggcacgaacgctcgactgcagttttgtttggcgatggtgcagcgggtgttttgttagctaatgataagcaaactgagtcagcgtttctagcctcagaccttcagaccattggtgatttaggtgataagctgacggctggttatcagcctgttaactctgtttttgccagtgattcgactgacccgcaccagcgttattttgaaatggatggtcgggcagtttataagtttgcaacacatcaggtgcctgaatcgattcaacgcgcggtaacgaaagccggtctgttggttcaggacgttgactattttattttacatcaggcaaatcagcgaattcttgatcaaatcgctaagcggttggatcaacccagtaccaagtttctgactaatgtggctgattacggcaatacgtcggcagccagtgtgccaattttactgaatgaagttattcaaaacgacaccattcaacgtggtcaaatcatcgcgttgagcggttttggtggcggattaaccgttggtacacaaattatcaaatactaaacacaaaaaataaatgatagcttaaggagctcaaatattatgactaacgacgaaattttttcaaaagtacaggcaattattgtagatcaaactggtgaagatgcagaaaaggttactatgacgaccaacatcaaacaagatttagacgctgatagcctggatattttcgaagtaatcaatgaaattgaagatgaattcgacattaagattgaaactgaagaggggattgaaaccgtttctgatttggttacctttgttgaaaaacaattagctgacaaggagtaaaaacaagcttatgcaattagatccatttatgcagtcattaggattaaaatatccgatttttcaaggcggtatggcatgggtcgcagatggccgtttggcggccgcggtatcaaacgctggcggactgggaattattggtgctggtcatgcctctggtgaggtcgtagctcaggaaattgaacgggctaagtcactaactgaccggccttttggtgtgaatgtgatgctcctttctccacatgtggaagatgtcgtaaatgttattttgaaggcgcacgacagcattacggtagtcactactggtgctggggatccttccaaatacctttcgatgtttaaagctgctgatattaaggttgttccggtagtggcttcggttgcgcaggctaaacggatggccagagtgggcgctgatgctgtcgtagctgagggtatggagtcaggtggtcatattggcaagttgacgacgatggctttagttcctcaagtagttgatgccgttaacattccggtaattgctgctggtggaattgccgatggacgcggtttagctgctgccttcatgctgggtgcagtaggcgttcagatgggaactcgattcctcgttgcagctgaatccaaggttcaccccgattataaacaagcggtgcttaaagcgaaggacatcgacacggtaattactggtgaatacgctggtcatcctgcacgtgttcttaagaatccgatggcaaaacggtttattcggcttgaaaaggctgaggccgctaaaactgagcctgattttggcgaagttgaagaaattggtaatggtagtttgcggaccgctgttttaacgggtgatcgtgaaaacggtgcctatatggcaggccaagtggctggactagttaaacaggcacaacctgccgcggaaattttggctgatgtctatgaacaagctacaaaattgatgggtggtgtctaaactgaaggttggattattatttagcggtcaaggtgcgcaaaaaacgggtatgggtgaagagctgtatcagcaaaacgcaacttataaagcggccatcgaccaggctagtcaaacacttgatattgatttaccaaaactatattttgattcgtcagctgcagatcaattatctgaaacacggtttacgcaacctgcaatcgtagcaatgagctgtgcgctttacgaggttgtcaaagaacaactaccgaccgttgtagctggcatcgggcttagtttgggcgagtacagtgccttagcaaccagtggcttcatgaccactgcacaggcattgaaacttgttcaactgcgtggtcgtttgatgcaacaggctagtgatgcacagccaagtaaaatggttgcaatcatgaacacgccaattgagatgattcaagaagcttgcgatgcagccaaaagcaatggactggtttcaattgcaaacgtcaacacgcctaaacaagtcgtgattggcggtgaagttgaggcagtggatgcggcagttagttacttagaatcaaaagatgtcaaacgcatggtacccctcaaagtcagcggcgcttttcatacgcctctcatgcagccagctcagtcagaattgcatgatgcattaacaaaagtgaactggacacagggtacctttccggtaatcagtacaacgactggtaaaccatttaaaaccaatgaattaacacaaacactgacgaatcagctgatatctaccactagattcacggatgccattcagcaattgaatggtcaagttgatgttgtcatagaattagggcctggtaagacccttatgagttttgctcggaaaacagttaaggggattgattattatcatattgatgacgttgatacccttaataaaacgatgacagctttaaggggtgaataagtttggaattaaaaggaaaaacggttttagtgaccggcagtacacagggtatcggacttgctattgcgcaagcttttgcaaaacagggtgccaacgttgtgattaatggtcgccatggggcagcaaaagaggttatttcctcgatccaagcggaaaacgtcatgtgttgggacctctcggctgatatcactgatccagatgctgttaaaacgatgattgacagtgtttatgaaaaggctggtcagcttgatattgtggttaataatgccggtattgtgaatgataagctgcttaatcgaatgagtgaggctgattttagtcaggtgatcaataccaacttgaccggtacgttcaacgtgatcaaagcctgtctgcgaccaatgtataaagctcgccgtggggttttcatcaatatggcaagtgttatcggtttgacaggtaacatcggtcaagctaattatgctgctagtaaggctggaattatcggcttgactaagtcagtagctaaggaagcttcaatgcggggtattcgttgtaatgcgattgcgccaggtatgattgataccgcaatgacagcacaattgtccgataaagttaaagcggaaattttaaaacaaatcccgttaaaacgtctggggttagcccaagaagttgcccaagcagctatctttttagcagaaaatgactatattacaggtcaaaccatcacagttgatggtggcctaacaatgcaataaggagcgagtgtatgactagagtagtgattacaggaatgggtgcattaacaccgattggtaatagtgtttcagaatttgaagcgggtctactagcttcgaaggttggttttcaaccgattacacattttgatgccagtgaaactggtattactttagctggtgaattacatgatttcgatccgttaaaacgacttggcaagaaagatttacgccgaatggatgcttttagtcaatacgcaatgtatgctgcttcagaagccgtagaacaagcaggtattgatgaaacgaatactgaaccggaatcaatgggtgttatctatggttcagggattggtggtttgacgaccattcaagagcaggtcattaagatgcatgacaagggacctcaacgggtttccccaatgtttgtgccaacgtcgatttcaaatatggcttccggtaacattgccattcgttatcatgccaaaaatatttgtacaacgattgtgactgcttgtgcttcgggaaccaacgccattggtgaagcgttccgccaaatcaaggaaggccgcgcacaagttatgctgactggtggctctgaagcttcagttaacgaaattgggattgccggtttcgctgctctatcgacgttatctaaagctactgatccgaagaaagcttccctgccgtttgatgctggccggttgggcttcgttatgggtgaaggggctggtactttggtactcgaatccctggaacatgctcaaaagcgcggtgctaacattttggctgaaatcgtcggttacggtgcgacttcagatgcttaccatatgacatcaccagatcctgaagggacccaagcagcacgtgccatgcaactagccattgatgaggctggaattaagcctgctgatgttgactacattaatgctcacgggactgccactatgggtaatgacagcgctgaatcaaaggcaatcaataccgtctttggacaggacagtgatgtgctagtttctagcactaaatccatgactggtcatctattaggagcagccggtgccatcgaagctgttgcgacagtgggtgcactgcagaccggtaagttgccagaaaacgttggcgttgtcaatcaagatcctgaatgccaggtcaacttggtaaatgacgctaaccgtgaccatgaaactgaatatgccatcagtaattcatttggctttgggggacataacgccgtcttggcatttagaaagtgggcggactaatgacacttgaagagatccaagccattattcgtcaaatcaacgatagcgatattcgtgaaattgaccttgattatcaagatatccatctttatctcaacaaaaacaaaattagccatcaaaaaaatgaggctgttgatcaaaaatcggtctctgctaagtcagctgatgagcctaagcagccaattcaagcaccccagcctgatttagagacgccaaagccagcggcaaaagaagcaacggcaatcaaagcgccactcgttggcgtgatttatttgcagccttctcctgataagccggcatacaaatcagtgggtgatcacgttagcgttggtgaagtagtttgcgtgattgaagccatgaagatgatgaccgaaattaagagcaaagtggacggcaccatttcgaagatcctagttgaaaatgaagaagtggttgaatatgatcaaccactatttgaagtaactaaatgaggtgacaaaatttgtcagaagaagcagcaacacacgagttagacgtcgttgagattcagaaaattttaccacaccggtatccgatgttgttagttgaccgggtacttgactatgtaccaggtgaaaaagtgattgcgaagaaaaacgtctccgttaatgaagcctttttccaaggtcactttccaggtaatccagtaatgccaggcgttttaatcgttgaagcaatggcacaggctggtgcaattgcactgttgaccatgccagaatttaaagggaagacagcttattttggcggtatgaataaggttaaattccgtaaaatggttaaacctggtgatactctgaaattagaagttactctggaaaagattcgcggcaacgctggcctgggtcacggtgaagcatacgtcgaaggtaaaaaggtttgttcaggagatctcacctttatgattgggtaggtgaaaaatatgtttaaaaaggtcttaattgctaaccgtggcgagattgcggtgcgaattattcgggcgctgcgagaacttaacgttcagtcagtggcaatctactcaaccgcggatgcggatgctcagtatgtaaaattggcagatgaggctgtctgcgtgggcggtcctcaaccggctgactcttatttgaatatgcaaaatattgtgagtgcggcggtactgacaggtgccgaggcaattcatccaggatatggtttcttgtcggaaaatgaggagtttgctgagctttgtgagacctgtcatattacttttattggtccaaaaccagacacgatctcattgatgggaaataaagcaaacgccaggattcaaatgcaagcgggtaacatcccagtgattccaggaagtaccggttttttgaaggatgaggctgatgccgttaaagtcgccaatgaagtgggttaccccgtgatgctaaaagcagcatctggtggtggcggtaagggtatccgccgcgttaagaacgaaagtgaaatgcgcgaggcttatcaatcagccactaaagaagcccaactttcatttggtgatcagagaatgtacctggaaaaaattgtcgcgccggctaagcacattgaagtacaggtttttgctgatcgatttggtcatgtgacggcttttccagagcgggattgttcgttgcagcgaagacagcaaaaagtattagagttgagcccttgtccggtaatgacaccacaagaacgtcagcatttacaggaaatcgccattcgagccacaaaaacgattaagtacctaaatacgggtacgattgaatttttgatggataaggagcatcatttttacttcatggaaatgaacacccgaattcaagtcgaacatccaatcaccgaagcagtgtccggtatcgacttggtaaaagaacaagtcagagtagcttcaggagaggcactttcattcgaccaggaagatcttaaacctcaaggatttgcggttgaagctcgggttaatgcagaagatccatcgctggattttatgccccaagccggtgtcgttaaacagcttaaactacctggaggacccggcattcgtgttgatagtggtattcagtctggagatatgatttcaccattttatgattcgatgatcgttaaaatcatcgctcacgcgaaaacgtatcaagaggcccttaaaaagctaatcgatgccctggacgaatttgagttagatggtattagtgctaatcaaggctttttggaagacttgttagctgacccaatcgttcagcaaggaaccgccaccacggattatgtgacgaagcagttcatggcgaaatttgctagtcacgctattcgggaggtgtcttagatgtcatcgtttggggaacacgttaagcggttttcatcacgttctgtgtcgatgctgaagcactatcaagcaaaagtgcctaacggtatttggcaagaatgcccgcattgtcatgccagcttttactttaagcgtgcgggtcaatatcgggtttgccctgagtgcggttatggttttcgagtaactgctcgccgtcgtctaaaaatgttgacgaaaaactttgaagaatgggatactgatttggaaactaaagatccaactgaatttccagattatgagcataaaatcaaaaaagctcaatcagtcacgcatcttaaagatggtgttttgacgggcaaggcactgattgatgagtatccggttgccttaggaattatggatcctttatttattatgggcagtttagggactgctaacggtgagcggattgcccgaatgtttgaaaaggcgactgaacagcgattgcccgttgttttactgactgcatctggcggtgctaggatgcaggaaggaatttattccttgatgcagatggcaaaaattagtcaggccgtaaatgaccattcggctgctggattagcttatatttccgtcatcatggatccaacaacgggtggtgttacagctagttttgccagtcaagcagacattaccctagctgaacctaaagcattgtttggtttcactggtaagcgcgtcattgaacagaccattaataaacaactgccagatgattttcaaagtgtcgaaaacagttacaagcgtggctttattgatgaaatcgtttctcgtgagcagttgcctaaccggcttagccagctactgggaatcctcgaagccaaggagtggggtgacacaaagtgacagatacgcaatcaattattgccggtgctagaagtgatcgtaaagccaatgtttatgaaatgattgatcaattgtttacggatttttttgaaatgcatggtgatcaagtttctggtgatgattctgcaattgtcgcgggtcttgcgaagttgtctggccatccagttgccttggttgcgactcaaaaagggaacaatctggaagacaggatggctacccattttggtagtcccgaacctgctgggtatcgtaaatcgttgcgagtgatgaaattagctgaaaagttaaactttcctattataacgttgatcaacacgcctggtgcctatccaggtgcggatgctgaagcctctggtcaaggccaaatgattgctaaaaacatcagtgaaatgttaaaaattaaagtacccatcttaacgctcattatcggcgaagcaggctcgggcggtgcgctagcgttggcttgctcagatcaaatctggatgtttgaaaatagcatgtattctgttctttcaccagagggatttgcctcaattatgtggaaagatgctcatttagctgataaagctgctgagttgatgcggttaacaccagactggttattaaagcaacacgccattcaccgagttatcccagaaaatatgttatcagacggttcgctaaagactgaaatgacgggggtaatccgtgatttaagtcatcaaaatgtagccgatcgccttaaaaaaagagccgctttctttagaagattttagtcgtttgtcgaatctaagggttgacggatggccggaagttttgtagaatacagtttgttgtatttgtgggcttccacagctgcaaccgcacgggccaagtcttaagtctgcttaagcagcgcttgttctcggcgagtctaagtgttaaataaaaaggaggtgcacatacatgtacgcaattatcgtaactggcggtaagcaataccgcgttcaacaaggcgaagcagtctacgttgaaaaacttagtgccaatgctggcgacaaggttacttttgaccaagttgtttttgttggtggcgattcaactaagattggtacgccattagtttcaggcgcttcagtcactggaacagttgaaaagcaaggccaagaaaagaaggttgttaccttcaagtacaaggctaagaagggtcaacacacaaaagttggtcatcgtcaaccatataccaaggttgttattgatgctatcaacgcataatttctgtgggtgatcatttatgattcaagcagcatttgactatgataatgacaatcggattattggctttaaattaactggtcacgctgacagcggaccatacggtagcgatatcgtttgttctgcagtttcagcattatcgattagtactgtcaacggtttatcaactgtggcttctattgagccagtagtggttgctaaacaggaggagggtggcttcttaagtctccggatgcctccggttgatgactacattcaagatcgaattagtcaagcattattacaaagctttcaaaatggacttttagatgtcgaaaaacaatattcggactatattcgaattaactaatcttttatggaggtgaaactcatgttagaaatgaacttacaattcttctctcaccataaagggggcggttctactgccaacggtcgtaactctgccggacgtcgtctcggtactaaggctgctgatggttctactgtaaccggtggttcaatcctttaccgtcaacgtggtactcatatttacccaggtgctaacgttttgcgtggcaacgacgatactttgtattcaaagatcgacggtgtcgttcgcttcgaacgtaagggccgtgataagcgccaagtttccgtttatcctgtaacagaagctgcagctagataataaaaaggtccctcaggggccttttttatttggctttttgaggtttagaagggtgacttttcatgaatactcgacttgaacagttgcaatcaaagtttgaaacactgcgtattgatgcatttctagtcacaaatacagtgaacaaacattatcttactggttttgatggtgatggtgtagtcttagtaacagctagcaaaacttatgtgattacggactcacgatacgaaacagcgttggcagcttcagatcatgagtttgatgtcgttattacgcgttactacctagaagcggctgcccaactgattagcaaacaacagatttcggtcttagggtttgaagatagtctaccatttcacgactacgatcaaattgatgaattgatgagctctgatatcgttccaatgactcagttaattgaacaaatgcgagagatcaaatctgttgatgaaataaagacgcttaaacgagcttgtgagctaacggttaagggttttaatgcgctcctgccactgattaagcctggagtaacggaacgatacctagccaatcggttagatgcaatcatgcgtgatttaggggctgaaaaagctagctttgatacaattgtggctagtggcaagcgcgcggctttgcctcatggtgctgccacctctaaaatggttcagactggtgaaatgatcaccattgattttggttatgagtttgacggttatacttccgatttgacacgcacagttgctttaggtgatccgggtgaagaattgaaacgagtatacgatatcgtgcgacaagcccagcaagctattattgatgctgtgaagcctggagtgaccgggaaacaactagatacaattggtcgacaaattatttcagcagcaggttacggcgactactttaatcacggtacgggtcatggtatcggtttagatattcatgaaggaccggcactgtctacccgctcagaggatcaaatgatgcctgacaacgtgattaccgttgaacctggcatctatctaccccaacttggcgggattcgaattgaagacgatattttggttactgagtcaggtcatcagattttgaccaccggcccaaccgacctggtcgtcttgtaattcctaattatttgcgggtgtggcttgcaattgcctgcacttaattggtattattaataagaattatttaggaggaaacacaatatggcaatttctacagcagattttaaaaacggtttaactattgaggttgacggtgctatttggcggattgttgaattccagcacgttaagcctggtaagggtggtgctttcgtacgttcaaagttaaagaacttacggacgggtgccgttcaagaaaaaactttccgtgccggtgctaagatggaacaagcaccaatcaacactcggaagatgcagtacctttatgaagacggtgactcacgggtcttcatggatactgataactacgaacaaattgaagttcctgatgaagccatcaaggatcaactgaagtatttgcaagaaaacatggaagttaatcttatccaatacggctcagaaactttaggcattgaagtgcctaataccgttgttttaacggttacagctactgaacctggtatcaagggtaacacggcttctggtggttcaaaaccagctactatggatactggattagttgttcaagtaccattctttgttaacgaaggcgacaagctttcaattaacacacaagatggtacctacatttcacgtgccaactagacccggtctataagaatacgttggatcttttccaactattctcccaaaagccatcagctggcatggaacgtgccttagcaaacaactgcgtgctaaccgtaaattggtgagcatggtagcgatgttcctagaagctcgttattcttctagtaatgagtagttcacgaaacggaggcttaaaattggctgaagatacaaacattgttttaaaagcgactgagcctactctgggtaaaattgaagttgcaccacaagtgctagaaatcgttgctggtattgcagctagtgatgtcgacggcgtggcaagaatgcgcggttctctggcaaacagtgtcaatgaattatttgggaaaaaggaacgcggtaagggcgttaaactgtctgtgacggacgattcacttaacgttgacgtgtacgtctacttgaattatggcgtgtcagtaccaaaggttgctttggcgattcaagaacaagtcaaacagcagcttttgttcatgactgacttacatgtcaacgaagtcaacgtccatattcaaggcgtgattcctgaaaaaacggctcaggcggttgatcccgataatctattcgatgatgatgatgaaagtgaaaatggtgaggataagtgactgaagaattaaatcgacaccaaatccgcactcgcgcctttcaaacgttatttgcaatgaacgctaatccagaagctgatcgacaggtcatttaccagcagttattatctgatgaagacggtgtaacggcagatgttcctgcatacttagagaaattagtagacggtgtcttggaaaaccaagatcaactggatgctcaaatcaaaaagtatttgactactggctggacattacaacgaatcgcgaaaactgatttggttattttgcgcatcgctttttatgaattggattaccaagctgatattcctaagcgggtagccgtcaatgaagctttggagctagcaaaacaatttagtgatgaccgttcacgccgatttattaatggtgtactgtcacacgagattgaaccagaaaaatagttttttaaataagtcggtagtgatcgtgatgattgctatcgattttttgatacgccaaaatagtaaccgttaaacggttaacagttttaaaaaataagtcattcttttggcagaaccagtagcgcttaacaaattgaaatgtgataaaataatatgcagtagatttgtgaaattgtgatgagaaatcattaaactgacaaagatagtgagagtgaaggtaatggcagaattaattgatggtaaacagttggcgaagacaatcaatgctcgaacccaacaagccgtgacacaattgaaggcacagggaattagccccaaattaatcgtcattatcgttggtgacgatcaagcaagtcagatttatgttcgtaacaagcaccgtaaagcaaaacagttgggaatcatctctgaaactcggcagttgcctgaagagacttctcaagcggaactgttggaaataattgatcagtataatcatgatgatacagttcacggactcatggttcagtcaccgttaccgccacagatcgatgaagacgcgatcactcgtgccatttcgccagctaaggatgcagatgggtttaatccggtgaacgttggcaacttatattcaaattcaccacttaactttccggtatcatgcacgcctaaaggtattatgactatgttagcggcctatcaggtgaaactagcaggggccaatgctgtgattgtcggtcgttctaatattgttggccgaccaatggctgcgttactgcttaacgccagcgcaacggtaaccgtggttcacagccacactaaaaacatgcaagcttatactcgtgaggctgatattttaatcgttgccacaggtattgcccatctgattaagggtgaggatattaaacctggcgccactgtgattgatgtgggtatgaaccgtgatgaagatggtaaattaacgggtgatgttgattttgatagcgccgaatcagtagccggtaagattacccccgtaccaggtggtgtgggtccaatgacgattgcaaccctactgcaacagaccgttgaattagcaaaatggagtgaataatttggcacctagtgagtacttaactgtcagtgcattaacgagttatattaaacgcaaattcgatgttgatccgtatctggggaaagtttatctaactggtgagatttcgaactttaggcttcgacctaacgcccatcaatattttagccttaaagatgatcatgccaaaattagtgcgattatgtttaagtcggctttttcgaaggttaaatttacaccggaagaagggatgaaagtccttgttaccgggcgaatttcgttgtatgagccaagtggcagttatcaaatctatgtcgatcatatggaacctgacggtgttgggcagctttatcaagcttacgaacagttaaaacgtaagctgagtcaagaaggcattttttcagcacccaagaaaccattaccacgttttcctaagcgaatcgcagtggtgactagcccaagtggtgcagtgattagagatattattaccacagctcgtcgtcgctacccgattgcgcagattgttttatttccggctttggtacagggaaatgaggctgcgggagacattgttcgccaaattgaacgcgttaatcggttaggtcatttcgatactttaatcattggccgtggtgggggttcgattgaggatctatggccatttaatgaagaggcagtggctcgagccatttttgaaagtcagattccggtgatttcttcggtgggacatgaaaccgacacgacaatcgctgatttggtggccgatgttcgggcggccacaccaactgcagctgctgaactagcagtaccggttttaagcgatgttctgttggaaatcaatcaagatcgtgtgagaatttaccatgcttttcaccatcacctagctatgtatcaagaacaactcaaaaagttgcgggaagcgtatgtcttccagcagcctgaacgtctgtatgaaggctatagtcaaaaagtcgatcagttgacgacacagttacagcagactatgtcacatcggcttagcttggttcacgcacagattgatgcggttgataaacggttgaaggtggcttctccaactaatcagatgacgcaattagaacaaaatcggcggaatctaactgcacggctgaaccgtggtatgcaacaagattttaaccagcaaaaacagcgcctagccgaattagtgcaatcgttagattatcttagcccactaaaaattatggggcgtggttatagctatgttaccagcaatcaaaaggtggttgctgatgtcgatcaacttcatcagggcgatgaagtggtcatgcgcctgacaaatggacaggcaaatgcgacaatcaaatcaattcaaccaaataaaaaggatggccaatcatgagtgaaaaaccagcgaataaaaagacgtcggcagaaacaccaacgtttgaagaaaatctcaatcaacttgaagaaatcgtcacttcacttgaaaagggaaatgtcccgttggaagaagcgttatcacaatttaagcaaggcgttgcacttagtcacgacttacaagtcaagttaacggaagctgaaaagacgttagcgcaaatgatgaacgatgacgatcagactgaaccgtttgaagtttctgaggatgataagaatgaatgatgcttcatcacttttaaaagaatttgaaaccgaatacgttccccaaattaatgcaacgttacaacaccttaatgaggggtggatcaatcagtcgattcttcagtcagccatgacttattcagtggatgctggtggcaaacggttacgaccgttactgacattggccgtgctgaaaacgtatggtgttcaattgactgagggccagttaatggctgccagtgcgttagaactgttgcatacttattcactgatccatgatgacttgccagcaatggataatgatgatctgcgtcgcggtgtggcaaccaatcacgttaaatttggtgccggaatggcaactttagctggcgacggtttattgacgttggcgttcgaatggttgagcaatgccgatattccggcaacccaacagttgtcactagtgcgggctttaagccatgcagcgggaccggccggaatggttgccggtcaggctcaagatatttcaagcgaacatcatcaattaaatatcgacgaactggcaaaactgcatcgtcaaaaaaccggtgcgttgctgcactatgccgttgaagctggttgtattatggctgatgttaatgaagaagaacggcaagacctgctaaaatttgctgatcaatttggtttagcgtaccaaatctatgatgatttactagacgttacttccacagctcagcaacttggcaagaagacgcataaggatgccggagaagaaaaaaatacttatcctggcttatttggtgtcgaaggtactaagcaacggttaaaacgagtcgttgaatccgctgagtcacagctgaaggatttaaatcagataactggcagagattatcggttgctaaacgccttttgcagtcattttaaaattaaggaataggggtcattatggataaacaacgcgttgacgtattactagtaacccaaggcttatttgaatcccgtgaacaggcaaaacgtgctgtaatggcgggtgaagtcctaggcaataatgaagagcggctggataagcctggagttaagattcccgtggatactgacctgcatattaaaggtaagccgataccctacgttagccggggcggtttaaagttagcaaaagcactcaaagtttttgatatcgatgtgaccgatcgaatcgtgctagacattggttcttcaactggcggttttacggatgtgatgctccaaaatggtgctaaaatgtcctatgcgctagatgttggcagcaaccagctcgtttggaaactgcgtcaagatccaagagtggtcgtgatggaacacaccaatttccgttacagtaagcctgaagactttactcagggccagccaagtttttcctcaattgatgtttcgttcatctcgttgagtttaattctgccacctctgaaacacatcttggtaacagacggcgaagtcgtggcattaattaaaccgcaatttgaagcaggccgtgaacatgttggtaaacacggcattgtgaaggatcctaaaatccacgaaaacgtcattcaaaaggtaattcaacttgctgtagagagtgggtttagcccattgcatctggatttttcaccgattactggcggcgaaggcaatattgaatttctgattcatttaaaatccgttgctggtacgccagaagttgggcctgaaattaacgttaaggaaaccgttgaatcagctcaccgcatattaactgcataaaaatcgcattttgcttttaaaatgaggatcttagctgtatgatgtatttaaatgatttttccgattggagatggtgtgacgtgaagaaacaagaccgacagcgcttaattcgtcaattattgagttcacaggatattgaacgccaagaagattttgttcgtttgctggaggaacaaaatattcacgtgacccaggccacaatttcacgagacatcaaagaaatgcagttagttaaggtccctgcggcttctggtggttatcgctacaatatgccaattcaaaagacgctggatacgaagaaaaaattaaagcgaacattgcaggatgcatacgtcagcgtggctgttcagggtaaggatgtgatcatcaaggtcttgcccggtaatggtccagcgacttctgcgttgattgatcagatggattttgactttgtttttggcaccattggtgatgataaaacagttttggcaatttgcacggatgatgatggtgcattgcaactacaatcagtcattaatgaattattagaataaatacgagttaggctgacgctaagggtgtggtctagctcgtttttccgttatcaggtataatgagtctagacaacttacagggggtagtgcagtgcttcaggaactttcaattaaaaattttgcgattattgctagcttggacgttgagtttgaaaatggtatgacggtcctgaccggtgagactggtgctgggaagtccattattattgatgctgttggcttgttagccggtggccgcggttcgcagcattttgtgagaacaggtgctgataaagccatcatccaaggggcatttgtattccccgaaaacgggcaaacgtatcatcagcttgaccagttgggtatcgatcatgacgacggcacggtgattttacaacgggagatttatcgtagtggtcgcaatgtttgtcgtatcaatgggatgctagtgaacaccaatacgctcaagcaattgggcgaaaccattgttgatattcacggtcaaaacgaacatcaggaattaatgcagccggataagcatctgcgtttactggatgagtttggtggtgatgagttactagcaatcaagtccaaataccagagcacttatcaagattatcagcacttgcatcactcaatggtgtctcgcaacactcaccaaaaggaatgggcccaacgtttggatatgttacgttttcaagttaaggaaattgaggatgcccagctggaacctgatgaggaaaccaatcttagtcagcaacgtgatcgtctgatgaattttcaaaagatcaatacggcgcttcaagaaggttatttggccttaaacggtgatgaggaagttaccggcgctttagatttaagcggtaaagcaatggattcactgtcttcaattgctgatttagatcccgcttttaagcagttatcggattctctgcagtctgcttactacgcgttgcaggacgcttcaggtgagatttccaagcaggttgaccagttagaatgggatgataacaagctggatgaaattgaggctcgtttggatgtcattcaccaactgaaacggaaatacggtgattcggaaaagcaaattttgaactatttagctcggattaaaaaagaactggctgatatggaagctgctgagatcgatgagagtgatctggacgaacagctggataaaaaagaacagcagctcattaagtacggtgagcaactcactgcagaacgaaagcggatctcggttaaacttgaaaaggcgattcagtcggaattaaaagatttatatatgtcaaaaacggtgtttcaggtacgattcaagccaaccaatgatcagcagtattttgctactggcatggacgatgttgagttttacattcagcctaaccccggtgaagaaattcggccactggctaaaattgcctctggtggtgagctgtcacggttgatgctggcactgaaaaccattttttccaagtcacaaggcgttacctcgattatttttgatgaagtcgatactggtgtttcgggacgggtggcacaagcaattgcggaaaaaattagcggtattgctaatgaatcgcaagttttgtgcatcacgcatttacctcaagttgctgccatgagtgatcaccattacttcattgataagcaagtcaaaggtaagcggaccgttacccatattaagaaactcaatcaatcagaccgagtcaaagagttagcccggatgctggctgggacaacggtcacagagcttaccttagaccatgcgaaagagttattagacatggctactgaggaaaaacaccaacgtgcttaaggacatttactgaaagaatgcaaaaaggcacgttagcagttccaagtttcgaactgttaatgcgccttcaatattcaaactttagctaattgatttttgattaacggtaatcgttacgttccacaaacataatctgattcaaatgtgcgacctgagtaatgttttgactgacattcgtgactaacaatgtatccttgggcccctttgcaaggtaacccgacattagtgcttgttctttgcctgattgacgaagatgtagggtaacgtgataatgacgggtcagggcttgggccaaaaagtaatctcgttgttcctgcggcattcccataggttcagcatcgtccatcactaaaaactgacggtaacgatcgtttaactgggacgatattttcttaattgcagatacttgattggacattttaatcacctcgaacatttgtttgcatttattattatacgaacctgtgtttgcttttgcaaggataagtttcgataattttgaaaaatctacgctaaagcttgtcaaagcgcggtatcccgtgcgataatggtttttattatcactctgaaactaaataaggggatctcaagtaatgactaaaagaggtatgttgattgtgctatctggcccatccggtgtcggcaaaggaaccgtgcgtaaggctttgtttgacgaaccagacactgattttcagtactccatttccatgacgactcgtaaaccacgtgaaggtgaacaggatggcgttgattatttctttgtatcaaaagagcaattcgaagaaaacatcaagaatggtgaaatgctcgaatatgctaagtatgttgacaattactacggtacgccattaaaatatgtaaatgagaccttagattcaggtaaggacgttttcttggagattgaagttaacggtgccatgcaggttcgggctaattgtccagatgcagtctttgttttcctgaccccacctgacttaatggaattgaagcaccgattgatcaatcgtggcaccgaagagatgagcgtgatcaacgcgcgaatcaaaaaggcggttggcgaaatcaaaatgatgcgtaattatgattatgccgttgttaatgatgaggttgaaaacgcggtagcgcggatcagaaccatcattcgttctgaacgtttgagggttactcgcgtgatgccagattacgaacagatgttattagagggagacgaataaaatgttattatatccatcagtagataagttacttgaacgtgttaattcccgttattcattgattatgcttgcaagtaagcgagcacatgagttagaggctggtgccaagccaatgcttgatagttatgaatcaccaaagacgattggtcgtgcacttgaagaaatcgcggctggtaaagtgattatcgacccagatgaaactgatccacttggctagttttaatatttcaggaccgctgttttgacccttaataaattgggttaagatggcggttttgtttgtacaagatgccatttactctggtacaatgagaattaaattgatgagatgtctgggggaatttaaatggctaagcaacaacacgtagcgttatacgtaactggcagcatcgcggcctataaagcactagcgttgacccgactttttgttaaggacggggcagcggttcgtgtggtgatgaccaaggctgctgaagcttttgtcacaccgctaagttttcaaatattatcgaagaacgccgtgattactgagatgtttgccggagcacaggtcaaagccgtggaccatattgagttggccgactggaccgatttagctgtcgtagcaccggcaactgccgacatcattgctaaactagctaatggtattgcagatgacatggccagtctgactttactggcaacgactgcgcctaaactagtcgttcctgctatgaatcagcatatgttagaaaatgcggcaactaaacgcaatcttgacaccttaaagcaagacggtataaccgttatgacgcctgctagtggttttttggctgagggttatagtggtcgaggacgaatgcctgaacccgaggcaattatgcaaactgttaaaaacttaaagccgcataccacgccgctaaccggtaaaaaggtggttgtgacagccgggggtacccgtgaacgaatcgacccagtgcgctttattacgaatgattcttccggcaaaatggggtatgctattgctgaagaaatgcaagacaagggtgctgatgtgaccttgatttctgctcccactaagctagaagctccagctggggtgaacttagtacccgtattgaccactgaagacttggccgaagctgtaaccaaggcctttaagcaagctgatattcttgtgatggcagcagctgttgccgatttcaaaccgcttaatagtgcggatcaaaagattaaaaaatcggctgacaatgatcaaatgacacttcaattaacaaaaacagttgatattttaaaacaagttgccaaaataaagcaaccgaatcaaattaccgtgggttttgctgctgagacacaaaatttgctggataatgctcagcagaaactggtcggcaagcagcttgatctattgattgcaaatgatgtttcaaagcctggggttggttttaatggcgataccaatcaagttaccattttgcaacctggacaggcaccaattaaaaccaagctggctgataaacacattattgctaaacaagtggttgaccaaattagtcaactagtacaaaaagagggatagtatgacgcaaattgctgaggtcatcgtggatgtccctacgatgcagaccaatacgccttattcgtatgaaattccggctgccttagtcgatcaacttcagcctggtatgcgggtagtagtccccttcggcaacggtggtcgtaaagttcagggatttgtctggcaaattaagactgacgcgacacctgatcccgaagtgacgttaaaagcgattgaaaccgtcatggatcccgcgccagttgttaatgctgaactgatggaactttctgactggttagcaaacactacgtatgcttttactatcacgtgtctgcaaacgatgctccccaacgcacttaaagcgaaataccaaaagtgggtgagtcccacagatcagttgcctgcagatatccggactcgtctatttggcgagcaaaagaaattgttatgggatgatacactgccaactgaaattgtgaagcagctactggcacttaatcgtcagcgcttgattaacgttcattatgaagttagcagtaaatcgcaggtcaaaacgatgatgatggttaaaccaatcacgagtcatgagaatttgatgactgcaagaacgcaactgagaaaaacggcagttaaacaagcagaactgattgattatttaatggatcatcccgaaccaatcagtcaaatcgaattagaacgcaaaatcaacgtttccagcagtattttaaaaacgggagaagcaaacggctggctgactcgtaaagctgttgaagtttatcgtgatccttttcagacagctgtggttaaaacccaaccgttgcacttaaatccggatcagactaaagcggtgagtgcaatttgcgctgctactgatcaagaaaaaccagaaacttttctgttagaaggtgtaacggggagcggtaagactgaagtttaccttcaggcaattgctaacgcgctgtcacacggtaagcaagcactgatgctagtccccgaaatttcattgacaccgcaaatcgttggtcgtgttcgggggcgctttggccaaaaagtagccgttttacatagcggtttgtctggcggagaacgttttgatgaatggcgccgaatccaacgtggtgaagcacaggtcgtggtcggcgctcgttctgctgtctttgcaccactgactcatttaggggtcatcgtggttgatgaagaacatgaaagcagctataaacaagacgacaatccgcgataccatgcacgagacgttgcactatggcgagcccgttaccaccgttgtcccgttgttttaggcagtgctacaccttcactagaaagtcgagcacgcgctgaaaagaacgtgtatactagattattattgcctaatcgggttaatcaccagcaattgccggatgtgaccattgtagatatgactgaagaactgcggcaccacaaagaaagcaatttctctgggagtttactgcaggccttgaaggaacggcttgaccgtggcgaacagtcgcttttaatgttgaatcggcgtggttattcgtcctttgtcatgtgtcgcgactgtggctttgtgttgcagtgtccaaactgcgatatttcactgacccttcacatggacacgaagaccatgaagtgccattactgtgggcatgaagaacccattccgcatgtttgtcccagctgtcacggtcaccatatccgttattacggtacgggaacccagaaggttgaacaagagttaactgaactgttacctgacgctcgtgtcattcggatggatgtggatacgacccgtcgaaagggtgctcacgaacgacttctgaagcagtttggtgaccataaagcagacatcttactggggacacaaatgattgctaaaggattagattttcctgacgtgacgttagttggcgtgctaaatgccgatacggcgctaggactacctgattttcgtgctagtgaacggacttttcagctactcactcaagtcagtggtcgggcaggccgggctgaaaaagcagggcaagtctttattcaaacttataatccggaccattatgcgattcaattagccaaaacccaaaattacgagcagttcttcgttagggaaatgcagctgcgccatcgtggtaactatccgccatattactttgcggttaagttaactgccagcgacgtgaacgaacgtcaagctgctgaagcgatggttaaaattgttcgccagttgaaaacggtcctgagtccacaagcaattgtcctcggccctacgccgggagctattgcacgagtgaacaaacgttactattatcagttggtaatcaaatataaacgcgaacccaaactggatgctgccttgttcaatattttggggcaggcacaaaagcagagtcgtggcggattacaaattgccattgaccgaaatccaatgagttttatgtaagcaacgaaggagaaaaaaacatgacttcaattgtatttatgggaacaccagagttctcagcgccaattttagaagcactgattcaaaatcattacgatgttaaagcggttgtgacccaaccggatcgacctgttggacgcaaacacgtgttgacagcatcgccagtgaaaaaggttgcggtggcacatcagattgaagtgttacagccggcaaaaattggcggtagtgatgaaatggcacgggtgattgagattgcacctgattttattgttaccgcagcctttggtcaatttttacccactaaattgttaaaggcggcaaagacggcggcaattaacgtgcacgcttcgctactgccaaagtatcgtggtggcgcacccgtgcattatgccgtcatgaacaatgatcccgagactggtgtttcgattatttacatgatcaaaaaaatggacgctggtgacatcatcagtcagcgtgcgattcccattgaaaaaacggatgatgttggtagcatgtttgataagttaagtttacttggccgagatttattactggagactttgccgaagttaattgatggtgatgtaaatccggtaccacaagatgaatcaaaagtgactttctcacccactatcaaaccggatgaagaagaagttgattttaatatgtcagctgaaatgattgatgctaagattcgcggtctacggccatttccaacgtcatatattattttatcaggaactcgaacgaaactttgggacgtgacggttttatccgataaaactgaattgacacctggaaaagttgttttacacgaaaaacaccggttagtcttgtcaaccggcgaccacggcacgttgcaaatcaacgaattacagcctgctggcaaaccaaaacaaagtattacagattttctgaacggaactgaggatgccctaacagagggcgaacaggtggttaaactatgagtaaaattgataacaatccacggtcattagcggttacagccctgactcgtgttaaaaatggtgcatattcaaatctacaattaaatcagatgatcgatcaatcaaacatgtcacaacgagatgctggtttaatgacgaccattgtctatggcgttattcaacatcgactgacgattgactaccaactggcaccgtttatcaaaaatcaaaagcgggtcgctgactgggtgatgatcctgttggagacggctgtgtaccagatgcagtatttggaacgcgttcccaagcgggctatttttgacgaatcgattcagattgccaaaacccgtggtcatgaaggaattcggcgctttgtcaccggcgtactgcatcaaatggaccgggttggaatcaacgacccagccgatattgacgacccaatccaacgtcagagcttggtctattccgttccagaatggctgatcaatgcgttaaatgaccaactaggtgctaaaaaggcagttagtgtgttagagagtatcaaccatcctgctaatcagtccattcgcgtggcaactgatcaaatttcaatggcggatgctaaagctgaattagaagctgaagactataaagttagcgagagccaagttgccgcagagggctttgtccttaaaggcaaacccgctaatcaagctaagttgttccatgagggtcagattacgattcaagatgaaagtgctatgttgccggctgaaagcatgcatatcaaaccagatatgatgattttagacgcctgctcagctcccggcggtaaaaccgttcagatcgcaggtcaattatcagcggatgatcgcggtcaggtagtggctttagacatccatgaacataaagtgcagctagttaagcagaatgctaagcggatgcatgttaacgaccgggtcgttacgcaagccattgatgcgcgtaagattcaagacgtgtttgaagaccaaactttcgatgaggttttagtagatgccccttgttctggaattggtttggtacgccggaagcctgagatccgttacgagaagcaacttaaagatgtgcaggcgctgtccaaaattcagttagatattttaaatgcggttgctcaaaaagtaaaaattaacggtataataacttacagtacttgtacgatacttaatcaggaaaatcgggacgtggtggcggcctttttggctgatcacccagaatttgaatcacagcgagtcgaaacagcgcttgatttaaaaccagaccgaacaactgattatcttgaaatttaccctgacgattatgattctgatggtttcttcatcagtcagttcaaacgggtacgttagtggaggatacagatgcagattgcttatcgaacagcaataggaaagcgtcgtaaagataacgaagatagcgtcggtatctttacgaaccagcagggtgtaaaacttgctattatcgctgatggtattggtggtaatcagggtggtgacgtcgcttctgagatggctgtaactcatattggccattcatttaaagcaagcaacgcccaaaccattgacgacactaaaaattggctgcaaaagcagatctcctctgaaaatcaggacattcgtaaccgttcggaacaatttattgatctcaaaggcatgggcaccacaattgttttagctgttattttcaaacagacggttttgattggcaatattggtgatagtcgaggttatttgttgcgtggtcacgttttttctcaagtgactgaggatcattcgctggtaaacgagttggttaaacgtggtgaactttcaaaacaggctgcacgtgtgcacccgaagaaaaacgtgattacgcgatcgttagggatagagaaggctgttcaaattgacatgcattttcttgaattaactgacaacgatatgttgttgctttgttcggatggactcagtgatatggtgaatgatgatcagattcaaactgtgcttgaaaacgacgctacggtacaggagaagtgtgatcaactcattaagttggccaatgatgctggcggtttggataatattagtgtgatcttaatcgatgaccgatcggaggtggctgactgatgcgaccaaattacgttttaggtggccgataccgaatcaccgaggccttaggtgaaggtggaatggccaacgtatacttggctcatgatctcattttagaccgtgatgtgtcagtgaagttattgagacttgatcttcgagatgacccacacaccatcaaacgatttcagcgcgaaggtttggcggcaactgaattagtccatccaaatattgtcagcgtatatgatgtgggcgaagaaaacggcatgcagtacatggtcatggagtacgtgaaaggtatggacctaaaggcctatatcaaacagcattttcccattccctaccaagaagtgatcaacattatggaacaggtcctgtctgcagtggcagtggctcatgcccataacattattcaccgtgacttaaagccacagaatattctgattgacgacaagggtgttgctaagattaccgattttggcatcgcggtggccatgtcagaaaacgcgttgacgcagacgaatacggtattaggttcggtacactacttatcgcccgagcaggcccgtggcggcatggcaaccaaaaaatctgatatctattcgttaggaatcattctctatgaactactgacgggaacggtcccctttaaaggcgaaacggcgatttcaatcgctatcaagcattttcagtccgaaattccttctgtgcgtgaatttgatccgcgtattcctcaagcattggagaacgtggttttaaaagcaacttctaaacggccttcagaccgctacgaaacggttactgatatggcgaatgacctagaaacttctttatcacctcggcgagcatcggaagctaagtttgtaccggccgcagatgctgataacggtgaaaccaaggttttagataaatcggccttacactctgaagttgctcatcaagagccaaaaccagatgatgtccctccgtcgaaacccaaaaagcggcatcgacggcgacactggctttacgtcttgtttggcctagctgcggttttaatcgccatggttggtttagccttttggcttggtcgcccacagaccgtgacggtgccggatgtcagtggtctaaccattgatgaagcccagcaaaaactttcagatagcagcttagacacgggttcaatcaagcggcaatctagtgcggatattaagaaaaatttggtcatcaaaacgtcgcccgccgcggaaaaatccgctaaaaaagattcaaaaatcaagctttatgttagtaccgggccacgaatggtaagaattgggaactatattggtcaatcttatacacgtactgcagcagttttaaaagccaagggagtaactgttagacgccagaacgaatcgtctaatgaggtgccaattggcagcgtgatgcagcaaagtgtcgagagcggtcagcgtatcaacccaaaggagactacggtgacgttaaccgtttcagccggtcagcggcagttgcagttggctaacttaattggtaaaaagaaagcccagattcagcgctatgcaacgcaagaatcgctcaacatttcgttcaaatatcgctatgataatgccactaaagagacagcaatcgaccagaatccggctgccggtagtatggtgaaagaaggttccaccgttgttgtgacgctgtctagaggaaagaagccagtttcgaaatctgaacccaaagttgaagatttcaacgttgacgttagtattccttttgaggcaaatagctctaagactagcggttcaggtaaaacgagtgtctcttcaacttcaggagtcaataccgttcagatttatattcgcgaccatgatcatgattatggcaccgtctataaacagttgaccattgctcaagatacgcaggtcacgattcctttcgccgttgaatccggcaagagtggcggttataagattgttagggatggcaaagtgattttagctgataacaatgtcaccaaaaacgcgcattgattataagatatcgagtgtgtgacaaaaattggtagattccagaatttaacgcaaacttactaacattagtgatgtaatcaatctcgacggagatggttacatcacttttttgataaagtgatagtggaactaaggtcgtaaggcttttaggcatacatgccgtaacgcaacaaattggccgtttcacagtgtttctcgaaactttctctaagtaagttaggcgctcgacgccgatattgaaattaaactgtagttacattttgaaacaagttccaacttcaggagtaattactatgcgtaccagtgattggaattgatgtctcaaaggcttcttcacaggttgccatattggtagatggtcaattgtccaacgaattaagattgataataaccagagggctttcaaaacttgatcatttaattcagattgccacaggatcagttgagattgttttttgaggcaactggtgtttattcccggcgattaaccgcacactactccgggtcattgtggagaatgccgcaccccagcgtctccttatcctgagcctgttcatggtgtgtctaattcaggccggcgtccttttcctctactcggcgttcttgtctcactgacctattatccattaggcattccaaaagggatgatgacacattctcctggcgcgccaccccccgtcatcggcccttcattgcgccgcatccgcgactgtccttttcatatgtgaatctcgcgcgccgctaacacaaccatgcgcggccgcatcgaccgataccccataggcggatacaagcagacccacgaacacttgtaatagacctgtccgcgatagtgccctcgttcgtgggtgtggccgaacccccgcgtcctctgacatcctcagctgcccactagcctgtcacagggtcacatagacaggttgatgctacgtgcctaccagggcttggtatctatactgtcactatctgtcccaccgtaggggcaccctcctggctggtggtcctcctcgccggtccggcataagcccacatcctgcggatgcgagggagtcaggtaaccggcaacagcgccagcgcgcggtcctgacgccggctgcccaagaacttcaaatttgagtcgttattatcagcaagtaaagatgacttagtacgcggtaaaccgcttgcataaagccttacaaatgacttttcccacttgaaggctttgtcgaccaccagcggggatcaatattggacctagtcgcacaattcccacatgcagatagttctacaacatgaagttgaaatactggcaacaactcttgagctcaactaaacgcaatatgtcagctaagcgagctaatgacttggcaaagcgtttaaattggcgcatctaacagcaccacagtttcggcaaatagctacgaagttaaagtaatcccaaattagctactactaattaatgagcctccatcatgaaaacaaaattattgatcgcatggttaagctttgcgcgaaccgttacctgaataccggatactaatgagcctccctggtttcgcagaaacaacctcggtatccctaattggcaacatggtgatattcgtagattcaaaaccgctaacaaacttaatgctttcattgggattgatttacgatcaacgatttctggtaactataaagtagcggttttatcactagcgaggcaatcacctagcgcgtaagatactgtttaaagctattggcaacatggcatcctcagcagctcaaatcatccaattcacattattggtatcagaaaagaaaaagatctctttcgtctaaggggacgaaaaagatcaccaattgggtgcaatggatcgtctaatatccacaattcccatttggttctaacgaatcaaacctatgattatacttgttgcccccccacaaacaccagcataactaaattttagcctagcatgtcctaaaaaagttggcaagaggataggcttatttaagtgtacctaatatttaccaaactactattcagtaagcaacgaaaaggcctgaagtacttgacttttggtagaaaaataaagcctattccgacgaccttttcggaataggctttattttgcgttaaatggccagaatctgagttttggcacatgattaggtcatattgacgcattgaaccaaagggcaggcatcgctaatttttgctgaaaaattaattgaaatgcttgccaatataaacttagggcacaacctcttttttggatgattactagtttcagcaatagtaagtgaaatctataacttgtaaacccttcttaacggttcactgatcagaatcctttttctgatcgctgaacgcagcgtgcagagcgaccattgccgctttggctgaaatattagcaaccaagttaaccatatctcgagaagtttcatccttggtgtctgacgctaaactgtcgacccaagcatgtagtgccttagaagctttatcaaaatcaggttcattgttattcaagctaatcgtctccttccaacgataattatctcactatctatccgttacagaaaggtagcaaccacttattaatcagtagagactgttccgacgaacttttcggaataggctttattgagtacttaccaatatcgacttatatcatggtcctttgttgaatacagctatccaccccggaaattttagattggtaagcaaaaatggaagccaattttgatttatttttggtaaaccctgttaaatcaatggacttaaccccaatagttcttttataatgaacaaggactggtttttaattattcagaacttagaaaggtggcgttgatgtggcggaaggccaaattcgacaatcattaagtggtttttacgatgtcatgacggattcaggaagactggtgcgcacacgtgcacggggtaattttcgtaaccggaagattacaccattggtcggcgatcgggttgtgatcgatgcgccgaacgatcgtgaaggttatattttggaagttaaaccaaggcataattcgttggttcgaccaccggttgctaacgttgatcaggcaatcgtggcgactgccgtgcgtgagccggtcttttcgactaatttactagatcgacagttattagcactggaaatcgcagatattgagccggtcatttacctgacaaaaacggatctgctgactgcagctgagcaggatgagtttgccaaattggcggatgactaccgcaagattggttatcacgttgtttatacggcggaaccattttcagcagctgctattcaagaagtggatgatttactggctggtaaagtcagcgtcatcatgggtcagacgggtgctggtaaatcgacattactgaatcacgttgcgcctgatttaaagcttgagactggtgaaatatcagccagtttgcatcgtggaaaacatacgacgcggcgagtacagctactggaagttgcaggtggcttgattgccgatacaccgggattctcctcctatgatacgttttcgcttgatgcacgggaattaggcaaatatttccgtgaatttcgcagagcgtctgttgactgtcgttttcgaggttgcgtccacgtcaatgagcctggctgtgctgttaaagccttagtcgagtcaggcgatattttgcaaagtcgttacgataattatttactgctgtatcaagctctgaaaaatcaaaaaccaaactatcgcaaatctgagaaatgagggagtatgtatgaaaatcgcaccatctattttaagtgcagattatgttaatcttcaacaggatatcgaaaaagtggacaaagctggagctgaatacctccatattgacgttatggatggtcaatttgtaccagctatttcttacggtccaggttggttaaaggccattcgtccaattaccaacatgactttggatgttcatcttatggtgcaaaatcctgaacgtttcgtggaacaatttgctgaaaacggtgctgatattattggtgtacacgttgaggcaacaccacatattcaccgtgcacttcaattgattaaaaatgctggtgcaaaagcggaagttgttatcaaccctggcacctctgtggaagctatcaagccattgctttacatggtggatcaagtgttagtaatgacggttaacccaggttttggtggtcaaaagttcctgcccgaaacactaaagaaaatcaagcagttagaccaattgaaacaaactgaaggctacgattttgacatcgaagttgatggcggcgttaagaacgatacgatcgtagactgtcaaaaagctggtgcaacagttgctgtcgccggttcatacgtctttgatggtgttgatcctgctgctaaagtccaagctttaaaggatgcgacgaaataacatgacacatttaaacttgctggtaggtggtcctaccagtgaatggcccaaccaactgactgccggcaaggtgtccggtgattggatcggtgttgaccgtggaacattaagactgttgaagatgggcattacaccgttagttgctattggtgattttgattcattatcagcagacgaacttaaactggttaagagcgccgtttctgacattagacaggccgttcccgaaaaagatgagacggatacacagcttgccgtaacggtcgctttacatgagtatcaatatgatcgattagatatttatggtgccactggcggtcgtctagatcatttcttagctaatttctggatggtcttagaaccccggtatcggcaatacgcgccccaaattcgctttattgataaacaaaacaccattacgttttttgcaccaggttcgtatgagataaaaaaagaaccggacaaaaaatacttggcgtttgtgacacttgaaaatgtgggtcacctcacgctgcctgatgaaaagtacaatctgaaggacgaaaacgtgacccggccaatttcgtatgccagcaatgaatttattggtgacaccggccatttttcattcgatagtggcatggtcgcagtcattcaaagtaaagattgattatgttctctaagttcccgtcatcatcatatgacgagaactttttaattatatatgacagcgactgtcaacgctggttttgaatccgttttcgtaaatatgatagaatagtagttgatcataacggaacaatattaatgaaagattagtcaaggagtggatagaatgaaagtctttaacgatcattatgtgacaaatacaaagtcagaaatagccgtctttatggtggatggcaaacgtattgaagtttcaaatggcggtgctgatggagagcaggacattcaaattattccaatgtcggaattcgatgattacaaagttgatcccgcaaccaaaaccgaaattaacggtgaagatatccaactgttagattttgacggtgaaacggatgtacctcaagccgccatggtcgatggtaaaatgacgtcaatcacgattaatcgtcccgatattttaccaaagggtcactatgttgcttatggattggcgtctagttttggattaaaacggggctgtgtctatctgtttaaagattaatatactatgacacggtattttcgagacagtatactggtctcattaagaacgaaagtgagcgactaacgtggcatttcaaacacactataactttggcggggctaaaacccacaacggtggcagtaaatcggctgccaaaaaagcactcaagcaattttggcaatatattcagggtcaaggagctcagctaagtgatccaatcacggttagccaaatttcaagtatgcaacgcaatctcttgtcgtatggctctcgcatggtaaacagttaccgggtttctggtggggcttatgacacaacgttaacccagtacgtgactgattgttgtggctacctggatcaatttataacgtctgatacagctcatttagctgacggctcgcttccagacaatcgacaggccttcatggttaagtttgaacatcaggttaatcaactgattcgtcgttatgaaacagccattactaagggatgattgaaatcccgagtctatcattgttcccagtcataactaactgaaaaaacaaaaaaaccactgacagcgaaattgatcgtcgtcagtggttcttttggttgaaagaaaaattttaaaaaattcacaaaaaaagcttggcaatggtgccaaacttttttaactaaactcgagtcactttacctgacttcaaagttcgtgcagaaatccaaaccttcttaggcttgccatctactaagatccgaactttttgcaagtttggcttccaagcacgccgtgttgaattcaaggcgtgagagcgcttgttaccgaaacgggtgcgcttgccgttaatgaaatcttttgccattggtaactacctccttttagacttatctaaaaaacgttgctttttagctcactaaaataatttatcataaccccaatcggaatgcaatagttttctttcaagtaattttacttgacagcacttaagatgattaattatgataacggtaatgcacaatttgtggtaagataaattatcgtgaagactagtatgcaaggaggctgctttagatggccgttaaaattaaaacaaaacatggcttaatcgatattgataatgatgtcattgctacagtcgttggtggtgctgccaccgattcatatggcgttgtaggtatggcaagcaagaatcagattcgtgataacatgaatgttattttgaatcggaataattatgccaaaggcgttgtcgtccgtcaagaagataacggtgtggctgttgatgtgaatattattgtcagctacgggacaaagatttcggaagtttcccgaaccgttcaatcaaaagtaaaatataatttggaaacaatgcttggaatcactgccaatgctgttaacatcacagttcaaggcgtccaagtattgagtgagtaagaagcggaggataaagttgttgcaaacgaaagaaataacgaatcgtgaattcatcaaaatgattgaggcagcttcagcattccttgatcaaaatgctgaattcattaattcattaaatgtgttcccggtacccgatggtgatactgggaccaacatgagtttgtcgttggatagcggcttaaagtacgttaatgaatcaagtagcactaaggtcggtgaattagctgaagccttggctaagggtctgctaatgggtgcccgtgggaactctggtgttattttgtcgcaaattttccgtggcttttccaaggatgtcgctgataaagaaactttgtcagctactgatttggctgacgcgttcgctgctggtgctcaaactgcttataaagccgttatgaagccaactgaagggactgtcttaacggttgtccgtgaagctgctaaggctgctcggaagactgccgcacgtgaggatgatatcgtcgcagttatggatgccacttataaagctgctgatgctgccttacaaacgacgcctgatttattacctgtgttaaagcaagtcggtgttgtggattcaggtggtcagggcttaacgtttgtgttccaagcatttgatgacgtcttaaatggtcgcgaaacggctcaaaagggtgctcatcaaccgaatccgaccgagatggatgaaatggtcgatgcagaacaccatcgcagtgtacagggtaaaataaaccctgatgacattgtctacggttattgcacggaaatcatggtcagaatcggtaagggtaaacaagtagaccaaaagtttgactacgatacattctatgattatctcgcaaaactaggtgattcattgttggtcgtcaacgatgatgagattgttaaggtccacgtccatactgaacacccaggtaaagtcattgcgtggggtcaaaagtttggtgatttagccaaggttaaggtggacaacatgcgtttacaacaggaaaccattattgaaaaagatgatgaggatgctgcaaaagccacaccagttgcaactgcggaaacacctgctgaagcaccagaaacagccattattacaattgctgctggtcagggtatgcagaccttgtttgaaagccttggggcaaccacggtgatttctggtgggcaaaccatgaatccaagtacgcaagatatcgttgatgccatcaatgacagccacgcaaaacaggcgattatcgtgccaaataacggcaatattttcttagctgctgaacaagcagtgaaggttgttgatattcctgcagtaatcgttcatagtaagactatctcgcaagggatgactgctttattaggttttgaacctgaccatacgcttgaagaaaatcaatcggctatggaagataatctatccaccgttaagagcggtgaggttactcatgctattcgtgatacacaaatcgatggttttgatattaaaaaaggcaatttcatgggcttgatcgatggcaagattgccatcgtcaccgataacgtggaagaagccgctattcaaatggtcaataagatgatcgatgacgatagtgagatcgtcaccattatttatggtgcagatacgaaccaagaaacggctcaacacgttgaagccgcagttgaggaactggatgatgaattagaagttgaagttcatgaaggtgaccaacctgtctacccgtttgtaattagtgtcgaataataaaattgattaaataaagcggtgaagcctgttttcgggtttctccgctttttgtatcgtaagctttttaggtgccaaagtggggtgacgtgtgcttataatatggtataggaaacattttaaaaaggagaatgtaatcatggatgataaacaaatcgtcacggttgatggtactaaatacgtggtcaccgaacccgcaaccggtgagatttatgaaagtacggtaatgggcgtcagtgaggccatcagaacactcaatggcaagggatacaaactgaatggcgacccaaataaattatacgaaattgaatggatgctagatggtgacttggacagcgatgatttttccaagtgggtgaaagattggcaaactgctgacgccgccttcgaactgaattaatagtgaaacacaaagtttaattcaattagaaagtaatggcagttcccaaataatgagtaatgccattgcttttttttgcgggtttcgattataatgtatgacgttattgaatcatgaacttggttgttatgtattggtgacaaaaagtcgaaatcattcattttttaaaagtggcggctcaagtgaaccggcactttgtttatcagttgcttaggttgggagggagtcacgtgggattatcagattccgtgacagtattgccaggtgttggaccaaaacgggctgacgccttggcggatcttggcatcacaacaatcgaatcgttacttacctactatccgtttcgttacgaagacttacgggtaaaggcacttaacgagattggcgaccaggaacaggttacactaaagggaattgtggctgcacctcccacgttgagtcggtttggtcgtaaaaaaagtcggctgaatttcagattgctgattggccaggatgtggtgccagtcactttctttaatcagccatggttaaaaaataacattgaagttgaatcaccaattatggtgtatggccgttttgatgccaaccgtaaacaactcaacgggatgaaaatcctgagcagtggcaagaatgacccaatggcatccgtctatccgtcaaattctggcattcgacaaaagaccattcaacaattagtagtggccgcttgggagcaataccatacggaaattgttgacttaattcccgatcacattaaaacgcactatcgattacttgatcgtgctcagatgatccatgacatgcattttccaaaagacttagctgcagctaaagctgcccgtcgatcggctaaatttgaagagttctttcgctttcaaatgcaactgcagatgcttaaacggcgtgatgagagtcaggccggcatcgatgtggactatgataaagagcggttgcagcgctttatccatacactgccttacgagctaactgatgctcaaaagcgggtggttaatgaaatctgtgcggatatgaaacgcccgattcacatgaatcgattgctccagggggacgtgggtagtggtaaaacggtcgttgcagctatttgcatgtacgctgcaattactggtggttatcaggccgcattgatggcacctacggaaatcctagcggagcagcatgctaataacttacaggctttattcgaaggactgccggttaatattgtgctacttactggttcgactaagccagctgttcgaaaagagattctgccacggctagcctctggtgagattaatctgattattggaacccacgctttaatccaagaaggtgttgattatcatcgtcttggactagtggtcatcgatgaacagcaccgtttcggggtggcacagcgacaggctttacgtcagaagggcgataaccctgatgtgttggcaatgactgcaacgcccattccccgaacgctggccattactagttatggtgagatggatatttccgtcattgatgaattgccagctggtcgtaaaccggtgacgactcgatggatcaaaagtgcacagattgattcagccgttcagtttgtcttacgggaattggccgctggacaccaagcttacgtcgtgacaccgttaattgaagaatctgaagctgtggatatgaagaatgcggaagccatttacgaacgtttttccgcttatttttcaccgcatcactatcaggttggcctattgcatggccggatgaaaaacgatgaaaaagacgaagttatgcaagcgttcaagaataatcagtaccaagttttggtagcgacaaccgtcattgaagttggggttgacgttaaaaacgctaccgtgatgctgatttacgatgctgatcattttggcttggcacagctgcatcagttgcggggacgggttggtcgatcagaccagcaatcatactgtatcttagtggctgatcccaagaataaaaacggggttgaccggatgcgggtgatgacggaaactaatgatggttttgtcgtgtcgcaaaaggatttagaattgcgtggttctggtgatgtactaggaaagaagcaatcagggttacccgattttaaagtcggcgatcccatagccgacctcacgatgttaagtgtcgcgcaagatgaagccaaaaaattgacgagtacacctggttggcagtctatgccggagaaccaagcactggtcagttatctaaaacaagctgaagaacacgcttatatgttcgattaagagaggatgaacaaattgagaatcgctgttgatgcaatgggcggagactacgccccgaaagaagtcgttgcgggaattgaaatggcgcgtgaccgctatccagaaattgaatttgatttgtacggacagtctgataaagtcaaaccatttttaaataatgaggaccatatcactttagttcaagctgatgaagtcattaccatggaagacgaacccgtccgtgctttgcgccgtaaaaagcagtccagtattgtgctggctgctcaagcagtgcgcgatggtaaagatgacgcattcttctcagctggtaattcaggcgctttgctggcggctggtttgctgatcattggtcgaatcaagggcattgaccgtcctggtttgacaaccacgctgcccgtgctcaataatccagagcaaaatcaatttttgatgttggatgtgggcgcaaacgcggattcaaagccatttaatttgtaccaatacgctattttaggcaagtattatgctcaaaccgttatgggtgttgaaaatccacgaatcggtctgctgaataatggtactgaagccgataagggcgatatgatccataaagccgttcacgaatacttagccaacgctaaagatctgaactttatcggcaatgttgaatcacgtgaactattaaatggtgctgcagacgtggttgttaccgatggcttcacgggtaatgcagtgcttaagaatactgagggtacggcactatcaatgctgaaactgatcaagcacagcattatgaatggcgggattacaagtaagcttggtgcagcgatgcttaagtcaacgttcaaggatattcagactcaaatggattattcaaagtacggtggtgcggttttacttggtgttaaggcgccagtgattaaaacacacggttcagctaaggcagaaactattgccaatacgattggtcaaattaagacgatgttggaaaatcattcagtcgataacgtcgtcacttacttcaatgatcacagtgaagagatggctgcagccaaggctgagatgcagaagtaaacaggtaaatctaccgtttatgaatagtttgtgctaaactgattgatgaactaaatagggtgaggtaaattatgtcaaaagatgaaatttttaataaaattgccgacatcattgcggaccgttttgaagttaagcgtgacaagatcacaatggacctaaactttaaaaccgaccttgatgccgattccattgatttcgtggaatttattttggaacttgaagatacctttggtgctgaaatttcggacgatgtcgccgaaaagttaaacactgtgggtgaagctgttgattacatcgcagcaaatggtgacaaaaaatagcagtgtcaattaataaacggaaaggttgcggtaaaacgatttgttttgtcacagcctttttccttgtatttttataaactaaaaggagcgttattgaagttgattaaaggactggatgatttactcaagaagaattttaacattgtcatcaaggataaaagtttgctggatgaggcgtttacacaagcttcctacgtcaatgaacatctcaatgaaaacttaaagttctatgaacgaattgaatttttaggcgatgcagtgatgcagctggttgtttcagattatatttacaaacgctacactaagatgcctcaaggtcggttgactcggctgcgggcggcaatggtgaacgaagaaagctttgccagctttgcccgtgaatgtcactttgaccagtacattcggttaggcaagggtgaagagaaggcgcacgctcgggaacgggattcattgctttgcgacatctttgaatcttttattggcgctttataccttgatcaaggagtggaaccggtacgagcatttgctgctcaggttatttttccaaaacttgatgagggtcgctttgatgaattttttgaccacaagacggaattacaggaagttgcacagaaaaacggtcccgtttcaattgattatgaactattagatgagaatggaccggataatgatcgtgccttcaaagtggcggttaagattgatggtaaagagcttggtgtgggcgttggccattctaagaaaaatgcggaacaaggggcggccaaacaagcgttacttaagcttgaaccagaccaagcctaatctgaaagtaagtggggagcaactatgaaactaaaatcgctagaaattagtggtttcaagtcgtttgcggacgataccaaaatcgaatttgaagacggcgtcactggcatcgttggccccaacgggagtggcaaaagtaatattagtgaagctatccgatgggtcctaggcgagcaatctgccaaaaacttacggggcagtcggatgccagacgtgatttttaatggttcttctaagcgaaaacctttgaaccgtgctcgggtaaccatgattctggacaattccgatcactatttaaagtctgaatatactgaaattaacgtgactagaaagctctttcgtaacggtgaaagtagctaccgtttaaatggtcaagattgccgtttaaaggatattttaaatctgttcatggattcgggtatcggtgataatgctttttccatgatctcacaaggccgagtcgaatcgattttcaatagcaagccagaggaacgacgattcatcgttgaggaacttatcggggtttcgaagtatcgtttgggtaaagcaaaggctaaacgtgagcttgatcaaaccgcgggctatcttgatcgggttaatgacttgatgtcagaacttggcagtcaaatcgaaccattagcacagcaaagtagtttagctaaggaataccttgcccaaaagaagcagtttgataaattagatcaaacacgattggtccttgaaattgaatccttgcaggctaaattaaagattcaacaagcacaactgaaagaaaaacagctgcgggtatctgatacaaaacggcagctggctaatcattcaagccaattagacgccgctcgtaaaacaacgaactcattaacgagcaaaaaggatgacaccaatcagcagttgctggaagtgacttcccgtaaacagcaaatggcaggtgcgcaagcccttgattctgaacgtcagaaacaccagcaacagaccttgggcgagctgactgagcggatcaagaaggctcagactaatttaaaaaccgcccaggaaacgttagctgccaccgaatctcagtataagaagctgaaggtcacgctaaaacaggatcgtagccgtgctaaccagttgaagtcacagttaaatgatttggatgagactaggctggctgatgaaggcgatcagcttcaaaatcactatattgatcaactgcaggccatcacgaccttgcataatcaaaaacagtatttggaaaaaaaccagcagcgggcaacttccgagaatcagcaggcggatcaacgattgcaggaactgcaaacggaactttctaagcaatccgccaaattaaagtcagctagtcaacagttgcagttacaacagggtcaatatgatgagctgcaaaagcaatgtcgaacactggcggatgaacacgagaaacgtcaagcgcaaatcgagcagttaaacaatcagtggctgtcagctcttgaagtcagccaacaggctaaagctcgattaaagagtcttcaggagttagcacaaaattatactggcttttatcaagggacgaaagccgttttaaaagcgaaagatcaactctcagggattattggtccagtagcggagattttggatgtgccaaacaagtacacgaaggccgttgaagcagctattggtgcacagcagcaacacgtggtcgttaccaatgaagcagctggtaaagccgccattcggtatctcactcaaaatcaactggggcgcagtacctttctgccgttgaataaaattaggactagccacgtggctgccgaaaccttatcaaactgcaaacaggcacccggttttttgggtgtggctgccgatttagtccgcgtgagcgatgcgcggttaaaaccagttttgaatcacctattaggcaacttgatttttgcggatgatttgaaccacgctgttgcactagctaatctgatacatcaccgttaccgaatcattacgttggcgggtgaagtgatttctaccagcggggcaatgtcgggcggtaaagataggcatgaacgacatggtattttgagtcaaaaacaagaactgacaaaactgcaggccagcgttgaccaaatgtctgaccagctggtagccaagcaagatgagctgaagaaattgaaagctgtccaagaaagcgacaaccaaggtgactatcaaaatcagcttaatgaactggatattagtcgtcaacggtcagaaagccaggttaagttgctgtccgaccacgtgaactcaattgaaaagcaaattgctgttcatcaaacacagtggggacttagccaagatagcgaagattttgcagcacagttaaagcataataaaaaagaaacagatgtcgctgaacaaaaactgacggcgttaaaaacgcaaatggccgctctcaagcaacaaagggcgcaacgcagtgagttagttcaaaaagtcagtgctcagtatcaagaccagcgagctgtggtcaccactaaaacagttcaggttaaacagttggagaaggaacggactgcgcagcaagaacgggttcaagcccttgaggatgaaagcagtctcctgcaaaagcggctcaacgcattaaaggcagcacgttcagaaactggggagtcaactcaggaccatgagacgaccctgaaacagctcgctaacaaagaacagcaattgaaggatactttaaagcagttaaatttggatctggaaactgctaacgaccagcaggcagacttagaacgttctaatcaactggctactgcaacgctgaatagtgagcagctggcagttcaaaagttagatttggcttgttcaaaattgagttcacaacttgatcaatgtgaaacgtcgctcgcagaaacgtaccacgtgagttttacttttgccaagcagaatcaagttgagttatcaattgatcagattcgagaaaaacttaagctgttaaaacgtggcttagatgatttaggtgatgtcaatgtttccagtatcgatgagtatgatcgcgtaaagtcacgctacgactttttgactcagcaaaaggaagatttaagcgcctcaaaaaataatttgttggaaaccatgaacgaaatggaccagcaagtcattgaacgctttgatacgacctttaaagcactgaatcagcaatttcaagagacgtttgttaagatgtttggcggcggtcaagcgaagctggtcttaacggatccagagcatttattaacaactggaattgagattatggctgaaccgcctggaaaacgcctgcagagtatgcgattattgtctggtggtgagcgagccttgaccgcgattactttgttatttgcagttctgcgcgttcaaccagcgccattctgtgtcttggatgaggcagaagctgcattggatccagctaatacgggtcgttttgccagttacttaaaccattttgatgatgatacgcagttcattatcattacccaccgtaaagaaactatggtgcaagctgatcggctctatggtattaccatgcaggaatcgggtgtctcaaaactggtttctgttgatctaaataaagtacccgctcagagttaataaaattaaggatgtgattttatgggactatttgattttttcaaacggcgtgctaaacaggatgaatcagaaaaaacagctgaaaagcaatccgaaactgaaacgaaacaggtcgttgaacagaccgccaagccagatgagcctgattcacaggcacctgaaacatcagtgaaatctgatcaatctgaagttgagacggaaaataagacagaaatcgtatcagaagatgaagaagtctcagaacaagttgatacgtctgttacatcatcttcagaggattcagaacaagctgtttcagaagcaataaagcctgatgaaactgaacctaatgatcaacaagatgctcaggtagtcgaatctgataaaacgtctgaagaacccgtacccgaaacgcagcaagcggaatcgaaatccgttgatgctactgagaaccaatctcaacctgtctctgatcaagatgaacaaacaggtacaactgaaacgggtgatcaaaccgagccaactgaagctgaacgttatgacaagggacttgaaaaatcacggttgacgtttggacaacggttaaatcatttgctggctaatttccggtccgttgatgaaagtttctttgatgatttggaagaaacgctgattggtgctgacgttggttttgatatggccatgaagatcagcgacgagttacgtgaggaagttaaacttaaaaacgtcaagaaaccaaaagacgttcaaaacgttgttgttgaaaaactgatcgagctatacgaccaggctggtaccgaagagaaaaatgggctcacctttgctaaagaagggccaaccgtgattctttttgtcggtgttaacggtgttggaaaaacaaccacaattggcaaaatggccaacctgtttaaacagcaaggcaagaaagtattgttggcagcagctgatacattccgtgcaggggctattgaacagttaaacgtttgggctcaacgtgatggtgtcgatattgttaaaaagccggaacaaagtgatccttctgcagtggtgtatgatgcactgaaaaaagccaaatcagaaaattacgatgttttgttcgttgatactgccggccgtctgcaaaacaagactaatttaatgaatgaattagctaagatgaagcggatcattacacgagaaattccagacgcacctcatgaggttctgttagtactggatgcgaccactggtcagaacgctttaaatcaagctaagatgttcaaagaggccacggatgtgacgggaattgttctgactaagcttgacggtactgctcgtggtgggatcgtgctggcaatcagaaacgaattgcacttacccgttaagtacgttgggcttggggaacaagtagatgatttgcgaccgtttgaaccaagcgaattcgtttatggtctgtttaaagggttaattgacgttaaataatgacattaagtcgttagtctgttcggggcttaacgactttttgaatttttttaggaaaacctatcgctattgttaggatttggtataatagactggctaggttaaactaagtcaataaatgggatgggaggaaacaacgtggagatagctaaaaataaccggatcaattcgctgtttgccttttatcagccactattgaccaaaaagcaaaacgattacatgcagctctattatggtgatgattattcactgggtgagatttctgaggagtatgatgttagtcgccaagcagtctatgacaatattcgtcggactgaaaagattcttgaaacctatgagaaaaagctgcatctgctcgaggagttcactagacgaaatcaactggcggatgaaattcagagctatgtagcgaaacaatatccaaacgattcacaacttaaccagctggtccaccaattggaatcagctgaagaagaatgaaagttaggtgcataataaatggcatttgaaggactaaccgagcgtttacaaaacgccatgaagaagcttcgtggtaaaggaaaaatttctgaggctgatctacgcgatacgatgcgcgagattcgtctggcattattagaagccgatgttaacttcgacgtcgttaaggatttcgttaaaacggttcgtgagcgagcagtcggcgctaaagtgctggaagggttaaatccagctcagcaaatcgtcaaaattgttgacgaagagttaactaaaaccatgggtgagacggaagttccacttaacaaagcaccgaagattccgaccattattatgatggttgggcttcaaggtgccggtaaaacgaccactgctggtaaattagctaaccatcttaaaacggatgagaacgcgcgcccattgatgattgcagccgatgtttatcgaccagctgcgattgatcaattagtcaccgttgggaagcaaattgacgtgcccgttttcgaaatgggaacggatactgacccagtggagatcgttcgtcaaggacttgccaaggccgaagaagatcataacgattacgtcttcattgataccgctggtcgtttacagatcgatgaacaattaatggacgagctggctcgaatcaaagaacttgcccatcctaacgaaatcatgctggtggtcgatgcgatgactggtcaaaatgccgtcgccactgcgcaagggttcaacgacaaactagatgtcaccggtgtgattttgactaagttggacggtgacacccgtggtggtgctgcactgtcaatccgtgcggttactgggaaaccgattaaattcgttggtgaaggtgaaaagatgtccgatttggacgtcttccaccctgatcgaatggcctcacgaatcttgggtatgggggatatgctttccctgattgaaaaaacccaaaaggaatacgatgaaaagcaagctcaggaattaactgagaagatgcgagaaaattcatttgattttaacgatttcttagatcaaatggaacagattcaaaaaatgggaccaatggatcagctcatgaagatgattcctggtatggcgaataatcccgcattagctaacgctcaaatggatccaaaggatatggatcacattaaggccgtgatttactccatgacagaacaggaacgaactgaaccagatgttctcaatccatcacggcggcgccgaatcgcagctggttctggtcgccccgtccaagaagttaaccgcatgattaagcagtttaatcaaatgaaaaagatgatgaatcaagtttcaaaggggaacttctccggtatgcaaggcatgatgaacaatgccggcatgggcaacgcgcttggtggcaagatgggccagatggcgatgaaatcaatgtcacgtcgcattaagaaaaacaaaaaacgtcgaaacaatttaaagcgacggcgtaaataataatgaaacattgattgagtcgggggtgaaagccctggactctttttgaatttgggcaaggaaacccgttcttttaaggacgtgatgaattgcctttttctgacattgtttgttggcagccggttgggaatatcgtataataagaacgtacgtttgctaatgataaaaattaaaggatgttaccgcttatgacgctaaaggcaattaaaacccgcatttatcccactgcgcaacagcaggaaaaaatcacagctaacttcggctactgccggtttgtttggaatcagttgcttgatatgcagaagcagcgatatgccaacggaggcagttacgttaacgagtttggcatgaactatctcattaagtgtttgaaaaaagaatacccgtttctcaaagcagcagaatcaacttcattgctgcatgtgagtcgtgatttgcaccacgcctatcaaaaactgttcaaagaacacaaggggtttccgaggttcaaatcccgcaagtttcccaagcaaagctatcaatgtaatgcggttaatcacaatattcaagtgattgatcagcatcaacttaagctgcctaagttgggacttttaagattcaaagctggacgacagccagttggcaaaattaagaacgtgacgattcgacgctccgctactggcaagttctacgccattattttggttgagactgatattgagccattaagcaacactggtaaggctatcggtattgatatgggcgttactgatctcatgattacttcggatggcaccaaataccccaccatccggtttgataaacggctcagtaaaaagaagcgttactgggaaaaacgtttggcccggcgcagacgtcaagccgaaaaggagattgcctgggacaaacataatcaggtacccgaaccccgagagttggctgattttaaaaactacttgacggcaaagcgcatggtcgctaaatatcatgagaagattgccaatcaacgggataactatttgcataatgttacgaaaaaactggttgagcagtatgatgtgatcaagattaaagatttgaaagccaaaaatctaatgaaaaatcataaactcgcccgagcaattgccaaccagtcttggcgaaaattacgtttaatgctggaatataaatgtgcctggtatggcaagcaactgttcattatcaacccacggaaaacttcacaaatatgttcaatctgcggctatgatgatggcaagcacaccttagacattcgccagtggacgtgttccaactgcgggattaatcatgatcgcgatgttaatgctgcaatgaatattttaaaagcgacagtgtaataaaagaccaactgggctggaacggcccttagtcaatagccgtaacctctgcgcaccattctttgaatgatacgtaagtcagcggtgttcctagaagcgcgttactttagtgacgagtagttcacgaaaaatggaagaaggcggatagatgttatcctatcaagaattagtgacagcaattcccgtcgtgatcaaagctggcaacgttccagcaattgttggtgaagctggaattggcaagtcagcattggttcaaacggtcgcagagaagatgaacgccaagttatttaccacggtcgtcagtctctccgaaaagggtgatctggcgattcccgtcccaccgatgacggatagtgcctttgtaaaaacatcgaagtatggccaactggcagacgttaaatttggttatacccataccttgattgaaattattcagtgggctgaagctcacccagaacagccaatcatttggtttttggatgaatttaatcgtgggactcaagcggttcaaagcgaactgatgaacttggtcttacaacgtcaaattaatagcttgcgactacctgaccaagtccatatggtactcgctgaaaaccctgatgctaccatggctggttttgaaaccagcgattatggcgttacggtgggtgatgccgccatcaacgaccggacagtgcgactggtaatgcgtgctgatgtatccgattggctccagtgggctgaatctaagggacatattataaaaagcgtttgccggttcatcgaagaaaatccgcagcaactggcacccaacgaccacgatgccgatttatatcctactccacgggcatggcaacgtgtttcacgaaatctgcaggctctaagtgaactaccggctgaacaacagcagcaagttcgtttggacatcttgaagggtgatttaggcgtcaccgttgcggaaagctttgaacgttttattcgacgtcagcaaactggcctcagcgctcaggaaatctatgctggcgatgcgttagatccagcaatcattcaaatctttaacggtgctggcattgatcagcaacagtctattatgaacagtctgatccagcaacttggtcattatccgctgacggaggggacctatgctggccggtttaccacattactaaacctgatgccggttgacgcacagtttgcggtggcactaaaactagccgaaattcctgatttattagaacaactgtatgaggcagcgcagaatgaaccgctggtgaagcagttgtatgatcagctgacggcaattggtttaaaaaacgacattagctgagagagggtttaaaacatgtttcatactcagttgaatgaattagccaatcaaaaagatcccaatctattacagcgacaaacgcaaatcttgtttcagcaagttaccagccaattacttaatagtcagcgtttctatggtgaactgctgttgcggttaaacaaaaaagccgatactgaactttcatcagcagtgatgttgaccacggctaaaagaccagttttactgatcaatcctcaacgattgaatgaaatcgttcgttcagatgaagatctattaagcatagttcagcacgtagtaggtcatttagcttggcaacatcccgtacgatacgcaaatcagggcactgatccgttagttcaaattgccaccgatatagccgttaatgatagtctcgtttcgttgtacccaggtgctatcacgcggcagcacgttaattttaagttagggctgcatttaactgctggtcttgggtcagctgaatatttaacacagttaagactggcactgcgtcgagacaaaactggcaccaaggcgaagcaaattaagcaaatcattggtcaatcaccagaatcgcatcttggctggcagcaattagatcaagataccacgatgcaattagatcagttagtcgctgattcctggcaggaaacaccacttaaacagcgggggttattacctagtaggcttcagcaccaattaaatcgccgacctgctaagttgacgctggactggcgacagttgatcatgatgggcttaaagggcccgcaaaagcgtcaggaaccagcttataatcgatttaaccgccgtcagccttaccgccttgaattacctggattaaccagggcggctactcgccagttatacttatttgttgatcagtctggttcgatgacggattcagaagttcaaaatattctcgcccaaattgttcagcttttaaagcgatatcgtgatagaattactgtgattccctttgatgcgatcgtgtatgataatcatgtacagactatttctcacagcaaccaagttgtttttcaacgcgttgctggaggaggtactgcttaccagccaatttttgactggctggttaaacaaggtgttaatgatacaaatgcgttggtactgatcttaaccgacgggcatggcgaagataaggtaatcactcatggactgactaatttgatttggggattaaccaccactaaggcggatctttcagtgaaacggccagtcggcgtcgtcaccgtgattcgtgaaaggaagtagctttatgctgacagctcagcaattacgtgccgtcattcagcagaatgtgccgtttaaacgagcacagagtattttaaaaaatgactggcaaaatattaatgaccaaaatccgttagcaagacagttaatgacggttaatgatttacaatttgcgttggcactgcaggaccttcaaactgaaaaccagtttgccgacgctagtgattacgcaagtgtgatgtcgtttgtccatgctcatcaggctgatttagccccaggtagtcgagaatttttgctccagccattcaaatgaatttatttctggttatcagttttaaaaatgttattcgggcttacagccactttgttttcaggtgtaaagaaaaaaacctttacaacctatcagataactggtatattatttatcgttgaaagaattaacaggaggtgtcatgcatgtcagtaaagattcgtttaaagcgaatgggttctaagaagcgcccattctaccgtatcgttgttgcggactcacggagtcctcgtgatggtcgtttcatcgaaaaagttgggacttataacccacttgttgaaccagctcaagttgaacttgaagaagagagtatcatgaactggttaaacaacggtgcccaaccttcagatactgttcggacattgctttcccaagcaggtatcatgaagaagtatcacgaagctaagttttcaaaaaagtagtgatcagtcatgactgactttaaaaaattaattaccacgattgtaacgcccctagttgaacatcctgaagctattgagatcgaacgcgttgaaactgatcggttttacgagtatcacttaacggttgccggtgacgatgtgggtcgtgtaattggcaagcgggggcacgttgcttctgcaattcgcacaatcgtatatagcgtacggatcaatgatcccaagcgtgtacggcttgtcatcaatgatgagtctaaagctcccaaatgagactcggtctcgggagcttttttgataccttagataaataaccaattgaaaggcaggtgcgtaatgtactataaagttggaaccattgttaacacccacggtatccgtggtgaattaagggttgttgccactactgactttcctgaacagcgttttaagaagggcagtcagttagccctgttcaaaaacgagcaggatactaagccggttggcacgattaccattaatagttcccgtcaacataagggtttcatattgattaccttagccggatacgacaatattaacgatgttttaaagtataaaggcatggttttaaaggttgccgaggaaaacctcagtgatgacgatttggaagatggccaatactactatcaccagatcattggcttgaaggtggttaatgaagacggtgaagagttgggtaccattaaagagattttggcaccaggtgctaacgatgtctgggtggtttctcggcctgagaaggatgatttattactaccagttatcgaccaagtcgtcaaaaagattgatctagcggctggacaagttactgtggaattaatggagggattagagtaatgcgaatcgatgtcctcagtttatttcccgacatgtttggcccactgcatgattcaatcgtggggaaggcactagaccgtgatgaacttgaagtagaagtaactgattttcgccaatattccacggataagcacggtaacgtggatgattacccattcggtggtggtgcagggatgttactgcaagcacagccaatttttgacgctatggcagccactcagaaaaaggcgcaagagttaggacacgaaaagggtcgcgttattttaatggatccggctggagtaccgtttacccagaaagtggctgagaattttgcgggcgaggatcacctcacgttcatttgcgggcactatgaagggtacgatgaacgcatcagaaccttggtaactgatgaagtatccatgggtgattacgtgttaactggcggtgaattaccagccatggtcatgatcgatgccatttcacggttattgcccggcgttttaggaaatgaagcatctgcacctggagattcgttttccacgggtttgctggagtatccgcaatataccagacccgctgattttcgcggcatgaaggtgccggacgtattgatcagtggcaatcatcaaaaaattgatgagtggcgagagattcaatcgcttaaacggacactgcttcgacgcccagatcttttagaccaattagacttaacgggtgaccagaaacgtaaacttcgtgatattaagattgatttggaatcagatgaatcatcatcgttttaaataaagctttactcacgctattagatatgatattctagtaaatggctgtttagccacattaacaatattccgctgtcgagattgagtatgaatgttgattgaaggagagaaacaacatgcgacaaaaccaattaatcgaaaagatcaacaaggaccaattacggaccgatattcctgacttccgccctggtgacactattcgtgttcacgccaaggttgttgaaggtactcgtgaacgtatccaattgtttgaaggtgtcgttatcaagcgtcacggtaccggtatccaagcaatgtatactgtacgtaagatttctaacggtgttggtgttgaacggactttccctgttcattcaccacgtgttgcccaagtagaagttgtacgttacggccgtgttcgtcgtgctaaactttactacattcgtgcattgcacggtaaagcagctcgtatcccagaagctcgtcgtcctcgtaagtagtcgacagtttctatctaaaaacgttcaagttagctattttgctgacttggacgttttttgttatggtcgaaacacttgagttctaagaatggagcctgtatgctgaaattaagcagaattcaatgaaagaagtggttgaaatgtctgatcatcaattgacttcacgacagcagcgacttttaaaaacgcaattagtcattcagggaagtgccttagttgtcttggtgacgttgttgtttaaaatgatatcctctaattttcgcttcctcaccggtagaaatttaatggttatgctggttgttatactggttcagtgggggtcaagtgcggtcctggctaaggtccaaaagcagactggtcaatttcagtattctgaaaagcattggctgtcacgattgtctaccagttttgagcttgcattatttctagtgttaggtatttatttcttgttgcaagtgtgagtgggtttacaactcagattctggtcatttaacgtaaagaaacgccattccgccaagaaccggaatgacgtttcttttattatccgcaaaattctcaaatctgacatcacactatcataaatttaaatcctgtttgtagcttaacggtgaaaaggcagtggcctgtgtaatcagactagccgatagttcgcggtattttttcagtgctaattcagcatttttcatgcttgcttgtgttaacagtgtggttagctcgatgccgtttaaaggttgcgctttttgatctgtctctataacggaacgagtaaattgctgattcagttctttttggacctggtttaattgatcgccaaattgcttgtaatgtggatcgaccagtacacctgtttgtttgaagacccaataagcgctgtctgaactataagtgcctaatccacggtggtaatcagcgggtgtctccgtgatacctgcatagaaggggacataaacgctctgtgccgcaacgcccattgctaaccaatgaataccggacagttcaggctgcgaatattggcgtaattgtaatatatgtgattcttgcgttgtcgctaagctgactggacgaaacttttttcgttcctcgagacttccggctccaatcggatcatacggtgtttcctgaaagtgagagcttaggaaatccttggcgtcttcaactgataataacttttctgcctgacgaatgaagggcataatatggctattcgttgtttgttccgtacttggattaaacattttttggccgtaccacacgcgtggaagattataataagcatccatttggttattagtaccaaaaatctcccggaagttgaacccctgacgttgcgggtttagtgcgtgttcttgcacaaattcttggatgtgcggatgccacataaagttctttggatcatcaaaatcaatggtttgaatcgccatttggttagcaaccacggcataactgtcatccggaatccgctgtgccacccagtagtgacccgaaccggtctcaaagtaccaggcttccgtgtggtcggcaaataaaatcccgttggactcagaagtcccatagtggctgataattgtgcctaatcgtttcacgccttcacgtgcagttttgatgtacggtaaggtaacggtgatcatggcttcttcaccaataccgtccttcaccaagggatcagcggccagcacgcggtcgtttgcataggtactttccgttgcactcatggcaacgccgtattggttgatgccatcttcttcaaataagccgtacttatcggtccactctggagtcgcggtgtatttataagctgtttctggcagtggcattttaaaaccattatcagttgattcaaaacttgcttgcttggtgacggttgctggatgaacgataaagtgttttggccaggctggacgtgagtcttcgttacggccaatcataaccgatccatcaacggatgctgctttaccaattaaaatgctggtacaagcagagtatggtgtcattgacatgcgtaatccctccaataatcaattataagagcattctatcataaatatagttgaaacatgttattataatgcagtctgaagcgattaaatggcctaaagaggataggcaaatacgagaaaatatgattaaatgaatgctgtgattcaaatcttctgaagggacgttattctttatgcaggctctcattgaccgaaaagattttaccattaagtgtgcgctgattgttggttcagctattattagtgcgattgcactgaactttttcttaattcctggtaatatttttagtgccggaatcaacggggtttctcaaattttatcaattctggctctaaaatggtttcatgttcggattaacacgggttggttgatcctgatattcaacatccccatcggcttgttaggctggttaaaaatcggccggggatttaccgtttatagtttcattacttcttttttaacttcgatcttagcggtgatcttaccggttcaaacactctctcataatccattgttaagtgctttatttggcggtattttaaccggggtcggcgttgcttatccgctgaagtacggtttttcaaccggcggcatggacattattgcagtaattctggaaaaaacgactggtaaaaccattggtacactgatgattgccatcaacttggtgattgtgttaattgctggtaccttagtcggctgggaaaatgccatgtatacgattatttcgttatatggcatgtctcgggtagtggatgcgattcatacccgtcaccagaaactcactgcctttattgtcacgactgaaccggatgacgttatcgacggattgaaaaaaacactgattcgcggtgtcactatattaccagctcaaggtgcttataaacgacgtcctggggcagtcttaatggtggtcatttcccgttatgaactgtatgaattggaacacgtggttaaaacagttgacccgggatccttcgttaacttggtcagcaccgtagatattgagggtaacttctacgatgaaactgagcagttaaagtttaaacaggggcaatccgaatagacttgcttgaaaacgtgaaaaacggtatacttttatcatcctaaataggggggggcacttttaatgccaatcgtaaatattgatttgattgcaggccgttcacaagaacagttgaaaaacttagttaaagatgttacagatgctgtaactaaggatactggtgcacctgctgaacacgttcacgttattttgagagaaatggccaaggaccgttacagtgttggtggcgttcttaagagcgacgaaaaataatttttgagggtgagcgggaattcgctgaccctttttttaacggctttttgtaaccgattacagtgctgttatgaatgctttttaaacaaatgtagttggctaattctccgttcttaggtatactatagaggattaactaacttgagaacgtaaatgaatggagacttaacgatgaatgacgaacagtacataatggcaattgacgagggtacgactagtacgcgtgcaattctatttaaccgggatggtcagattgtaggtcaggcgcaacgtgaattcacacagcactttccaaagcctggctgggtggaacacgacgctgacgaaatttggagcgccgtccagtcagtcatttctgacgctgtgattgacgcgcatattcaaccttacaaagtgcgtggcattggcatcactaaccaacgtgaaacgactattgtttgggataaaaataccggtgaacccgtttatcacgctgtggtttggcaatcaaagcaaacgagtgagattgctgatgaattaaaggaaaaaggatacgctgatttaattcacaaaaaaacgggtctggtgattgattcttacttctcggccactaagatcatgtggatcttagacaacgttcctggtgtccgtgaacgcgctgagaagggtgaactcttatttggtaccattgacacgtgggtcttatggaaactcacgggtggccgggttcacgcgaccgattacaccaatgcgtctcgaaccatgctgttcaacatccatgatttaaagtgggacgaagaaattttggacttgttaaacattccgtctagcttgttgccggaagttcatccatcttcttacacttacggttataccgctggctacacgttctttggtttacaagtgccaattgccggaattgccggtgatcagcaggctgcgttatttggccaaaccgcttttgaaaagggttcggtcaaaaacacctatggtactggtgcgttcatcgtgatgaatacgggtacgcaaccaaccttgtccaataaggggctgttaaccaccattgcttacgggattaacggtgaagtcaactacgccttggaagggagtattttcgtggctggatcggctgttcaatggttacgggatggtatgcggttattcgaacacgcttctgaatccgaaaaaatggctgttgaggctaaaacgacgaacgatgtttatgtggtgccagctttcactggccttggtgcgccatattgggatcaggaagtccgtggtgccgtcttcggactgactcgcggtacgacccgagaacaattcgttagagcaacactggaagccattgcgtaccagaccagagacgttgtggataccatggcagcagatactggtatcgacattaaaacgctcagcgtggatggcggggcagccaataataacttcctgatgcagttccaagccgatattttgaacacccatatccaacgggcggcaattgctgagactactgctttgggggcttcctacttggctggcttggcaaccggtttttggcaggatttagatgaaatcaaacggatgcacaagccaagtgaagagtttgatcctcaaatgtcagaaaaagaccgtgagaactgctactctggatggcaggcagcggtgaaggcgacacagttatttaaaccgaaaaagaacttgtaatgttttaaccataaatacaaaaaagcattctcatcggacggacatgatgggaatgttttttgtatttaatctagtattcaaaataaccgcgaaaacctcgccaaacttgatcaacttgtttattttgattctggtagtaaagtgcgtttccggtcaaaggctttgcgtcttgtcgtttcaaaattgttttcagtgatcgatgttttgtatcagtcccgtcaccaaataggcgatattgccaattacgaagtttacctgcacgatcatgccaaccgtatcgcagacggaataattgccgctgtttgggattgataatcagaacatcccaagcaccaatagcagggttgtctaaccggttagttttacgacgatctgcaatatcgctggtagtggcaatccaattgataccatcctggtttgaccaatcatcaacgtgcgtgtggccagacatgacagcaatgatttgttgccggtgcttaactaaactgctataaacgcgcgcataatcaccttgttgattgttcgcaaaccaatcataagtccaaaacggcttgactgcttgtttgtcagttgcagaacgaatcgaatcatggctaaaaatgatgacttgttcgtcgggtgtcaactgatctaaagtgtgaatgagccaagcggcctgttgctcagcaattcgcgaacggctatgacgaatgttttgcaaaatacctgtccaatgaatgccatttggttgatcgtcataatcgcggtcaaaatagacgtctgaggacgaatctcgaatatcaaaggtattgagcatgatcaggcttacaggtgtgccaggtacgtgatatttgccatagaagttatgctgattagctagccagctattattaaggctatttcttaagttcaacgcggtttgctccgtgacgacctgttcagtgcgataaccatttaaatagcgagcaaaccccgagttatcatcatgattcccctgagtaataaaaacgggacggtgactgtttttcagcacggatattgcatcgccggtgtcaacgatggtccggttaaggggctgattaccgtcaactagatcaccattcatcactaatccgtcaaaaaattgttctcgtgccagctgactgatcatttttaaatcacgtaatggtcgttgggtagcgctagattgatgcgcatcatagtgagtatcgttaattaggccgataacaactgagtcaggctgttgcagctgcttaagttgagaggtgattctttgtagctgctgtttctctaaatgcgtaggcgattgatcaggcaatgtctttacctgatcaaaagtccaaggttcacgtagccgagaaacacttttagaaccggtgatttccttaccaaaatagtggtcgtgaattggatagcgactcatgaaggggacgtagctatgacgaccagcatgggtaagctgtaaccagccacgatgcttgtcagctaacttgcccgtgtaatcaatgatcgagtctcgcttaaggtgaccgagaatgggtgaatttaaatcgggagtttgatagatgttgacagcacggcgattaaaacagaaccgaccattcattttaaagaatgctgtttttttagattgaatgatcagctgtgaactcaagtccgaacctgccagcacaccatatcttttacccgtttgctggttgtagtagggtaaaaagccctgttcagtctgaatataagcaattccttgatttgataggatgttgttatatacaatttgatcgcctgtatatagcaatgcccgattacttaaggctgtccactccggtgatgttcgaaaaacaagcggttctgcagccacaaattgccgtaaattaaagtggttatcagaatgacgtgatccagttgacgacttctgcttttctgacggtttattcttgaatccccaattggggtctgaatcatgaccgtataaaagtcgctgattcgtagcgacacacagatagccgctttcaagcactaaccaatattgaccgtcactcttaattttgccttggtaggtaatagcgtggtgagccggataaatctcaattcgaggacttaacctatttgggtattgacgactaatcaaaaagcggtcaggtttaaaaatcccggactgaacgattggttgtccgtcgattaaataatccataaaacgattcctgttatgtctcaattttgtcaccgccatttgttttgatatcttatggtataatcaacctagtaataatgcagataataggaaaatatttgcaaagaaaaaggagtttttttaatgcagtcaacgttagcttacgagataacagggttggaacaacaatcagtcgtgaacgctttttgtattgacgctcagacgggttacgttgcccaaaccattaatcaagatacagtgattacaaagtgtgacttagatgagtcgaaagccactgctgtagcaacttccgatagactgatattgccaaatttaaccaatgtacacagtttatcgttaatcaccagtacacctaatctcacattcatgctttgcgggcagccagttgatgccaatggcgaagtcaatgcaccggagatatggcaccttacgcttaatcaagatgatcatacaaagcaacccactatttttaaaataacccatctagaaagtgctaacatcacggggacgccgctgccagagcccgtgattggcgcagtttctgcgctgtccagtaatcatgacgaactagctgttttggtactggacaaagcccagcaccttcagtgtaccgtttttaatatgaaacaggtcagtcatttagtttggcaaatgatggaaaagggtgaaacaacgattgaggctggagatttaaagctgatggctacggtttaccagtcatttaaaccaactgaaaagcagttggctcctgaaaccattggtagtattcgcagcattgctttttccaacggtcgcgcaatctatgcaaccaaaagttttggtgaccagcgagccgtcagcaaagggttttggctattaaagaacggttttcaagatcagttggtcgatttaccagcagatgctgaactgacaggaatcatgcttctgggaaagtacgtttactttggtgcatcacaatctcaatcaaatcatcaatctgtcaaccaaatttatcgtgtggaaaaaagtctttggtcctaatgacattaatgttgatagcctagcattgtttgaagaagacaatgctaggctatcattgcactcaggtcaacacgtttaagctaacttaagtgcttttgaaagataatcagccatgccatcctgatcgttattaaggtcagttacgtcgtcagcaatagcttttaactgatccgtggcgttacgcatagcaacccctgtaccagcgtattcgatcatttcgttgtcgttatgttcgtcaccaaatgcaatgacattttgtcgatcaatatggtaataattggcgagacgttcaaccccaacggccttttgcacacctttggccccaatttccaatacgctattaggcccgccccagggagcaacgtcgacaaagctgccgaatcgttcctcgatatatttctgaagtcgtttttgtaacggccgttcaacggcgatggtcatgctcgttggattttgggttaaggttacgggacttagctgttgatcatgggtcaaaactgtggggaaaaagccaactgaagttgattcgttctgatgtgccaaaaagaggtgtttaccttcagctgcaatcatttgaatcttaaattcctgttgatgtttcaacaagtccaagacgatctcacggtcaaacgtatactggtattctaattgccagtgctgatgaggcatatgacctaaactgccgttaaaattaatcatcggtgaagttaatcctagctgatcatagtagctttgagaaagccggttgggtcgtcccgttacaatgctgacaatatggccggctttaatagcggctttgatggttgccatggttttgttagacagtaccgcttcactgtttaaggtggttccgtcaagatcaagtgcgattagtttttgagtcaatattacacatccgtttctttcgaataatagacttaatttaccacagttaataggataagagcaaggccgcttcaacgaaagccaattgaccgcaaagtcctgaaaaggtatactgctttcagagaatttttaaataatgaaagggataaatcatggaattacctgcagcgtttaaaactaaatatgaaaaattactgggagatcaagcagagtcgttttttgccagcttcgatcaaccagcaaacagtggtttcagaatcaaccccatgcgacccatacccaccgatcttgatttaactgatcctgtgccttatacccagtggggttactacggaaaagtgtccggtcacagtctgaatcatcaaagcggggcggtttacagtcaggaacctagtgctatgtttgtgggcgaagttgctcatccaagtgaaggtatgcgagtccttgatctttgcgcatcaccaggtggcaaatcaactcatcttagcagttttctgcaacaaactggtttactggttagcaatgaaatcatgtctaagcgtgctaaggttttggcagaaaatacggaacgtttcgggctgagcaacacattagtgcttaacgaagatccagcgaccattgccaaagtttttccggtatttttcgaccaagtcttagtggatgcaccgtgttcgggtgagggcatgtttcgtaaggatccagatgcggttaattattggtccaccgattatccggtagcctgtgccaaacgtcagcgagaaattctgactgaggcggtgaaagtccttaaaccagggggtgagttggtttactcaacgtgtacttttgcgccagaggaagatgaacaaatgatttcctggcttctagagacatacccacaatttgaagtggtacccattgaaaaaacggctggtatcatcgatgccaagccggaatggggcaatggcgatccaagtttaaagggtgctgcgcgactgtttccacatctcatgaggggcgaaggccactttgtcgcaaaattaagactgaacgaagccatcggtgatggtcacaaattccatcgacaggcctcaaatgtgtctcgtgatcaatctcatttattcgaagattttgctgcccaatacttaaatttcaaagtagattcgcaccagttactggcatttggtgaccagctctacctgatgccagaagggacaccttcgctgagaaaaatgaaggtggttcgtcctggtctgcacctcggcacctttaaaaagaaccgctttgaacccagttacgcgctggcgttggccttgcgacctggtcagtttaagtttgaatcagccatttctgaggatgattggaaacaagtggttcacggcgatacgtttacacgagatgatttgccaattaaaaagggctggatccgactattctgcaatggccaaccagtcgcttttgctaaagtggttaatcaaaccgttaagaacttctttccaaagggactgcggtttaaagctgagtaacacaaaataaaaaagtgttttaacacgcaaaatgtgctaaaacacttttttattttgtgttcgactgatcactctaatgaaatgaacctttgtctagcgaacgactccagctccggtgaaaaaaccatggactgtttacgcagatctttaacggtttcactacccgtcagcaacatcaactgtttaaaatcccgaagccaatggattagccatgcttcagttgcagcatagtcagtggtaatcaagtggtgtaaaatctcaccggccatgccagcaatatcagcgcctaaggctagtgctttaatggcgtctaggggggtcttaataccaccgctagcgataatcactggacgactggataatttccgcatttccagtaaggattcaggagttgttagcccccaatccgccatataagtcatttctttttcgggtcgccggaagttttcaatcttggcaaaactcgtaccgccacgtccacttaagtcgacgtatttgacgccaattgacatcaatttttgaacggtcttagcagtcatcccaaaaccaacttctttaacgattactggcacatcaagtttagctacaattgcagccaattgatctaaccagtaaaattcgcggtcaccttcaggcatgataatctcctgagcagcattcacgtgaacctgcagtgcgtcggcagagatcatattaactaccttttgagcatcgtcaacgctgtgtcctgcaccaatgttggcaattaccatgccattggggttgcgttttcgaacgactgaaaaagtcggcactaatgctggttctttcagcgcaacactttgtgaaccgacagccattggcaattgggttgcctcagccagttgcgcaagctgagcgttaagctgaccagtttgcttagagccaccggtcatcgcttcaatcaaaatgggatagttgagacgacgattttgaaaaatcaccgtcgagtcaatatcggacaatgccaattcaggtaaactctgatgcaaaattcgaacctgactgaaatcactggtatcagtaggttgatggaacttttcagccagcgacacgtgttcatctttgcgatgtgactgctgtgaggtcatgctatcactcctctacgtcgtgaacgttaaactttaagggaataattttgtttgatgcccatttattaattaattgatttaactgtttatgagaatcgacgatggcaataccgcaatcgccgccacctgcaccagaagttttcgcaattccaccgaattcttcagcaatatcacagagtttcttgagcagcggtgtttcaatgtgcgcgtgggtgaactgatctaattcattcaatagtctacggttaaccgcgatttcggcttgaatggcctgtagatcctgatttctgaagccatcaatcatccgttttaagcagactttactattggtcagaaaatcttgataggcttgttgccgtttggctttattcaacgccactcgatcaacaaggtgagaagtggaggccggtgaaccggtccagccaaccaatagttttaaattcttgggtggtgtcagtaattcaatatctaagcctggccagtccatcgacagcatttcagcaaagttatagtttttttcagccagtttcaaccaatcacggtcgaatgaatgataagcaatccagccaccgtaaacactggcagcgatatcacctaaagacccatttccttgaacgtggaaatgggcaatggcggctaatttgaacagtttatcatgattaacggggaggtcgtagaacttgcaaagtgctttgatggttgcgacagtcactgctgctgaggaacccagaccgtacttacggccatcttggctatcaaggtcgctttccacggttaaatgataaatacccagatctttaccaagggttttggcataatcttcggttaccttaatggcagataaaatatagtggaaggggttatcccggttgtcaaaaaccatttccccatcttctcggcgccagtaaattgagttttcttggtactgactagaaacgatactcccgatttgatccgcggattgaatcgtgaccgtcacaaattgatccaaggcaacgatgatagcagggaagccggtctctacgacagcatattcacctgcaatataaagtttgcctggggctttcacagaaatcaaaacatcatgtcctttcattagcagatcaaagtcacacactgctaattgataaataaagcaaattattaatctgaaattgaaatacctgaacctggtcgggtaacgagtacttgttcttcaccaaattcagtttgaaaatattgtgcaattcgttctgcatccgcgccttggcagataatttttacgttcggtccagcgtccattgtaaagtaacagggtattccttgcaaacgtaagtctttaaccatgttcatggccttaatgctatccgcattaaagtaggtgaagttaggatcggaactcagggttaatgcatgcatccgcatggcgttttgttcagaagtatgccccagtaattcaaagtcttgattttgaatcgcagtcttaaccgttttaaaatcggcttgactagctgaaatccaggcggaataaaaggggctggtttcaacggctaaccgcatacccacacggctggaaattttcttttgtttagccgttaaaactagcgccacaaccgcaatgtcccaagttggctgttcatcgattgggtaagcgaatgaagtcgcatcatcatggccttgctgccaagcaacaaagccaccaaaaatagagcgggtagctgacccagaccccagacgagccagccttgacaggtcgcgccggtttaagtttaagcccgctgcccgacttgcggcaccagctaaggcggcaaaaccagatgcagaagaagcaagtcccgctgcggttggcacaaagtttttcgtgtcaactttcgcacgataatcgatgcccgctaagtcacgtacatgatttaaaaaggtacgtactcgtaagctagcctgatctgataagacttggccgtcgaaaataacttcgtcagctgttaagctcggtaaaaactcaacggcagtctgtgtgtagaactcatcaagagtaattgatagactgtcgttttgcggaatgatcagttggttatctaacttaccccagtatttaaccaaagcaatattggtatgtgctttcgcgataattggatgatttgcgattaccattatttagtttcctcactttttaagggctgaacccacgattgactgacgccctcattagctaatgctaaccgaattcgggttgttgtggcttcatcgggtgccagacagatcatgcagccgcccatgccaccaccggttaatttagccccaagagcaccgttttgattagcaacgttgatcatggtctccaatcgtgggtgactgacacctagctgtctcagcaaaacctgagcacgattaaaaattactcccagttcggccaatcggtcgttagcaagagctgatttagcagcgtgggtcagctgacccagtcccttaatggcgtgatcagctgatgccaagtcacgctttcgcagttcggccactgcttgaaccgctaaacccgtttgcccatgtatgccactatctgccaccactaaataaccgtgcagatggaacgggatggcgctgggctgggttcccgtcacaaaccaaatggggttgctggcgctggccgtagccacgtcaataccgctggggttgccgtgaattattttttcggaaatattggcgtcagacaatagttgttcgtgtgagagcggctgttcgaaaaagcggtacaaggcacggataatcgccaccgcagtcgctgccgatgaacccataccgcgttcagcaggtaaatggctattaatggctaaattgaaaccgacattggctgcattaaaacgtgtcaacagttcgtcaatcagatggttaatgccagctaattgctgcggaccggcgtgcctagcacccgtatagtagcggctgatcagctgttgctcgttatccttgcgtaacgttatcgtgacgttttcacgaacagctggcaacggcaacgcaattgcgggctgatgataaacaacgctgtgttcaccaattaatataatttttgcgtgactgctgccactagctggtgtgtccactgaacaggctcccctctcatgtttttatggtagactccaaataaatcatgccttttaaatgattacaaacacatggtatcatacgacaaataggtaatcgttacaagaaaaggcgaaaattcaccgttgtaaatttggtaaatttaatgttttattaagaatggttaagctcgaaaattcattctagacgcttcaaaacgggttcatctataaacgtctgcttccgcctgtgaaccaagtgtagtatgataaacgaagaaagatagatcatagagaatttggtgaaattaatggatgcaaatacaatttatgccgttgtcgatattgaaacgaccggtactaacgttgctgaaggcaaccgaatgattcaatttgggtgcgtcctggtacaaaatggcaaaattattaaccattttaatacagacgttaatccacaaacttcaattccacaatccattcaggcactaaccggaattaccgaagcacaggtcaaacgggcaccactatttgatgacgtggccggtacgatttacagtttgttgtccgatacggtttttgtggcacataatgtcaactttgattttccgtttgttaatgccgagttagagcgggtgggttaccccaaactcgatattcaagctatcgataccgtgaccctgagtcagattttattgcctacggtccccagttatcgcctgcacgatttgacacagtatctcagcattgaacatgatcatccgcacactgctaacgatgacgcgctggtaactggcgaactgctgattgtattgtttaagcggatgcttgaattaccaatcgtgacgttacagcaaatggttgaggaagatgctgacttacctcaagatactggtgaagttttcaaatggggactcgcagaagttcgtaaaaatccgcgcagtttacccgataatctgtacgtttctcacgggattgcattgcgtaaaaccccagttctaacggcaactgatgatcgtgagtacacctatcctcgaaccaaaaagaataaattaaaacgattcccaaagcactttgaatggcgagctgatcaagctaagatgatgaacttggtttaccggcagtatacggatgcggaaacggccaaccagccgttgatcgttgaggcgcctactggtaccggtaaaacactaggttacgccttaccgatggcttatttagcccaaaaattcgataaacaagtggtcattgccactgatactgttttactgcagaatcagcttatcaatcaaaccatgcctttgctggaagaaatgctgccctttgaaatccacgcggaagtggtgaaggggaacgcgcattacctggatctgtcacggtttaaaatttctctgagccaagcagaccattctaaacagactcagctcatcaaacttaggctgctagtttggttgacccaaacgtcaacgggtgatttagacgaactgcattttaaaaacgaaccgccatacttagacagtgtttaccatcatggtatgactgatttaacggatacggatcccttttacgaagatgattttctaagacggctttataaacggttaaaatatacgcgttttattatcgttaatcatgcctttctaatacagcatgcagatctattgggtgatgatttcagccaaccgtacttagtggttgacgaagctcagcatttggctgactatgcacttaaaacgcagcggcagaaatttgattttcaagtttcactttctactggccgtcgcttgatggaacttttagatcccgataatgaatacggtttaaacgctgcgactgatggcttaactttaaatgaagatttaaataccttttatcgctggctgattgaattcaatcgccaattgaaggccctaagcgactatttgactagtcattttaagactcaatttggcggtaagttcactaaaccctataaagaaatcgtgatttctgaagctgattgggtgagttttcttaatcagcgcaagggtttatttgaacaattagatattttagtcggtaagttccaagataaactggctaagatcacggagtcattttatcagcaatctaaccgttggctaaaaagcgatgaagaattgttcatgcgtttcagccatgcggtcaacgctttgacggatgcatggcacacgctatctacgattcggctggcacctcagcatgaagaggctggtacgggcagttacctatactggctcaccattagcaacgacttgacgcatattatgattgcttcaaatttaatgactgttgaaggttttctgtcacagcagatttactcgcactttcaagccccaatgtttacgggagcaacactcttttcgtcaaatcgttctcagtacttgtatgatcagttagatcttgatagaagtgctgtgaaaatgcgacggttaaaatctgattttaattttgaagctcaggctaagatgtatatcagcaacgatgcaccagatatcaaagaagaggataaatacaaccagtatgtctctcaaacattgatcaagaccctggcaaaggtcgaccggcccacattggtactctttaattctttagcagcaatcgagtcggtgtacggtgcactaaccgatgccattcatcccaaagaacgcctgattttagcacaggggatttctggttcaaaagaaaaactgatcaaacggtttatggacgaagataacgcggttttactaggtgctgccagcttttgggagggaattgacctaccgcaagataaactgcagttgctggtcattgcgcgcttaccctttgattcgcctgatcagttagaaaccaaggttcagtacgaacgaatgaaagctaagggcaaaaacccgttttataacctatcactccccaaggccaccttacgactacgccaggggattggtcggttgattcgaacccgtcaggattatggcgtcgtaattgttttggacagcagactggtgacacgtcattatggtcaaacgattatcaaaacattaccggctagtttacccattatgacgggaactacaccgcaattactcagcgatatcactaaattttttaaaaaacacaaaagtatcggtcacctcagctaagattttgctataattatgggcagtgacaactgaaagaaggcgtattaaagaacatgagaagggaacatgcaagccggcgacgtttgggcaatcgaatcttgctcaccgcactcggtatagtcgtggttttgctattattgatctttgggggaatccaccatgcgacttccccagtaactaaggcgaaagctcagtcggtacaaattgctaagaaatatgccggtctgaaaactgataatgggttctactggaccaatttggaccaaacctattacacagttgctggcaagaataatcaaaaccagtcagtatatattattgttccccaaaaaggcggacacgtggttgccttacagcaatctaatggcatgtcccgagaccaagcattaagtcaggtctggtcaaaacgaaatccgaaaaaagtcctctcagcagcactgagtgtgtttaatggtaaccctgcatgggtgatcagctacatgaatcaaaaaggacaactctgttacgaaacgttaagttttaaaactggtaaggtattacaatctatcgaaaatatttaatcggtacctaggggggctatcttttgaaaatctcacagcgtgcacaacagcttcaaccatcagctactatgaaagtttctgctcaagcgaaacaaatgattgctgacggcatcgacgtcattaacctcggcattggtgagcctgattttgaaacacctaaaaatatcgaacaggcggctattaatgccattaacgcaggcaaggcgagcttttatactccggctgctggcattccgcaattacggaatgcggtggcacaacggacgactagagactatggtctgcaaggactcacagcacaaaacgttgcgattaccactggagccaaaatggcactgtacagtgcttttcaaaccattcttgatcctggtgatgaagtgttattgccagaaccatactgggttagttattccgaacagatcaaattagctggcggtgtacctgtttctgtaccagtggatgagagtttcaaagcaacgacagctgatcttgagactaaattaacggataaaaccgtcgcttttgtgctcaatagtcctgaaaatcccactggtgtgatttatgatcaacaggaattagctgcgctaaatgaatggaccaaacagcatgatttgatggttattacggatgatatttatggtcaattggtatataacggtgccagttttacttccattgcacagttaggtgacaagttagatccgcgtatcatcatcatttccggtgggagtaaaacttactctatgactggctggcggatgggctatgtcgtcgctgatgaacgattgatcagtaaaatttccgcctttctgtctcacgctactggcaatccaactgcagtcagtcagtatgcactcttggaagccttcaccggtgatcaaactcagactgaagtgatgcgtaaggcttttgaagaacggttaaatacgatttacccgttactaaacgatattccgggttttgaattaaaagttaaaccccaaggcgccttctatcttttcccagatgtcagcgaggcgttaaagttctcaggtatcgctaccgctggagaattggtcagtcgcttattggctgaggcacacgtcgctttggtagacggttccgcgtttggcgtcaaaaaccacgttcgcatcagttacgccactgatttagattcacttaaaacagctatggctagaatcaaggctttcatggtacaatttaaagactaattattcattgggggttacattgtgcaacagattaacatcattaatgccaaagaccacgttgacgaaaaagttaaaattggtgtttggctgacaaacaagcgttccagcgggaagattgctttcttgcaattgcgtgacggtaccgcctttttccaaggcgttgtgctgaaaaataacgtttctgaagaagtttttgaactcgctaaagagctccggcaagaaaccagcatgtggattacgggtgtcattcatgaagatagccgctctaaatttggctatgagatcgctgtagaggatattgaagtcattggcgaaagtgaagactacccaatcacacctaaggaacacggggtcgactttttgatggatcaccgtcatttatggttacgttcatcacgtcctcatgcaaccatggtgattcgcaacgaagtcattcgtgctacctacgaattcttcaacaaagagggcttcactaaaatcgacgcaccaattctgacaggtagtgctcctgaagggacaaccgatttgttccacacggaatattttgatcgtgatgcttatctttcacaatctggtcaactatacgaagaggccggcgcaatggcctttgataaagtcttttcattcggaccaactttccgtgctgaaaagtccaagactcgtcgtcatttgattgaattttggatgattgagccagaaatggcctttatgcatcaggaacaaagcttggaaattcaagaacagtacattgctttcttagttcaaaacgtgattgatcactgcaaggacgcccttgaagtacttggccgtgatatcgacacgcttaaacagtatacccaattaccttatcctcgaattagctatgatgaagctgttgagatgcttaagcaaaacggttttgacgttgactggggggttgatttcggttcaccggaagaaaccttcttagctgatcaattcaagcagcctgtgtttgttttaaactaccctaaggctatcaaagcattctacatgaaagaacacccaacgcgtaaagacgttgtcatttgtgcggatttattagcgcctgaaggttatggtgaaattattggtggttctgagcgggcaaccgactacgattacctgtacgatcaaatcatcaaatccggtttggatcctaaggaatacagttggtacttagatcttcgtaagtatggcagtgttcctcactcagggtttggattggggcttgaaagagctattacatggattacaggcgaagaccacgttcgggaagcgattccgttcccacgtttgcttaaccgtatttacccgtaaacgtatatgtttgaaacaggaacttctccaaagcctaaggataatgggcgcatgggggagtttcttgtcgttaaaagttgcatcaaaagattggaggtcagtagatggatagttttgcgaataccttaattaaatctggccagactacggtggcaacactgttattggagcattatcgtgaattggggatgagtaacactgaattcttaatttatctgcaaattaagagttacaacgatcgtggcatcagtttcccacaaaccgagacgattgctaaagcagtggggttgactgataaccagatttttcaggaactgcacacgatgatcggtaaacggctaatgcagattgatactgtgcagcagcctggacaattagcacgagattcgtatgattttaccttactgtatgaaaaactcgctcagttcgttaaaaaggccgaagcagagactgtgaccagccaggttgataacgatcgtgagacgatttttaaccaaattgagactgaatttggtcgaccgctgtcacccattgagttagaaatgatttctcagtggctggataaagatcattaccaggtgggcattattcggttagccttaaaagaggctgtactgaatcaggtttataacttaaagtatatggaccgaatcctgctcagctggcaaaaaaagcacctgacaacgcctgaacaggttcagcaggaacgtgagcaccgtcagctgaatcagggcgctaccagcgtaaatcaggctaataatgggactaaaaagcaaaaaaatttacctcatattcccatgttcaagattggtgagaaacccaaagataactaaacgtctttaccgattcgatgatacgctaaacagcagaaaagaccagatttcgatgattgatcgaaacctggtctttttgtgttttatgaattattgactactcttggttgacgagttgcttttaccagttccagaattagcgttagcattattagatgtgctatcggtagaagctgaattggtattttgcgtgtcgttattgttattgttgccattaccatttccgttaccaccgccattaccgccagttggccgctgttcggtagaggtgcttgaactctcagtggaactggatggccttgacgagctattcgtgtttgcttcattgttaccagttgtgtcattggtattcgtgctactgctactaccatcgtttgtggcggtagatgcatcacccggatagccggaaacgtaatattcagttgttccgtttcggcgtgtagcgaccacgtctgatggagcggtccagttagtattacttgcattttgctggacgtaactcatttcggaacgataaatttcttgagctattttggtttgtgcctcagggatgtaatgacctgcctggaattgcttgtcatacccggtccaaatggaaagcgagtaatttttagtgtatccagtaaaccacgaatccatggccgcgtcaccaggaacttgtgatgcgtaatcatcaggataggcagttgtcccagtcttacccgcttgatagagtccggagatattagccgcggtaccagatccgttagaactggtcataacgccctttaacatatccgtgatcataaacgcagttgccggagacattgcacgctttcctttgacaccgtaattgtgcgttttgccatccgcggtaacaacgtgattgagcaaatggggtttgtaataggttccaccattagcgaaagcggcatatgcagcggcttcctgttcagtcgaaatgtaaagcccaatcccgttttgcaacgtcaatttatcgttaaaggtcattcctagattacctaagaagtcagttgcacggttaatacccacggcatctaaagttctgaccgctggaatatttcgggattctaccagtgctttacgcatggtgatagtgccttcatgacggttatcaaaatcgttaagctcacgtgtcgtacctggatagtagtattgcgtatcttgaaccggttgataggtcgggtacttcaagtactgaatggctggaccgtaatccgcgattggcttagccgttgaaccacttgaacgatcggtttgaaccgcacgattaagaccaaaagtaacgttacccgttttacggccacccaacatggcaaccacttgaccgttgtgtgggtccaccattgtggcacccatctggaatttattgcttggataggccacataattattgctattcgcaatgctatagaggtgtttttgtgctgacatattcaggttagtgtaaactcgaaggccatccgtgttggtattataaccttcacttttaagctcggcataaacctcctttaaataggcatcaatgtacttttgattagctgaattgaccgtgctaacgggatgcgttttagccaagccagtttgaacactggttgctttagcagcagcagcctgaccagaggtaatgactttgttagaaaccatggcatcgagtacttggtcacgacgatacttcgcgtattgcggatgatgaatgggatcatagtttgttggactctgtggcataccagctaacattgccatttgctgcaggttaagcttggatagtgatttaccatagtaatagtgagccgccgtttgcatcccataaacaccattgcccatgtaaactttattaatgtaaaattcgaggatctgctgtttactgtatgtctgatcaactttgattgctaaccaagcttcctgtgattttcgctttaaagtttggtcagactgtgcagttgaaaagaccgataatttgaccagttgctgggtcagcgtacttccaccttgaagtccaagcgaggaacctgtgacgttgtgcatagcagcactcacgattcgaatggggtcaacgccgtggtttttgtagaaacgacggtcttcaatggaaacaactgctgattttaactgttcagggatgtttttcgatttaacataatcacggttctgtgcacctgatcttgaaataacatcattgttagaatcatagatcttcgttgaagtatcactttcaagtgcagactgtgaaatgtttggcgctccctgtgcgtaatagaagaagacaactgcacctaatagtatagctgccaaaaaaacaacgaccgcccatttgagtattcgccagatggtgtgatggcccttaggaccgcggtttcgtttggctcgtatctccgagcgtgtctgaggattagattgattgcttgacataaatagactcctttggttaaggcgttaaatgagttgatcaaccgcatcaagataagcgataatggggttgagagaatattttattggtatgccggaagttttaaatgcggacatgggaattgatttccgaccatccgcattatcctgtgcgtcccaatatttgattaaatcagttgcctttaataaaaataattgatcaagcgtggcaaatttgattaaaccaaaacaaattccaccttgttttaaacaactacgcatgtgctctacttgatgctgatgaaaattatcgagaggaaaacgcgttgtttcctttgtttcttttgcatcaaaatcgatataccggccacgataaattccgttatagtcagtggttgaggcttgccggaaataagcttcccgaattaccgcagcactacgtttaggataatctaccttgacgatttgaataggagtcggttttttatgaataactgcaatatcgtgggccagataatactgattgctttcgttgatttcctgttctagcgtcataccgcggccaccgtgcttcactagtgatgcatgcgcatgtgttgaacgttgagttgcttgcggctggtattttgtcccgttaggataatggattgtcactggctggatcatctcttttctatagtaaaatgttgaaaaaaagtccgtacccagttacgcttattataccaagttgcttcgtgaataaaaactggaatatgaaactattaacttaagtattatgtaagaaattagtttttgcacaacactcatggttgaaatgataccacaaaaagggggatgagaaatgcaacgagtttggataacggggtaccgtgcctatgaattaggcgtattttccgataaagaacccaaatttttagttctgcaatacgcactgaaacagctgatcaaagcggcaattgacgatggaacgacatggctgattactggtggtcagatgggaattgaacagtgggctgcccaagtgggtttatcattaaaagctgaatatcctgaactgcaagttgccatgatgacgccatttacccatttcggtggtaactggaaaccggagaaccaagccaaattagcgacgttactatcccaagttgattttcacgctagcgttagtaaccatgattatacatcaccgcaacagttaagaaattaccaagaattcatgttaaaccatactgacggtgcaattttagtatacgatgtagacaacaaaggcaaatcgagttacgattatgatgcaattgtaaactggcaagggcagcatgattaccccttgcaaatgattgatttcgatcaattacaggaattttcgtatgaatttggagaaaattcagataaaaattcaaataagggtttcaattcaaactaaaatttgttaacatcttaaatgttggtgttgaataaatgatgaggtgtatttaaatggcaaccattaattataatccaaaagacatccttcaaaaagagttcagacaaaagatgcggggatatgatcccgccgatgtcgacagctttttagataatgtgattaaggactacgaaacattcacgaaggaaaatcagcacctccaagacgagaacgaacgtctgcgtgctaaagttgatgaattgacgaagcagttatccgttgggggcacaaccgctgcccaaccaagtcagccagctactaatgtgactaacatggatattttgaagcgtctttctaacttggaacgccacgtgttcggttctcaagtagacagtggtgctaacgcatctcaccgtctttaataatttgatagtaacttgtaaatctcgggtaatcgcggtcggcttatgtcggctgaggaaagtccatgctcgcacaagctgagatgcttgtagtgttcgtgctcggtgaaaaaataagccgggggacttcgcaagaagttacggcgggaaaacgcgctaaggtttcggctatgcgttaatatccctgaaaagtgccacagcgacgatgacatattcggaaacgggtacggtggaacgttggtaaacccctcgagcgggcaacccaaactatggtaggggagcttcacatctggaaatgaactaaatgtgggggaagagtttttactcttgagatagatgattaccgctttgttagactgtccctgacatctaataaagtacggaacatggcttacagagatttacagttcaggattggtgagaggagactctcaccttttttttatttttaatttggagcaaggaagcacattcttttaagaacgtgatgaattgcctttttctgacgttgtttgttggtaatcggttgggaatatcgtataataagaacgtacgtttgctaacgataaaatcaaaggatgttaccgcttatgacgctaaaggcgattaaaacccgcatttatcccactacgcaacagcaggaaaaaatcacggctaacttcggttactgccgtttcgtttggaatcagctgctcgacatgcagaagcaacgctatgctaacggtggcagttacgtcaacgagttcggcatgaactacctcattaagtgtttgaaaaaagaatacccttttctcaaagcagcagaatcgacatcactgctacatgtgagtcgcgacttgaatcacgcctatcaaaaactgttcaaagagcacaaagggtttccaaagttcaagtcccgtaagtttcccaagcaaagctatcaatgtaatgcggttaaccacaatatcaaactggttgatcagcatcatcttaagttacccaagttgggccgtctaaggtttaaagctggccgacaaccggttggtcaaattaagaacgtgacgattcgcctctccgctaccggtaagttttacgccattattttggttgatactgatattgagccattaagtaacactggtaaggccattggtatcgatatgggtgttgcggatctcatgattacttccgatgggatcaaataccccaccatcagatttgataaacagctcagtaaaaagaagcgttactgggaaaaacgtttagctcggaggagacatcaagctgaaaaagagattgcctgggataaacacaatcaggtacccgaacccagagagctggccgattttaaaaactaccagaaggctaagcacatggtcgctaaatatcatgaaaagattgccaatcaacgggataactatctgcacaacatcaccaaagaactggttgaacaatatgatgtgataaagattgaagatttgaaagccaaaaatctgatgaaaaatcacaagctatctcaggcgattgccaaccaatcttggcgaaaattacgtttaatgttggaatataaatgtgcttggtatggcaagcagctgttcattatcaaccccagaaagacttcacaaatatgttcaaactgtggctacgatgatggcaagcacaccttagacattcgccagtggacgtgtcccaactgcaggattaaccatgatcgcgatatcaatgccgcaatgaacattctaaaggcaacagtataataaaaaccaactgggctggaacagcccttagtcaatagccgtaacctctgcgtaccattctttgaatgatacgtaagtcagcggtgttcctagaagctcgttactttagtgacgagttgttcacgcaatcaaagacaagaaaatacgttcccatcaggaatgtgatgaattgcctataaaatgatgttaatgttagtagcgaaagctaggctaccagattttggctataacggggatggcacatacctttggcaacaatctggttttcgacagtgcttttagaaacttgttactttaaccaagtaaccactcaccacaaagaaagaggcaaaacatggcagaacagaaatttcaattgtatgcagcaacggctagtggattagaagctttagctggccaagaattacgggacttagggtatgacgtgcgtgtcgataacggacgaatctattttgaaggaaccatgaccgatattttacgggcgaatatttggctacgttcggctgatcgtatcaaaattattttaaaaacgtttaaggcgactacgtttgacgatatttttgataccgttaccgctatgccgtgggatcaatggctgccaatggatgctaaatttccagtaaatggccgctctaagaactccaaactgttcagtgtgccggatattcaagcggtcactaagaaagccattgtcaatcagatggccggtgcttatcaccgtaaaagtcgttttcctgaaactggtgccctgtttaccttagaaattgcgttaaataaggatgaagcaaccctgacactagataccacgggtgatagtctgttcaaacgaggctaccgtcaggaaaagggcgaggcgcctttaaaggaaaactttgctgctgccttaatcatgctgaccaactggcataccgatatgccgttcgttgatccaatgtgtggttctggtacgttgcccattgaagcggccctcatggcacgcaacattgcgccaggaatcaaccgccattttctatgcgaaaactggcatccagacaaccttaagatttcaaacgaacttaaggaagaagcaaagactaagcaaaacgacgatgttgtcgacattactggttgtgatattgacggttcaatgatcgatatcgccaagctaaatgctaacggcgctggcgtgttacatgacattacctttaaacaggtagcggtcaaagactttaagactgataaggaagacggtgtcattatcgccaacccgccttatggtaaacggatgggtgatcaaaagagtgtccgtaagctctatgaacaaatggggcaagtattcaaaccgttaaccacctggtcaaagtatattttgactgctgacctcgagtttgaaacgttctatggtgaaaaggccacaaaacgtcgtaaattatacaacggtgccttgagaacggactacttccagtattggggacatcgctcacataggtaggaaaactttcaacgaaatagaataaaaagagctgacatgactaatcaatgagtgaagtgactagtcgtattagctctttttattcatgatgatgtattaaaacctaacattgcgacgaaaattcttaaaaaaaattaatcttattctcagatagtgttcacgctgtttactggtcaactgttgtgtttctcaagctcacatcgtgaaaataccgctggaatagtattttaaaccatgttagaattcataacataatcaaagagagaagtgattttatatgagtcttgctaacgtctcgtttatggtgctatccagtattctggttttattcatgacacctgggttggcctttttttatggtggtttggtgtcaaaacgaaacgtagtcaataccatgctgtcagtgtttgtcatgaccggtgtcgccattattttgtggattctaattggatattcattgtcatttgttggtgatcatggcggtgtcttcggcagttgggcccacccgtttatgagccacctgaatctaaatacgttgactagcactcatattcccacaagtctttattcgttattccagatgatgtttgcaattatcaccccagcactgtttgttggtgcggtagtgggcagaattagatttaagtttttgctgactttcttagttgtttggtccatttttatttactacccaatggttcacatggtttggagcccatccggattgcttgctaaactgggaacggttgattttgccggtggaaccgtggttcatatcaacgccggtattacggcctttgtgttatcggcattcttaggcaaacggataaagtttggtgacattccacatacccattacaacttgccttgggttttgcttggaacgaccattctttggatcggttggtacggtttcaatgctggatcagctctaggcgttaacacggtagccgttcaagcaacgttaaccaccacggttgcaaccgctacggcaatggtggcgtggatgtttcttgatgttttcattaaaggtaagccgacgttggtgggtgtttgcacaggaacgttgtgcggtttagttgggattacgccaggtgccggctttgtcactgtgggtggctcattctggattggcttagttgtaacttgttgcagctacttctttgttaacgttctaaaggaccgtattggtgtggacgatgcgctggacgcctttggttgtcacggtgttagtggtatcttcggtagtattgccacgggtttgtttgccacgaaatcagtgaatagcagtcttgcagaaaacggtttgttttacggtgggggcgtccatcttttcttaattcaacttgctgccactttaagcactatcgccttcgttgctattatgtgtattgtccttatcaaagcactgcaacttgtcatgccaatgcgtgttgacgccgatgaagaagagctaggcttagatattggcgaacatggcgaagaagctgattatacggttgaacttagcgatgatgttgctaaagcccagagtgatatgaaactctatgccaccgaatttaaggggcaaactgcccgtttacgagaatgaactcattctttataatggaaccatctaagtaaatgaggtggtaacatgggactcgaccgcacacaacgagttgaactagttaatatgtgcatgatttacgacgagaaaacaaaacaagtgttagtggaagataaaactgatgtgagctggaagtttggtcacacctttcccggcggtcacgttgagcccaacgaacccgttgcagatgccatgattcgggaagtttttgaagaaactggtctgcacatcagtcagctagaagcttgtggctgcgttgagtggttcgatcagcaagccggttatcgaaaaatcggttatttgtaccgaacaagtcacttctcaggcattctgaaacaaagtgacgaagggcgtatcttttggatgccgttggccgacttagacgcatcaaatacggcggaaagctttatggaaatgttagccatttttaccgagccaacaactgtttctgctatgtccttgactatgaatggtcaattacacttaactgccaatcagcaggacaatcaataaatcccagacagaatgaacaataatacttggccacagtgaacggctcttgagaaataaccaaccgaacagataaccaagaatggcgacggtcactaactgccccataatcgtgatcaacgaaagcgctggataagtcgtgaggtatttaggcaggtgaatcaacgcaaacaaaactgcctgaataatgagtgctgactgttcagtgggaacgattttgcgtaaccgatttagcagataaccacggaacatggtttcctcacaaagacccacaatcaaaaaatcttgcagcagcatggtgggtttaaaactagcaacaacgctaatactatgtcgctgaataaatgcgctggctaacatgtaaaccaagattgcagcaagcgtcacataaagtggtttgaattttaagtttagctggaagggccgttcaacctcgaattggtcctttttcgtatgaaaaatcatgaaaaaaccgacacctaaccagatcaacattttgacggcatccgtcaataattcctcggtccagccactagtcaaattcataatgggtacgttgataaaaacttgtatgacaaaccataaaacaaaaaaatagccgtactgactaagtagttgacgacctgttcgttgatgcaacatgatgtcacgtccttcattgttattcgttgtttttagtgtagcatgcgcatagtgcaaggacaaataatggtgcgcttcttaagcaaaaaacgaaaaagacctttacttacaaaaagtaagctgttatactagttcttgtaaattaataaatgaacgcaacttattggaggactttataaaatgaaagaacaacttttaaacttagctaaacaacgtcgctcaatctatgccttaggccgcaatgtgaatgccagtgaagatgatttggcaaacttgatcaaggaaacaatcaagtgggcaccaacttcatttaacaaccaaaccacccgtgcggttattctctttggcgacagccacgaaaagctttgggacatcgttgccaaacgtttgaagtccgaagtaccaactgaagaagcttatcaaaagacgttacaaaagatcaacagcttcaagtcagcattcggaacagtcatgttctacacggacatggctatcgttcaccgttttgaaagtgactttgcgctttatgcagataacttcaaagactgggctgaacagggccaaggatatgcacaatttgccgtttggactgccttagctgaaaatggtttgggtgccaacctgcaacattacaatcctctgattgatgaagaagtaaaagctgcgttcaatattcctgataactggcaattacgtgccgaaatggactttggttcaatcgaagcacctgctggcgacaaggaattcatggctgacgaagatcggttcaaagtattgaagtaagttttataaataaaatttaaagctcgtttaaaaaacctgacagatcacaacaatatttgtgataactgtcaggcttttttgggcgttcatttgagttgagacaaataagatcaatcttcaaaatatagatttccataaattttccaaaatttctagtttaatcttgaaagcgatagtatgctagaattacgctatgaaacaaaattgattttgggagcgtggtttggagcatgaacaagaaagttgcaattatcggtggtggtatcgttggtgcaagtgccgcgtactatcttagtagtttacctggaggcagccaaatcgatgtgaccttatttgacgagggtgtcggtcaagcgacaaaggccgcagcaggcatcatttcaccctggttgtcaaaacgaagaaatcaacagtggtatcagttagcaaaagatggtgcgacgactttaatgacgttggcaaggcgcgcgaacctttcaacggatatttatcaacaaactggcaccatcattaccagaaccaacgagaaggaccttcatgatttgtacgtgttagcacagaaacgtcatgaagaagcacctgatatgggtgaaatagaacgcttaacagctgaagaagttaaagcgcgcataccgttattgaccaatccgcagccaggtatttacgttagcggtggcgcacgaattgatggtgaggctttggttcgtgaattactggcgcaagctcagcaagtcaatttgaccgtaaagcatcaacaagtgacttttgatcatcaaggtcatctgatttctccaaccggcccgcaacggtttgacaacgtcattatcgcagttggtccttggttgaacgaattagttgaaccattggggatcaaggtggcggttcgaccacagaaggggcagttgatcgaattatctgtacccgattatgaatcacaggaaaacatgcccgtactgatgccagaaggtgaacgagatttcattccatttggtcacggcaagctaattgttggggctactcatgatgatgaagctggttttaatctaacggcaaccctcgaagctacccaagatttactgagtagcgcaacacaatttgccaactatttaactcaggataatattacgcgcaccaaagtgggtacccgagcctatacgccagattttgccccgtttttcggtcgcctgaaggcctacccgcaaatgcttgtggcaagtggtttaggtgcctcaggattaacgaccggtccgcttataggtcgcttattagctggtaccttaatttatggtggcacacctgactggtcaaattatgaaaaaccgttaaccaattatttaagctaatcattttcgtgcaacgcttgctgggcaagattgtgagcgccttggttttgtttttctggcacccattgagtgataacgaggttaaacgctgactgcttagctagtagttgatcaaccaggtcttggtaatgttttgcatagcgcttttcaacgctgtcggcaacaattttagaatcagtaaaatattgaacggtggcggttttggcctccccgtttagaagcttcagcaacgcttcgaatccagctagggctgcgtgaaattcggcatggtgattgtcgctgtcaggcaaactggtgcgtaattgctgttgctcgcccgcgtgtacgatcaggataccagctgcactgtgctgggtatcgttgttggttgctgcatctgtgtataacgtatacatggtatcaaacctttcgaaatgaggtagttctatcataaatcaaaagcgaaaatttttatatcaacctgcgccattaagcagtattattctgtggagctggacattttgccttcttttccttgccctgatcgttgggttagaggtttcggccaaactgcaatggatcgcctatctactaggaattatttttctggtgttgacttgggcacaaattcattatcgccatatttatttggataatggtatcatcagggttagccgggtgatcaatcgtaactgggttcacattcggttaaaggatgttcaggaacttcacgtttcaaagtaccgtttaggttttatctacggtggtaagatttattcgtttatcatgccattgaattccatcattgaattgagtaatatcattggtgaaaccaaagaagaagcactcaaataaattggaggttgtttaattgaatgatattgaaatttcacaagctgcaaaagagaacccaattacagaaattgccgctgaattaggactttctgctgatcagattgaaccttatggtgcctcaaaagcaaaaatcaaattacccgttaaaggtgacaccaagaattccaaactggtcttagttacttccatcaacccaacgccagctggtgaaggcaaatcgacggtaacggtcgggttgggtgacgcccttagacggcgcggtaaaaaggccgccattgcattgcgagaaccatccttaggcccagtcatgggcatgaaaggtggtgcgactggcgggggctacgctcaagtgattccaatggaagacatcaacctccactttacgggtgacatgcatgccttgaccgaggcccatgataccttagctgccctgattgataaccatattcagcaaggcaatgaattaaatattgacccgcgccaggtgatttggaagcgggtattagacattaacgaccgcgcactgcgtcaaactgtgattggtcttggtggccggacttctggtgttccgcgccaggatggttttgacattaccgttgccagcgaactcatggctattctttgtttgagtaaagatcttgcagatttaaagtcacgaatcaatcgtatcgtgattggttatacttatgataaagaacccgtcacagtagctgatttaaaagtgggcggtgccattacattactgttaaaagatgccattaaaccgaacctcgtccaaaccttggaacacacaccagcaattattcacggcggtccattcgccaatattgctcatggctgcaactcagttctagctacccaaacggctttgaagctggctgattatgttgtgactgaagctggtttcggtgctgatcttggtggcgaaaaatttatggatatcaaaacgcctgtattaggcaaaacaccggatgcagtggtcattgttgctaccgtccgggcgttgaaatacaacggtggggttaacaagaatgatcttgaaaccgagaatttggaagccttagctgctggttctgcaaacctgaaacgacacgtggcaagcatgcagcagtacggtgtgccagtgattgttgcagtgaaccgctttacttctgatacggatgcggagatcgatcagttacttggttacattaaagatgaactccacgtcccagcatatgacacgacggtttgggcaaatggcggtggcggtgcacttgaacttgcggacgctgttgttgatgcaaccaatcaaaccagtcattttaactcactgtatcagcaagatgacgatgtggttgccaagatgaccactatcgttcaaaaaatatatggtgggaaggacgttgaactggaagccaaagctaaacgtcagttacggcgatttgcaaagtatggctgggataaattaccagtctgcatggccaaaacccagtattccttatcggacaacgctaaagcccttggtgcaccaacggactttacgattcatgtccgggaattcgttcctaaattaggtgccgggttcatcgtggcgatgactggcaatgtattaaccatgccaggactgccaaaacatccggccgctttgaacatggatattgacgcaaacggtaagattacgggtcttttttaacaatcaactcaagcggattgataacaatgacgtttatcagccgcttttttgatataatggaagttacttaaacaaacagctgctattttggcgcagatgaatttatacattttaaagtaaaggaagttgccaacgtgttaattgggctaattacagcatttatcatcttattatttttcattgaccaatggatcaaacattttgttgtggcaacgattgcactgggcggtacgcataccgttctgccggggattctctcgttaacgtacatccgaaacaacggggctgcttggagtatgctggctggtcaacagtggtttttcctgattatttcagttgttgcgttagcggtcatgatctggtttttagtccgctatcacactaactggcggtatgaaattggcttggcctttatgattgccggcacattaggtaatttttacgatcgcctcgtcaacggcttcgtggttgatatgtttcaacttgatttcgttaattttcccatttttaattttgctgatagctgtttgaccattggtgtcatctggatcatggtgattttgtttatggaagataaagcggggacaccaaatgcctagaacagtacagttagtgattacagatcaagtcggtcgattggataaggttgttagtgacatgatgccagatgaaagtcgatcacagctcaaacaagcaattgatgacgagcgtgttttggtgaatcaaaaggtggaaaagccgaagtacaaggttcagcctggtgatcaaattgaagtgacgattccagaccctgttgcacttgatctggagccggaaaatattccgttggacatcgtttatgaagatgacgacgtgattgtggtcaataaacctgctggaatggtggtccatccgtcacctggacatcctgatcacacactagtcaatgcgttgttataccattcgccattgtcaaccatcaacggcacttaccgacccggtattgtacaccggatcgataaagatacttctggtctactgatggtggctaaaaatgataacgcgcaccggtctttagccgctcagttgaaaaataaaaccaacctacgggagtatatcgcgctggttcacggtgttatcaaacaggataagggcgtgattgacgcgccaattggccgttcgccaaaagatcgtaagcgtcaggcaatcgtagcggatggccgtcatgctgtgacccactatcaggtgttagaacgttatttgaactatacgttgatttcttgctggttagagacggggcgcacgcatcagattcgggtacacatgaaatcgattggccatcccttagctggtgatccactttatggccctcggaaaacgattgctggttccggtcaatttctgcacgccaaaaaattggggtttaggcacccagttaccggcaaacagctggtgtttgaagcaccgcttccagatgacttccaacgggtgatcaatcggctccgagaacagacgccccattagagataaaatcgcttgcaagtcaatttattccagcatattgtaaagttattataggatttttgagataaccagaatttaaaaaataggaggccacttatggcaaaagtagttgtagatgcaatggcaatgcagcgtgcactgacacgaattacttacgaaattattgaacacaataaaggaatcgatggtttagtgatcctgggcattaaaacgcgtggggtctatttagcacaacggattgccagtcgcctaaaacagttagagaatgctagcgtcccagtgggtgagttagatgtgacgcaatatcgtgatgatattgagcatgatagccaagaaactgatcctcaggtaaccgtatctaagattgattttcccgtgacggataaaaaagtgattctcgtcgatgatgtgctatataccggtcggaccatccgtgctgctatgagtgccattatggacctgggacgtcctaaacagatcaatttagccgttttagttgatcgtggtcaccgtgaactgcccattcgtgccgattttgttggcaaaaacattccaagttcacagcaagaacggatcaaagtctctgtcagtgaaatcgacggccatgacagtgtcgaaatcattgaacggtagtacagtaatcaagattggaatgatgtaaatggcacaacgttttttaatattggaagatggttcggtctacccaggccaaggctttggtgcgggagcaacaaccactggcgaaattgtctttaataccagtatgttgggctatcaagaaatcgtcacgaaccagatctaccacaatcagattattgttttttctcagccgattgtcggcagtattggaatcgctcacgatgcctatgaatcgatcttaccaaccgccaaaggaatggtggtcagagatgtcactgatatttccaaaaatcgccaacgttcattgtctctggatcaatttttaaaacagcacaatattcctggcattagcggcattgatacccggcatttaattcggcaaattaatcaaactgggaccattaaaggtagtattgtggacgtggctgatgatcacgcctttgatcaactacatgccactgtgctgaccaatcagcaagttgctcaagttgcaacgccacggccataccccaaccccaatcaaggttataacgtggttgtgattgattttggtctcaaacatggcattttacggcaattgtctaagcgcgactgcaacgtcaccgtcttaccttgggatgccagtgcgcaagatgtgattaacctggatcctgatggcgttttactttcaacgggacctggttcaccgctgaatctcccagagagtgttttggacatgattcgaacaattcaagaacggattccgttattcgcaattggacttggtcacgaattatttgcgttagcgaatggttctgaaattaccaaactaaaattgtctcatcatggggctaatcacccaattcgtaaaattattactaatgaaattatttatgctatggagagtcaagaatacgttgtggatccagattcagttaatcgtgatcgtttgattacaacttatctggatttaattgacggttccattcaggggctacggcaccgagattacccagcattttcggtccaatttttccctgatggcgcccctggtcctaacgattcagtggacttattcgatgaatttattgaaatcatgggaactcggaagtgatgagatggatactgaaattcaaaaaatacttataatcggtggcggtccaacagaaattggccatgaaaccgaattagatgctgcttgtgtccaaatcattcaagcgtttaagaaacagggcattcgttcattgttaatcgacaataatccgttttctgcggcgctggaagacgttcagccaactaatatgttcattcaagcggtaacggctgataatgttcagcgaattatcgaaaaagaacaccctgatgctatcttggctactactggtggcgtcaccgctatcagtgtgattcaagagttacaagaaaatggtgtgttgaccgataataacgtgaaaactttgggcattcccgcagacgccatgatggacatcaacaatcctgatcggctcaacggtgtcatgcgcaacgttggcgtcccagtcattgcttcagaaaccgtgggtaccttagacgaagccatcaatgtggcgaatgatattggttatcccgttatcgtcaaaccgattgcaccgcgaatcgataccaaccgaatactgtgcgaaaacgaaagcgacatgctcagtgctgtttcacgagggtttacttggtcacgtttcaaacagtgtgtcatcgagcaaagtatcgttggttataaagaaattgaattagtgtccatgcgggacatcatgggtacgcaagtgttaatcgccggtctcgaaaacattgatcccattggtattcactctggtgattcaatggtcgttacaccgactttgacgttaagcaatactgaatacgaaatgctgcgcgacacggcttttgccattaataatcagtttcaatttacaggagttgtgcatactcactttgccttacgtgcagatggtgagcgtttttacgtgactaaagtaacgccttataatgaccgtggcacttcactggtagctgcagcgacgggatatccaatcgcgtatgtcgccgctaatttatatttgaaccaaaaattaaccgatgtccatctacccgacatttatcattttaaacaaacagcgctactggaacccagcttggatcatgtggtagtcaggattccgctttggccgtttgaagacgttaaaaatgccgatcgacacttaggcacggtgatgaagtcagtggggtcaactattggtatcggtaggagtaccgaagaagcaattctgaaagccctccgatcgtcacagttcagtccgcaagatgaattaccgtcaatgagtaacttaaccgactcgcaaattatttcacagttgattcacccgctatccagcagaattttagtcttactagaagctttgcggcgcggttaccaagtagatgaactgagtgaactcaccaagatcgatcaattttattttgttaaattaaagcatattcttgccatcgaaaccatgatcagaacccacccgatggacgttgaagcccttcatgaggggcgatattacggcttcggtgacgggatgattgcgaagatgtggcaggcagacattgaaactgtccgtcagttagggcatgataaccacatttcaccgacgtataaaggcgtcgaaccatcagctggtgaattgctgaactcaccaacaacgtattacagtacctttgaacttgagaatgaaagtcagcagctttctgacaaaacaatcttggtcctagggcgtggcggtaatcagttggggccaaatgcctcagccgattatttcacgactgaaatgcttaaacagttacggaagtctggctatcaaaccgtcatcatgaatactaatcccaacgccgggtcactaacggcaacgctcagtgataaacagatcattgacccggtacaactgggggacatcatgaatgtgattgccattgagcatcccgtgaaaattttcgtgcccggcaaccggcactatttgacccgagaattacggcgacgacattactcgatttcaattttgccgccggatcaagaaaaacgtagtgagttgttgaccgatcatgctaatattggccttgatttatttgtgactgaagggcatatcgttcccattctggtcagtgatctacgttcagatcaaggcatcgctacgacgttagatcaaattacgttgatgcggtctccagcaacattaacggatgcccaattaaatgagattcttgtacatgccaaggactatcttggacaccataagcggactggaatggttcaaatgctatatacaactaatggcaaacaatcaccgcgttttgcgggtgtccggccaactcggctaaccacaattgcgtacttaaataaggtcactggtattaattggattcgcatgctggtacgccaagcattgggagaaatcaatgaagatttaattgcgcagttagacgtggatattcactctgatcgccgttcgcaggtacggggcacatttccgtttaaacaactgcaattaccagatcagttgggccttacaactcaagaagtgggtgcccgaattagttttgaaacgttgtaactaattgaagtcaaaaaagccatgcttccagtcaaaactggaagtatggcttttaatgtacacggagatgactactgcgtacttaatttttcaacaaattccctgtctggggtgacaaagagggtcttttgaccttcataaataacgtaacccggcttggtaccgtttggtttacgaatcttcttcacttgaacatagtcaactggcaccgagctagactggcgtgccttggaatagtaagcggcaatgttagctgcttcaagtaaggtttggtccgaggggtctgcatcgtggatgatcacgtgagaacctggcatgtttttaacgtgcaaccagatatcggttttagccgcgctatgcagtgtcagtttctcattttgcaggttgtttttgccgacttcaattttggtgccatcactggctgcaaaaacttctggtttagagacttgacgccgtttctttttaccactgcgttgattgtgctcatgatctcgtaaatagccgccctgctgcaattcagctttaatatcggctaaatcctttggggctgcaagttcaatttgtgagctgatgttatccaggtaatcaatctcagcattggtcttcgccatttggtcgttgacataactgacagaagcctttaatttattgtacttcttaaaatacttctgggcgttttgtgaaggactgatttggttggataaggcaattttcagtggcttttcgtcattgtagaagttcggcagggtaatactagttattccacgggtcactttagtcaggtatgtggtcagtagttcacctttgattcgatactcatccgcgtcatcggctgatttcaaagttgattgaagtttcttgagcttggttcggtttttcttgagttcgttgcgaaccacgtgaatcaaagtactgccttgctgctggactcgatcacgttcagcccggtcttgatagtaaaagtctaacatggcacttaaactatcaaagttcttgctggtgacgtgttcttgaccataagggaaggcgttgaagccagtcttgcccttatcattagtcaccagaactggctccggatcatcgaatcgcttaaagaaggccgtaaaattgtcaacagggtcacctgcttgatgtaaggccttggctaatcctaaaccagtatcctgaccaagtccttgataagtgtgacgtaattcttgggtcaagacatcttcattaggataatcgcggactaagctttcaactgcgtgagccgcatccggttgaaagggatctattaaatcctgtgcaggcggattaatgtagtgaccacctggcagtaatgttcggtaccggttctggtctgaaccaacgtgtttgatcgtatccaaaatagtactcgtagcaaggtcaatcaagatgacattactgtgccgggccataatctcaataattaaacgcagggtaacttgatcgcccagttcgtttcgactagtaaagtccaagtgaaccacgcggtcgttagctgcctggctgaccccggttagaattgcaccgctcaagtacttacgcatcatcatggtaaagttggtaggtgttactggattaacatagggtatatcggtaatttgaattcgggcaaaagttgggtttgctgataacaataacggtaaactcttgcggtttgcccgaacggttaagatcacctcattattatacggctggttgatcttagagacacgaccgccaacaagctgtcggcttaattcgccaaccattgcgtgggtgaatgcaccatcaaatgacatggtctcacttccttcgttcgttattcacacggatactagtataacggtgtttacacccttagtaaagcagattggttgtaaattatggcctaaataagaggctttttagcaaaaaagatgtataatacaagtaaatcacagcgaaaggggagtcgtatcttggaaggaatcttagataacttaagtttagctgccaaatcgttgcaggcacaaacggccaaaattacgaagcactaccacgttaccattgccgaatggcgactcttacgccaaatcgaaagtcaggtaatcactcaagatgccatggcggaagctttacaattggacacgtcaacattaagccgacagttaaaaaatctcagtactaaggagctggtttctaaaacggcggtaggtaaagatcgccggcagctggaatacgcacttacagcgatggggcgtgatactctacaacacgttaatgcggattacgatgcgttgatcgacgctgtttttcactactggcctgaagatgaacagcagatgatgaaaatcatgctaaatcggctgagtcgtagcattgatcgcgcagacagcattttagaagaaaactcgaagtaaagttcgtaacgactgttgaaatctttaaacaatcgttacgttttcgtctgtgcttgctttcacttcgcggattcgttacaattaatcccagacttaaacgacaggtaagttaaatcgataaaagaaacgggtgtttacaatgaaaatagctgtcgtcactgatagtaccagctatttgtcacaagaagacattgagcgctatcacatacacgtcgttccgatcccagtgatcattgacggccgttcctacaatgaaggtgtggatatcagcaccgaagaattctgggataaactacgatcctcgaaatcctttccaagtacgtcacaaccaccgctgggtgaaatgattcagttgtaccagcaactgggtgatgaaggctatgatacgattatcagtattcacttagccagcacaatctccggctttgttaattcactgagacaggttaacgaaaacttaacaaacactcacgtcgtcgtttacgattcgcagattaccgtgaaactcatggggtatttggcgattgaagcgtcgaaactcgccaccgctggtaaaacggttgatgaaatcgtgtcacgtttagatgccgttcgggcaaccatcgacgaagtttttgtggtcgatgatctgcaaaatctcgttcggggcggtcggttgtctaacgcatccgggtttgttggcagtttacttaaaatcaagccactattaacctttgacgatgaaagtcacgaaatcgtggcctttgaaaaagttcgctcacggaaaaaagcgttgctacgagtggaagatttgtttgctgaagcagttgcagccgctgattatccgttacgtgccattattattgatggcaacgatcctgagggtggcgataactggcagaaacagatcaagaacaagtttccagagattcccatcgagcgcagttactttggtcctgtaatcgggacacacttaggagaaaaagccttagctttagcttggctcatcgatactgataaagcttaattttgctattataattcgatatgttttaacgaccccgtaagtttttgcggggccttttttctgtaatcatgtcagaaaggttttgtatttagtggaagcgctttataatgggggagaataagaaataaagttcaaggaggttttggcatggtgaaaacaaaagcagtgatgatcggtgcaggcttagccaatatggcaagtgcggtgtacttaattcaagaggcgcattggtccggtgatcaaattacgttttattcgattgatgaccatggttcaaatgacggtgatgaggtcaagtacgctaaagatgattactggaataagaatcatcctaccgaaaatcatgaaggttacgttgcccgtggtggacggatgctcaattaccgtacctacgtcgacttaatggacctgttaagtcgtatcccatcaggtaccgaaactgggatgacggctgcagctgatacgagagaattcgatgctcatcaccgaacgtttgatagagcccgcctgttacagggcggtaagggcattgtcaacggcggcaagcttggcctgaataaccaagaccgttcactgttgactaaactcattttaatgccagatgatcaggaagagcggctggacaacgtcaccatcgccgaatactttcaagatgatccgcacatgttccaaactaacttctggtacatgtgggaaaccacctttgcgtttcgaattcaaagttctgctcaagaactacgccgttacatgcaccaaatgatttacgaatttacgcaaatcgagcatttagtgggcgttaaccggacacgttataaccaatacgaaagtatcatgctgccactgatcaattatctgaaagatcagagttgtacttttgtgttaaatcgccgcgtgacggactggcgtttcaaacaaacaccgttgcaagacgaaattaccgttactggactggtgatgaccaatacagaaaccggcgaagaggaaacggttgatgtggatgaacaaaccgctgtcattttcaccaacgggtccattacggattctgctaccatgggcgatttcaatacgcctgctagtgaaaacatggactatggcgctgcctcagggctatggaaaaaggcaacggaacacttctataaccttggcaaccccgataaattctttgcggaccgtaatgccagtgagtggagcagttttacactcaccactaagaatcatttattactaaacgaaattacccgaatcaccactcaagtgccgggtaacgcgctaaattcatttatctcaactgagcccattacggatctaggtcaaaacgacgttaatatgtcaatcgtggtgcatcatcaaccgcatttcaccactcaaaaaccgaacgaatcagtgatctgggggtacttcttgtatccacgccgatacggtgagtttgtggacaaaccttacgttaaaatgaccggtaaggaaatggctacagaactcattggtcagctctccaaagttgatcctggtccaggtaacattatggataaaaaggctgacatcatggatagtattatcaactgtattccggtttacatgccatatgcttcagcattgttcaataaccgggctaaaacagatcggccagaggtgattcctgaacacagtaccaacttagctttcaccggtgaatttgctgagcagccgtatcaaatggtttatacagaacaaagtgccgtacgttctggggaaattgctgcttatcattttgctggtattccaatgagtaagttggttcatacgccacggtacgacaaagattggaagacgctggctaaggcgactaagaaactgttttcttaacataacaggtaactgttaattataaagaccgaatgcgatttaagtattcggtctttttgggtttggtcgattagcaagtaagttgacattgttgattcagcaacgtaacataaatatttagtagcttactattcgtaaccagaattaaaaattgccacctagttagctgctagtagcattttaaacaaagataatgactttatatacataggaggcaacgttaatgaattatcaagaaccatttacctttcaatctggcgttacggtcaaaaatcggctagtaatgccaccaatgaccaccctacaaagtttctatgacggtacgattacttctgatgaaatcaattactatgccgaacgcgcacacggtgttggtgccgtaatcacgggtgctgccaatgtgaccgacatgggtaagggatggcctggtgaactcagtattgctcacgatgaagacttaccgggactcactaaattagcgagtgcaatcaaagctcaaggtgccaaggcgtttgttcagatttttcatgctggacggatgagccgctttgatgccttaaacggacaacaggcgatttctgccagtgctgtagcagcacaacaccgtgacgggtcaccaaaaacgagtacgccacgggaaatgacgttaactgaaattcacgaaacaattgacgcctttggaactgccactaaacgggcaattgaagctggctttgatggcgtggaaattcatggcgctaacctttatctgattcagcaattctactcaccgcagtccaaccggcgaactgatgaatacggtggggaccgtacaggcagatttacattcatcaagcaacttctcggtagtgtttttgatgcagtgaagcaatatgctgatcggccatttgtagtgggttatcggttctcgccagaagaatttactacccctggtattactttagaagataccttttacttagtggaccaactggtcaaaacacctctggattatctgcacgtctccttagattcatttgatcgtgttgcacaatcggatgactataaacaacaaccaattttggcttatttgcaccaacacattgctggtcaaaaaccattagtcggcgttggtggtgtgcgaactcgccatgacgttgaaactttgttgaagaatgctgaatttgcggcagtgggtcagcaactgttgttcgacccaacttgggttcaaaaattagaggcagggcaggatgcagatatggttactggcgattttacggaggctattcagtacatgccgttcagtcatccactatatcaatttctggttccgagataccagtagatcagcgtttatgaaaactagtttatcggaatgaagattaattcactttgaattggtcctttttagtccattggtctatatgtttctcgacgattcatgttaaactataattactattattttttcgtaaagaaggggctaacaatgtcagaaacagtattgatcactggcgcaaataagggtatcggttttgagattgcacgtcagctgggacaaaaaggctggacgattctattaggtgcccggaataaggagcgaggattagctgccgttaataaactacgggctgttggtgtgacggtggagttagtgatgattgaccttaacaatttagaaaccatccatgccgcggctgataaaattgctaacgttcatccggaactcaaggtattagtcaacaacgcgggtattcccggtgacatggaagctgaaccacttgagactaaaacaacggatctacaggcaactttagatgtgaatgtgacgggtaactttgaactgatcaagtcatttacaccgattctacagaaaaatcatggtcgaatcgttaatatgactattccggcgacaggtaaccggttctttcatccgtttgcgtactgtgtcagcaagtcagcacttaaccaaatgaccaagatgtttggcgacagttttaagtctcaacatattccagtggaaatttttggtgccgtaccaggcggagttaccactgatttgaatcatcatatggacaaccgtttcatgcgctcagtagaagacggggcaggttcggtagttaaattaattctggaccatcataatcatcagggcaaaacaatggtgcgttttggtggcttgaagttggttaaaaaggtcatcgtgggacattaatgtgtttgggataggtaagtagtggtcgtttggctaactagtgaaaagttactttaacctactaacaaaaccacaaaaaccaccatagggagagaaatatctccgcaccaacaaaaaaatgtcctatattcctataacagcgtttcaagaagtcaattaagattatcttgaaacgcttttttgacccatagaatcagtcgaaatgtaggcgataactggtaaaattctgggcccttaaacgtgaccaaagtagtttgaccaccgtgacccagtaaccactgaacagattttggtaccagtttaaaaacagcccaaaagggaatttaccaaaaataatttaaaatttacttgccttgcagtaacttgaaggtaatagactaagggtcgtcataaagcgtttctcattggatgacattcaatcagcgtatgaggcccatggaccaccatgaaaccattaaatcactggtaattgtgagcgagtaaatttttaacttattaaaataaaaaccggcagatggtaaatttgccgatttttgctatgtatggatggataggtatgaagaggtagtcaatgcaatttatttaaactttttccaaattgtgcttgccttgaagtaacttcaattgtattgccaattattttaatcagttattttatgattcttttagataactcaatcgtttttaccagcacagtcaaaatggccgctgatttatctttggatgcccaaacactctcttgggtcaccaacgcgtatgcgttaacttttggcggtttattactgcttggtgggcgtgctggtgatgtttttggtcgacggaaggttttcttggttagcctcgtgatttttagtatcggttcactactggttggtctgtcagtcaacggtgcaatgttaattgccatgcgagctctacaaggtgccggttccgcaattttagcaccaacaacattagcactactaatggacagctataacggcgtgatgcgaacccgtgccattgtgtattatggtgcaactggtggtctgggcgctagtttcggactcgtcattggcggtttaattgccagttatctttcctggcgaattggtttcttactaaacgttcccatcggtattttaatggccatcttaaccattaagttcgtgccaaaaagcgaaccatccaatggtaaaatcgattggctcggggctatcttgtcagttctcggaattgtggctattatttacagtattaatggcgccacttatccagtgccaacgttagtgattggcgttattttgatgatggccttcatctggcaagaacaacgagctgtcgaaccgttaatgccgctcaagcttttcaaagaccgcgagcgcagtagtgcttatctggcgcgattcttctttctcggcgccatgatttcgtacttcttcttaaccccacaggccatgcaaaatgtttatcactttacaccgttgttagccgcactgggattcttgccagaaacggtccctcaattcatctttgccacactggtttcacggttaaatacacgtttctcaaatacacaaattatgattgctggaacattgatcaccaccattgggttattaatggcagccattatgaaagttcaaagtgggtacctgctggcgattgcgattccgatggtcattattggaatcggacaggggttcgcattaagcaccctgactgtctccggggtagcaaacacggatccagaaattgccggatcagcttctggagtcgttaatacggtacaccaggtcggtagttccgctgggctatcggtcatcacgatgttgacagcaagtatcagtaatcccgttatctcttataaccattcactgatgattatgtttgccttcatggtggttgcgttgctctcaacgatcaatattgcctttacaaagaaataggaggatttaaaatgaacattaaagaagcgagtgaaaaaactggagtctcatccgcagcaattcgttactacgaaaaagggggtctcatcccaccgattgatagaactgatactggtaaccgtgacattgacgcgcggattataagacggatcaaatttgctcggcaaatgcgctcagcagggatgtcgattgaaaatcttcgacgctatatccagttattcgatgcccaggaagataacaccaaggagcaaattgatttactgcaagaacaactgactgaaatggaagaaaggcgggacgatattcaagcagccattgaccatctgcattacaaattggatcactatgatgatcacatggcgactactgaagaagagttacgtcagattgaaaaagaacatgactcaaaagccggtaactaatcaccaaatggcaaatttaagtgtttgccaaatcagaaagttatgctagataatacatcaagagccatagcagttatgtctgctatggctctttcaacacaatcgaaaccacaattggatttacttctttaaaaagtcctgtgcccaccaaccgtagacagggcttaatcccagagtaaaaatagcgataaacagttcagagagataactaacggacagattatggtcaaagatatagctaattgcaagttgcaaaacaaacaacatgagattcatgtatactgcaaacgtgagtgtaaacagccaaaaaataaaattacctttgccccatttcgaatgatgaccaaaatgaacgaataggtaagaacctataattccaaaccgatatcgcacccttcttaaatagtgtaaatcctgtgaatctgcctgaaattttgtcatcagattttgatccccctttaatagagtgtccagtgaaatatggtacagttcactgattttaatgaggggtggtatgtccggataattattgccgttctcccagtttgaaatggcttggcgggtgacgttgagtaattcggctgcttgctgctgagttaaccctaatgattgacgttgtgccttcaacttatcttttaacatactcatcctcgtctctattattcattcattaatgctattatactagcaagcagtcgttacagcacgacagcgtttcttgcatccgcggtatggcgggaatttacgttattcttgccaagactttatgatggaatttaacagttaatccttgtttccgcaaacctcaagccataagcttaagttaagaagtggaggtgagcaccatgaaaaccattctgattgttgaagatagcgacgacatgcagggactcttaaccagtatgctgtcagctgaataccaagttgtgagtgcgtattcaggtactgagggcttgatgctatttgagaagtatcccgtatcgttgattctgttagaccgcttgctacctggaaaaagcggggatgaggtgctgcaaatcattcgtcagacttcccaagtgcctatcatcatgttgacggcattagatgaagccagtgatatcgccgatctattggtggcaggcgccaacgactatgtaacgaaaccttttgatatcaatgtattgaaagctcggattatggtacagctacggccaacagggaccgatatcactgatgaacacccccttacataccagcagttaacactgtatccacatgagttcatggtgaaacgtggcactgccagctgttcactgaagaaaaggaatgtgaaatcttaaaattactatttatgaacccgcaacaaattttcactcgagaacaactctatgaacaagtttggcagacgccttatttaggggatgaaaatacgatcaatgttcacctcagtaatttacgaaataagttagcaaaattagactcagagcatacctatattgagaccatctggggaattggggtgcggttagcatgatactaatagcgatgattatcttgatagtggctgttttagcttattcctggttaatgatgatggatctacgggctttaatcaaccagttaacattcattaatcagcacaccacgaatcaacaattaaaagtcaaaacccgtaatccagtgatcgtggcgttgacacagcaaatcaatcagttgattaccaaacagcaagccactcatcagcagtcggtgcaaaccaaacagcagttagacctggcgattcataatatttcacacgacctacgaacgccactgacagttgctagtgggtattcgcagttattattaacaaacgaaaatttacctgaaactgaacaccagcaggtcagcaagttgaatcaaaacctgcagacattatcgaaacaccttaatctgctattactatataaccgactactagaaaatcggatcacgattattcccaagcagttaaatctgtcaaagctgctgacacagacttgtctgaattactacgatgcattgcagcagaaacaaattataacggatttaaagattaagcccaacattatgtggcaattggacgaggaagcaaccactcgaatcttacagaatattttaggtaatattttggatcatggctatcaaaaagcaaccatcgaactcaaacaaattaatcaaggggttcagctgacagcaacaaatcagttaatcacgcctatcaagaactttgaccggctgttggatcggttttacacagaagacctgtctcatcgcgagcaaaacgctgggttagggctgtacattattgcggaactaacacggatgcagggcggccaagttagcctgaataccaagaatctacaatttcagattcaagtaacgtttaagttgacggacgcaaaaaaggatgaggcctaaagcaaggcttcaccctttttgctgtttacaaatcgcgttttctaaaggataagaaggctaagaccaaacaaacgataatggttccgaatcctgctaaaagtaactggctcatttgaccagatgtgtagtgggcaaagtaagcagaatcaacgttattttgaaaactgaaatatttcaaccaatgctgcttggtaaaaatctgtaccagaactgtgatgatcaaagggaaaaggatggttgtcactaccgcagtaatcgttgaaaagaagaggtacatgactaacgttgagatggcaaaaatggcgctcagttctaataattgaatgcttgaagtttgaagtaatttaactaagaaatgaccggtaattttgccgaaaccattcttaaaaccgccggctagaaagataaacaggtaatagaaaatcacctgacaagccgagatcagcaggaagataacgtacttggaaataaagtagttaagccgcgtcatgccactgctgagcggatttttatagacctgtctcgagaattcgaaaccaattgtcatgataaataagggcaaaataaagtaaatcagtgcactcgtttcgctagacatcgctttaacacattggacgcctgtccagacaactctttgattagctgcctgaaaattggaaagggcatcagaaccaccgccgataataccaattgttgaggtaaggatgctaatggtcgcaacgatgatcatcagaatttgggtgatataaaatcccttagaatgaaataaacgatacatatcagcccttgccatattaagcatttggggtcgtcacctcgttttcagcgacaattgttttgaagtagttttcaaggttaatgtgctcacggacgatagtggtgacactgactgaggcagccacgagcatttccaccaacgctgcgttatccagcgataagtcatagatattcagggtgtgctgatcgatgactttgaaatcttcgattcccatcttattaagcactgtagccgccagtttaggctgatcaacttgcagtttgatgtattcgcgacttttagcatcgaactcctctttagtgagttctttaataatcgttccgtgatcaataattccaaagcgggtcgccatttggtaaagttcttctagaatatgactggaaataagaatcgtcatgccctgagtctgattgagtttcaccagtaaattacggaaatcagcaatggcaatgggatccagaccgttgataggctcgtccagaatcaagaaatctggtttgttgagtagggcaattgctaaacccaatttttgcttcatgcctagcgaaaaatccttaaacttctttttcccagtatcagtaagccccacgaacttcagcgcgtcatcgatagcatctttatcgacgatgcctttaattttgcagtagtacgtgagattctgctgagccgttaactgatcgttagccactggcgtttcaataacactacctgttcgtttcaattgtttcgtataatctttaccgtatgttgcgccaaatagcgtaatagtcccttgatcagcatacagtaattgaacaatggtctttaaaattgtcgttttcccagcaccgtttcgaccaatcagaccgtaaatctcacccggttgaatagttaaattaacttgatttagagcatgttgtttaccaaagcttttgttgatattctccatttgtaagattgctgccatcataatcatctcctgacactcttagagtaatggcctagtgttaacagattattaattgaaatcttaaatgtttattaactggctaggtttagtaaatgagacatatgtatggaatggcctgctcgattgaaatttctctcgaatgtgtactagcgttatactcagattaccacataatatctgagaaattaattttcgctgattgtattgtacaaattctggaaactatccttgtgactacacctttgctagtaatacttgcgtgacggcagcaaggcattcttgctagtattaacttagaaccttgactatgatttaggaggagtgagattttgagttttaaagatgatgtgaagcaattacggatgcaagctaatctgacccaagaagaattagccaatcaattacacgtgacacggcaaacagtctcaacttgggagaccgggaaaaacatgcccagtttggaaaccttacatacgttaagtcagctgtttgatatctcacttgaaaaactattgtttaacgaggagattactatggataaagttaagaaccagcctttggctaaccagatcgatcatgatgtgaaattaaagaaacgttaccggaattggacttacactttaagtggattaatattaatctgcatcgttagtatcgggattttaatgtttggctattataaaggtgtttccaatatcgaccgtgttaatccatttttgtcatacaagattggctatacaaaattaccggataataaaaggtagcaggttattggacggcatggtttactgataatactatggggaatgagtggacaaagttaaccttaactaccggcgtgaatcctggcctcaaaaatccttatgtaatggcttatcataaagggagctatgtaaaagaagcacggatagttcctcgtgcgtacgttaatcgtgtgtatatcagtaatctgaaggcgttgagttcactgttaaatcacaaagataatactgcaactaataatcatgaccagaaaaaattcaagacgcaggtccatctatctgacacaattcagcaaagaatagatgaataatggcaagctcaactacttgtcacgatcatcagacatattatattaagaagtgcacacctgaacattaggaccacagcaattacgactgctacggtcccttttcaaacagctatttaacttttgatgagttctaagttcatttcttcaaaaagtcctgtgcccaccatccagatatggggctaaacccaaagtatgataactatgaacaatatagaaagataattaatggatagagttcgttcaaaaatcaactcattacaaattagtaaaactaaccagaccagattcatgtataccgtaaacattccaaccaatgaaactggcagatttttgtaatatttgtggcaattaacatattcatcccaattatgatattattaattgttacacttatctaaaattaccgctaagaaggtcatacatatggttctaacaattctctttttaatcggcgctggttttcttgctgggatactggcttccaccgctggactagcctcgttagtgtcttatcctgcgttattggccgttggactaccgccggtcattgctaatgtcaccaacaccacatcactgatttttactggcatcggctccacagtgtcctccctgagagaactgcgcggacactggcgccaattaacgttatatgtctcactggctttagtcggtgggattattggcagtctcgctttaattcttgcgccggaatcttcatttgaaaaaatcgtgccgtttttgatctttttggcaggggctttattgatttcttcgggccggcgaaccggtgataccgctcaaaaaattaaagctgctaaaatgcaccccaaaaagcatgccattattcaggtggccagttactttggcattttgtttgttggcgcctatggaggctattttggtgctggtgctggtattttgatactgtctttgttatcgatcatcaccgatgacgactttttggtggtcaacgcgatgaaaaatgtcatcgggtttgccagtaatttgattgccaccatcgtctttatcttccgcactcgcattgcttggcatttcgtgattcccatgggcattgggttatttatcggcggctatgtggggccaatcatcgtccgccacatcaatatcaccatactgcgtgccttgattgcgttggccgcatttggcttaggtatcacgttatttatcaaagcttatttttaattgcagggaatggtaataccagggccatccgctttggtaggctggaaaaatcggtcagctttcagactgccaaccgggtaatagtcttcggtacgttccggataatcatgatgataaatcaatgtaaattcaccgtaatcaaatgaaatcgataaaaaggagactgcgatttatatcgcagcctctttttatcaccatcgtgacgttattattcgtttcgcagctacactaccgcgaaaaagtgtaaacaaatgaccagtaagggtgttgtatttgattaatgactaacgggtagggcgctaaccgatacgataacgtcttggtcaacagaattgattgtgtccgtgattgattattggttaattcaatttggtatttacccatgggcaactttcgttttaacttaaatgctttcttagtccgtacaagcgtataccgatgatggatttgttcattaactaaaataccgcggaattttacaccaggggctaaagacaccttgaatttccgcgaaggatgattcagcttaacttgctgtgttaaggtactgccaggctgaattcgagtttctttagcatcgaattggagcgataactgactttcttgaccggcaacatgatcgcccttagtcgcaagatggccgtggggggcaatcgcgaaaatggctagtgccagcaccaagatagtagcggtcgccaccccctcagttttagttctgcgggttgtccgtcgttcatccggcaaggccaaacttggaattgaacaaagaatccccagtaatggaatcatcacttgtccatagcgactttcggtttcccacagcagggtatgaaacgcaatgtaacccagtgctgtcaagattgtcagcatgagttgcggatcatcgtttctaacggcgtaacgtttccgccacagacgtacacaacgtaatagggtttcactgtaaagtagaataaaaccaactcgcatgacgaccatccctaaagcggctaacgggatttcaactttctgataggcctttggtggggcgacaaaaccacccgtataagctttttgaatggtggaaacatctaacagaatacctgctttttcaatccagcgttccccgatacgaacgggccctaacttacttaaacgtttagggagcgctttattaaggtacttttgttttgcttgtttccctggaatcgcactcagtttcttcacgtctcggaattcgtacccaccttttccatgaggatcgtaactcatccaaacccaatgagtggctgggaaagcataatcattattgactttgtaatggctaacagtttttagacctgctgacgttggtattgctagaataaagcctaaaacaattagaataaatggcattttaaccgcatttaattgtgcacgatctttgaagaatagccagatagccaccaataataccgccactagcaacacaatcaagttcggtttgaccacttcagcaagaatcacggagagaaccaaaccaataccggttaaaattttcttcggccgtttaaatgactgccagccaattaaaacgttgaacacaatagccaaactcaccattgatggcagatcagagtagaacacctgaaggtaataggtgtaggcaaacggactgatgaggaagaagagtgcggccaataataccacgtcgttttgatgacttaatctgcgaaccgaccgcagcatggcaaagatgaaagcatcaagcaagatcattgataataaatgaatgccccaataggtactcaaatggattaaactcgttaatttgagccaaaatgccatcaaaacggtcagcgaaacgttattgggaaagcgcagaaaatataacgaaccatgccagctcagattaccatgggcaagttgctctgcttgaacaagtacccgaaatggatcatggtaaaccgaaacgggtaaaaaatggatgactaatacctgaatgatgatgattgcgaccatcgtcgcgtaaatgatacgtgtcatatttttttccgaaagttttttaacccactttaagaaaagcggcttgaggtaccaaactaccacacagccaataatgactagtgcagcggacttcaagctcaggggtttaatcaggtttgcaatgatgccaattaccattgcaaaagctaatatcaaagccaaaattgacgtaatacttatccttttaaattgcatcagaaactcctacataaaattgttgggataaagccaaaccaagttgacgatttatcattgttctatggttttgagctggtggcttctagtaattcttaacctcctctattaattgattatgtacaccactaatcactcgcatacggagccatcgaaaaccgggtagtatcatgacttcatgatgaattaagcgtaaatgatatgaactttgtcaactaccaataaaaactcaataaaaactgagctttttttagtttgatcgattaaaccttgctaaattaggcttgttttctgaagaaaattcataattgataaaaagacagccaaaacttctcaaaatttcttgagtcgtttcggctatatgcgaggctagtcaatctctggataacttggctttaaagcgatgtcaactcattttgacaccattaaatgaccaatgacagccaaatttggctgaaataatatcggttatgcgctacattaataatattgaacgggaggtggtaacgacggacattcataatcaaatcaaacttaaccgagaacgattagggctaacacaggatgaacttgcttcaaagctgtatgtgtcgcgacaaacgatttctaactgggaaacggcacacagttatccggatttagaaaatctactgcggttaagtgttttgtttgatgtttctctggatgatttactgaaaggagacgtggcggtgatgaaacatgaactaagctacgcacgaaccaacaaatgggcctggctaatgactgtcatgctgggattaagcgcactgtcaattggaccatccgttaaattttgaggctggtggggtttggtgttacctgttttactgataaatatttcgctgtatgctggaattaaaatagagcgctggaagggacagcatcaactgaaaacctatagtgagattgttgccttcgagaagaataaagttatcgatgagaatgaacgtcaccgtaacgaattgaaagatcaagttgttttggttgtcaccatgctgctgtttatgataggggctggtgggtttgctctgcttggattttggttagttaagtaaatatcagcctaaaaataaaaaaaccaactttccttttaggggaagctggttttttcaagactaattgctcttaagaaacacgattaaattgacctgctaatcattgattgattacctgagaattgcttaataaagttagtgtgtaagctcagccaccagatagttcaatccattaatagaaagtattcaaaatagggttaataaaagccagatttccttgtctcttgtctaaggaaatctggcttttctatctttcattttcattgagaaaaattatttatactattttacttatctgaccatcgaaatttttttacttattttactccttatccttatcatcatgcaaccgattcaacgctttccgctgctgggtatcaataatatgcgtgtacaacccagtggccgaagtcgaactttgacctaactgtgtagcaactagatgttcattcttggtttctaaatacagcttagaagccaaagtatgacgcagtttatgtggcgtgattcgcacgtgattaaaggcagtggagtattttgccactaataattccaccgttgccggcttgattcggcgaggttcatccgtacccatagtgagaaacagcgccggcgtattagtagtggcatgataacggggacgacggatgctaatgtaacgggctaaataaggcagtacccactttgcaattggcaccgaatcccacttaccacctttacgccgaacggtcacattggcggctttgagactaaggtggcccacatccatgttggtcagttcagagacccgaataccggtacctaacattagtgcattaatagcaacgtctcgttcacgatcacgctggtagtagcgtaagtgattctgatccagccgctcaccgtattcatcttgaataaagtttaagtaggctttatcctgatcacccaacatcagctgatctttaatatgactggctcgagtcgcataggtttcgctatcttgaaccagtgagatttttttcatcacattgcggtagaagtaaggttcaccttcactattttcagattcagctgttaaaaaccgaaacaaggcggacagggcatttagagaacgattaacggtgcggtgcgacaacgcgccttgcggatgctgtgcggtttgcttaccacgattgagcaaataggatttatacaactccatatcttgtttcttcaaatgttcaagatcttgcagactgatttgtttaatcgagttggcagaggacactcccgtttcaatcagccattcaaaaaaacgtttaaattcgttcagatactgatataaagtcgctggcgacaatggcacggaagacttcgctaaatagtaatcaccaacgtagtcaggaagttcattcaccaactgttcattatgtgcaacataggctgaatggtccactagaatacccccttttaggattaggaacaggtgttctaattataccatgaatcaccgggctcgtgagaaggtataaacgaatgaccagtaaggatactgagattgatcgatttttagtgggtacggtgccaaacgatacgataacgtcttggtaatcagcacggactgtgagcgctgcaaatcatttctaagctgaatccgatatttgccaactggcagcgtccgcttcaacatcagtgatttaaatgtccggtaaagttcatagtgctgatgggtttgctcgttaatcaaagtaccgctgaattcagctgccggtgccaaagaaatctcaaaacgcttagctttatgatttaattgaacttgctgactcagcgtaccatacggtttgatcttggtcttcttggcatcaaattgcagtgataactgactttgctgtacagccacatcgtgccccttggtagtggatagcgcatgaggagctgaagcataggtcactactagggcgacgaccgctacgagggcaacccagccttcatttttagtgcgcaatctaatccgtcgctcggaaacgagtgccaaacttggtacggcacaaaggatcccaagcaacggaatcatgacctgtccatagcggctttccgtttcccataatagggtgtgaaaagcaatataacctaaagcagttagaatagttaacataattcgtggatcatccgttgactttaaccgtctccgccataatcgcaaacaacgcagcaaggtttcggcgtaaagtaagacaaagccgattcgcatgatcaccatacccacggcagatagttgtaactcaaatcgttgatagagtttcggtgcagcaacgtagccgccagtgtaggctttaggcatgagtgaaacatttaataggatgctggctttttcaatccagcgcgtcatgatgcccactggacctaattttgctagccgttccggtaatgccttatttaaataatcctgcttagcctgtttaccctgaatcgagctgagtgtttcaacgtctttaatatcatatcgaccagcgttgttcggattataactcatccagacccagtgcatggctggaaaggcatattcattattagcgtgataatgactagcagccttcaacccagcagacgttggtacggctagaatgaaccccaagatgataatcagcaacggtgtttggatggctttcaactgctgacgatttttaaacagtagccaaatcgtgactaacaaaactgccaccagcaaaacgatcagattaggtttgaccacttcaccaataatcaccgaaatgagtaagccggctcccgtgagtccctttttggttcggttaaaagaagaccagccaatcaaaacgttaaacaccacagccagacaaacgagggtaggcaaatcggaataaaagacttgtaagtaatacgtataggcaaacggactgaccaagaagaacagggcagctaacaaagcagcgctgttttggtgactcaaacgacgaactgaacgtaaaatagcaataataaaagtatcaagcaaaataaaggataataaatggataccccaatacgtatccagatgtagcaagttcgttagtttaagccatccgctcatgagtaccgtcagcgaaacgttatttggaaaccgctggaagtaaagtgaatcattccagtttaaatgaccgtggctgagctgttcagcctgcacaagaacccgaaatggatcatgataaacagaagccggtaagaaacgaagtaccagtagctgaactaccatcatcaaaatgataatcacagctaatatccaattaaccgttcgttgtgaaagctgactcgtccattttaaatagagcggctttaaataccagatagccaaacacccaattaaaaccaaacaagtggccttaagattaagtggcacaaaaatgttggaaatgatgccaatcagcattgcgcaagctaatattaaggctaaaactgaagtaatactaatttttctgattcgcatgagaaactcctagttaatttaataatttgattattcccgttgctttgataacacgtggctaaatgacaggcgtaaaacactccaccagcccaatgacaagcataatcccgctaacacgtcactgggatagtgaacaaataaataaatgcgatcaaagcccatcattgctagccagaaaagaccgaccaatccaagtaagaaacgaacggatgctgagtgacatagcggtatcacgatcaaaaggatgaccaataccatcgtcgcagttgaagtggtatgtccactagggaaactatagcccgcttgagccactagttttcctagtggccgtggtcgctgcatgatcattttaaaaatagccattagtgcgttaatgccaacttgagcggtcaatacccagcctgcctcaaagcgatgatgacgcaaccagagaattagggagatcagcagacaaatgattgtgttggcggatggggtgcctaggagcgcaaaccatttgaaaaaaatggtcctactaggttgcctaacgccaattgacaattgctgtccccaagcgtcaacatcaccgatccaactggcgtgaaaatgaacccccattgctaatattagaaaacttaaccaagtcagcatagcaactccccaccaaaaacggtttgcttgctgtcgtatacgcataatatcaagtccagtctgtaaaataatggtgcatagtcctgctttagctataatcttatatagcgctcagtttttcaatcaataagaattgtgaaaattaccatcgattagatttttaacagcaactacacttaaatgtaatttggaaacattataaatgacacgcgaacaatttaatagtagactaaaacagtcaaaaaaggctgctttgaagataaaaattaaaaaaattttaggatgataacaggtaattttcacaacaaatcggttataatacgaatattagtagaatagattgttcatagtgttcccattctataacagtctattcgttaatcagcataagagacattaaatttcccgtagaatccgaaagggtggagagaatattgatcatagatggtaaagcactatccaatcagttagatatcagcatgaaagcggaggtcaaagcactccgcgaagaaggtattgaacctaaactggttgtgattattgttggtaacgatcctgccagtcaaatatacgtccgcaacaaacaccgtaaagctatcaaattgggtattacttcaatcattgaacgtcggcccgcagactttacccaagctgaattactggcattaattgaccagtacaaccgagacgatactgttcacggtattttagttcaactgccattaccgaaacaaattgacgaatctgtgattattcgcgctattgcacttgaaaaagatgttgatggtttcagtcccgaaaatgtcggcaaacttttcagcaatagtcacgaacattacccggtttcctgcacacccaagggtattatgacgatgcttgcacattacaagattgatccagcaggccagcatgccgtgattgttggtgactctaacattgttggtcggccaatgggtgcattactgctgaatgctggtgcaacggtaacgtatacccacattttaacgcaggacctatcgtcatttacccgtacagccgatattttgattgtggcaaccggagtcgctcatttaatcaaagcagacgatattaaacctggtgctactgtaatcgatgtcgggatggatcgggacgaaaacggtaaattagtgggcgatgtcgactatgatcaagctaaagaagttgctggcgccatcacacctgttccaggtggggttggtcctatgacgattacgtcgctcatgcagcagactcttgaactcaccaaagtcgctaatcatcgagcattagaacctgttaagtaaaaactatataacatatagcgtccagttttcattgtctaaaacaaatttcccctgttttctaatccacttttgcggtaatgtaaaagtattataaaattgggggacaatgtatgaactggacgctattttatttggttgtttttgttatattcagtttaaacaccgctgcagcagtgtttacggtgttccgagaacgtcgtgatattgctgcaacgtgggcgtggttgctagttttgaacttgttgccgatcattgggtttttaatttatgctttgcttgggcgaaaattaacccatcgacagttaaataaggtgcaacgtcaacccgacgctgaattaacagacgccttgtcacagcaacaggcctcgttaccaccatattcttcaggtgatacccaccaggaatcatccgttaagaacatgattcgcttattccaaaacgttgataacgcctttgtgacgttaaataatcaaactgagatttttacagacggtacaacgttatttaataatatgcaacaagagattctgaatgcccaacacgtggtttacgttgaattttatacgttttacaacgaccagcttggacagcaaatgctcagtgctttaaccgccaaagctcaagaaggggttacagttcgcgtactgtatgattcttggggttcaatggggactaaacgcgatttctttgaaccattgcgtgacgctggtggctttgccgaaccattcttgggcatccactcaaactggcgcgatttccgtctaaacttccgggatcaccgtaaaattgttgccattgatggctggactggctatatcggcggtttcaatatcggtgatcagtacgtgggacgttcaaagaaattcggccattggcgcgatacccacatgaaggtaacgggggatgcagctttagctctccaagaacactttatttctgactggaatgccacggttcctgaaaatgaactggaacgtaccatgcagcattttcccaaaaccagtgatgaaattggtaaaacaatgatgcaaattgttaccagtggacccgattccgatattgaacaaattaaactagggtatttgcgtatgatcaacagtgctagaaaaaggctctatattcaaacaccttacttgattccagatgacagtgttttaaacgcgttacggagtgccaccttatctggcgtcgatgtccgaatcatggttcctcatatgccagatcacccctttgtttaccgggcgactcaatactatgcgcggttactagcggaagatggcgcgaaaatctatttctaccagaatgggtttatccattctaaagttgtcatgattgatgacgccatctcgtctgtgggttccgctaatatggattttcggagttttaaactgaatttcgaggcaaacgcctttgtttacgattttaaagtttcccgtgaacttcgagatatttttgagaatgatatcaaagaaagtcaattaattaccgccactgactttcaaaatatgtcactgtggctacgttttaaacaagctggttcacgcttacttgcgccaatattgtaattaaactaaagattcctcaacgtacgctagctgatttaatcaatcagccaacgtatgttgaggaatctttttaatgactatttagttgcggcacctttataaatacctaagcgctttgattcacgttccagatattgatgcatggtccgtggcttgtgatccaataatgcttccaatgtaaatgaagaactgtcccagccccatttacgcatggtccggactaaacgaataaaggcttcgtatgaataactgtcgccaccgtggaagtactgtgggaagtagtcggcaaggtgatcttcgtcgacatattcagcagtaatctttttgccagtgacttcagtcatcatatcagcgacttcataactgtttagcttttcgttgcacagttggtaaacacccttgtcgaagtattcaggacgatcaagaaccttcaagataacgtcggcttcatcgagagcatcgaaccatgacattcgcttatcaagcggggtgtagttagggaacttacccaacttgtagaattgttctaggaagacatcgtggttatacccagatggttgtagaacagtccataacatgtggctttcgaacccacggtatagcaagtaatgttcaactttttgtttcatcatatggtgcaacttagtatccaagttagggaagagcactgaaatatcgataaattgtttaacgccttccttgatggcagcgtcaatcgcaattttacccatcacatattcttggaatgagaagagggtagggatatagacaacttggtcaacacccttcatggccttttcaacttgatcagctttagtagcatcaatgaccattgtttctttaacaccttgtgccttatagtcagctactttaggattaatatccacggcacgaatatcaacaccatgttgtgccaaatagggaacgatttggcgaccaacagatccacatgcacttgtaattagtaacataataacttcctcctagactgaattagttttcgagattcttcagaacttttttcatgaagttaattcccgatttcaactcagaatcgcttaacccggttctgatatccgtttctaattggtcagctgaatcaaggagaacatcttgtttagccaaggctttcgctgttagtgcaatttgcttactgcgagcatcatcgggattcggaatccgcttaacaaatccctttgtttccaactgatgtaaaagtcgtgtaacagtggggctggaaagcttgaattgcttttccaaatcaacttgtctaacagctcgatcttgattaaccattaggcaagacaaaagattaaactgcggttgagtaagctgaaattgagcgagtaggacattgctcttcttatcaaactcaattgcagcctctttgagatagattccaatccggttccgttgattcagcaagtcattaccccccaaaagcagattgttaatgaaatagttagctagctaggattcattacttatatcttagcatgctaggaatattttgcaaccgctttctttagtaggaccagatcatgcttgagtactatggaaaaatgacgatagagaaggctaaattagtaaacttaataaaatataggttttattaagtttactcaaaaaacgcaatttaatcttcccctcgcggaaataacgttctgaggggagttaataccaaagaatatagctaaacaaaggccattaaacccaaaaatacagtaaaatatggcgaaaaagctgatttgaaagtggttcaaacagctaaaaacctgaatttacgatgttttaagcataataataagccaaactgtgaatttaaaacgccaaaaagtgactagattgctgtaaaagcagctgtttgtcgacgcaaacagcgttcatatagcatttgagagcaaactcatacaacaattgcactaataattagcacaatttacatcaggatcgttaaactgtatatcttgaattgaaaattgagctaacagccaatatattcgatgtcttggtggtcttggtcttgctagatggacactacgatgactaaactagtacctgattgtttcaatctaaagataaacgatacaaaacaatgcaatttctaaaatccgttgtaatttaacaactatctacaaaaacaagaaactggtctcagtagcaacaataagttaacgctcaaactatgtagatgattgtaggtgattgttcggcgttcatacgacacacgttcgttcattctggtgtgtagttgtccgaatgatgttctcagttgcgccaatttaattcaactagtcagccggtttgattgttatcgtaatttgatagtcgataacttaaataaacgcaatcaataaaacaggggagtatttttaacgttaattacaggtctacttctgatttctttctctactttacataatatatattattcaaagtagttaatcaaagaaatcaagccatcatttttataatcacagatttctatccaaatcactttcctgaacaattccattcttttttaattccaaaataaaaaagcactgcatttgctagtgctcttttgaatctgcagaatttgttttctcaaatcgattattaaaccagattgccatgattcctgtcacagttccaacaatgcaaatcactaatagcaacaccacaacaaaccctgaatactttctcgttgcattgataatcattgctaccaatattgcaacagctaaaatgttaacaaatgtcagaacgattttttcagtcccgttatgttttgctaaatacagcgaaatggcatatacaccgatataacttaaaacgctcaccaaaacctgatacgataaattatgcttactcattgcagaaattaccgtgattaagcacagacaaattgcggtgatccatgatgtcatagcatattttttatacaaagcgaacaactccctaaagtacgtatatatactattatcggtgatttctagggatttgcaaccgatttgctagaagttattactcaaacaacgttttatattgcccataaccagcctgttcaagctgattcgccgcaataaactttaaagctgcgctgttaatgcagtatcttaatccaccggcatcctgaggaccgtcagtgaaaacatgacccaaatgtgattttgcttcagttgaacgtacttctgtccgatacatgctatgtgatgtatctaaatgccgcttaacagattgcttttcgattggttttgtaaatgacggccagccacaaccggcatcgtatttatctagtgagctaaacagtggttcgccgctcacaacatcaacgtagatacctggttgatcgaactgatcatattttccactgaatggtgcctcagttgcggcattttgagtgacttcataggctgtttgggacaattgcttccgtaacttttgctcgtctttctccattttttaccaactccttgattaatcaattataaataataggttgtgcacaatttaaattgtaggctacttaaccatttttagcaatatttaggttctttaacaactatgtaaaaaccagcttatcagtatccattgttgtcttggtgaactgataaactggtttttgaatcaaatgacattaaaatcagtcatacagattgccccgcaaagttgattgctcataatgagtccgcaacaatcctcgttcctgaagaattgaaaccacgagttcaacaaaatcggtcatactttctggataagttggaaacattaagttgaagccatcagccacaccattctcaaaccaatcttgcatcatatcagcaacttcctcagcagagccaaccacagttgcgtgaccacctgcacaagccaaccgttgtaagagttcccgaacggttggctgttcggtttcgacgatccgtttgatgacttcaaaccgtcctttaggtccttgaaaatcggcaacctcaggtaatgatggcaccggaccatctaagggccaatccgctactggtaagttcaagaaatcgcttagttgtgccaccgaatccgcaatcggcaaagcatcgtctagctttttctgcttagcggcggcttcctcataggttctgcctacatatggtaccaatccaggtaaaatgatgggtacatctcccgttcggtgatagttttgagctcgctgcttcacgtcatcgtagtacacctgggattcagcctgatcccaggcaaccgagtaaatagcttccgcatacttagcgcccaaattctttccctgctcagattgaccggcttgaaaaattacgggcctgcctgttgccgaagttggaatgtttaacgggccacgaacgtcatagaattcaccatgatggttgattgggtgaatttggtcagtgtctaaccagcgatcatgttcggcatcgttaataatagcggttgctggaaatgatgcccataattcatttaacgtttggataaattcatcagcttgtcgatagcgatcagcgtgattgggcagtgccttaagcccgtgattctgtgcttcttcatcaaacattgaggtcacaatattaacccctgcccgaccatgactaatgtggttaagactactgatcagcctagcagcgttgtatggatcatacaaagtagaagaaattgtgggaactagcccaacgtgttccgtggcagttgcaatggctgtcatacacgtaattggttctagatagtaagaaaccccaccgtagtaaccacccataatggcttggccatcagcaaagaaaatcgcatcgaaacaacccttctcagctaattgacctaaacgctgccagtaacgataatcacccacttgtgtgatggttgaatttggtcgacgccaggcagcgccgtggtgcccggaactaaacagaacagttgctaaatgcatcattttattcattagatatgacgtcctttcctaattactcagtgatattaggcttactaaccgcatgctgcattgcatcaaatcgtaaagtaatcaacttaaccatcacaccatcaaataatagaccggaaataatattcacaacgaaaactaaaacaagcaatcctggtttaaactgctgataaccgtaaacaaagtaattgtaaataaacgctgcaatactggcaccaaaggctccccaaagacaactggaccaactaaaccgctgatacttactctgattcgggaaaaagccaagttcgtttccgcctccttgaatgataccgtacaacagggtcatagcaccccactggccaccaagaaacatttcaaccactgccgctaaagtttccccaataacccccgctccgatttttggaacaaaatacatggctaatggtgccgcgatgaaccaaaggccggcgaaggcactatcaactaccgggccaagcccagtcggcgtaacagctactttaaccaaattgtagaaaaaatttatcacataggtatagataatgccacagaaaataccaatcaaagtcactaaaataatggctctaatgtcccaacaagtcgcctttttcattagagttcacctgcctgcccatcgaatgccgattctgtccaactcgcccaggatatttgtttagttgcagcatcccaaaaataccattccaataagcagcttctaagaaaagcttgttttgcagcagctaattgcgactctgttgcgcgagctgcttctcggtcaatgatagccataaacttgtccgaaatgccgtctttgccggcaaattccccgtgctgcaattcgtcaacccacggataaaatgggttatcccgatgtacttgatcactttgactaaggaacttacctagttcaacatatagccaaataccggcttcaaacggtgtcaaaattgccagcagattagcggatgatagcggtgcaagaatgtgttgccgatacaaaaaagtaattggctgaactgcggcatcatactgttgtgaccattcattatgattgttgtgtgataactgctggaacaaggcgctcacagattttaaatgccgactaagctgatcggcaaataatcgttgatcgtccaccgtcttgctgttagcaatcaaagctgtttgaacaatcgtttcagcgttagcatactgcagatcttgttgaatatagtatgccagtgcttttgcatccacttggttgcggagaacagactggataaacggatgttgctcattagcaatcaaatacggctgactggctttaattaattcttgtgaaaatgacatatcaaacaccccttttgtttggggtccggggtggtcaaattagctgagtttacgaagaggctgtgacttaagtcgtaaatcatagctttcaaaaaaggtttatcgaagaaatcaaaatttgatttctcgataaacctttttttctgaataaaatcgggattttatcccctgattttaaccatttttggccatattaaggccaatgaacgataccggtttccttagtaaccttcgctaaacctcggaccataaactttgaaccctaaataagccttcatctaccgaagactggttctaatctattttacgccgggcatccattgtgccgtcgttccggttaccggtcccgctgctgagctttaaaatattcccaacggggattgatactgatatatcgggtttgccagaccgcgtcagggctgctggataacctggtgatcctcgtcgaatttttctgcccgatagatttgaaatcacgcgtgatacccatcttgtcagtgcgcttagaataacgctggaagttaaatctaacccccgttgatcatataatagtcgtcatcacgctgtttccgttcatgattttacgatcatcagactgccactgacggctttgttcttttaacatcgttccgtacgaatgatgcttgatgtgctcatagttatcttctattgtaggtatagctctgaaccataaccagcatcagccacaaattctcagccaacgtgttggtttttgctaagtactcagatggaataaacgttcttcgtatcggttggacgcctggaataaaccgaaacctaatacgaattgattattggtggcgatttgtaagttataggctgcttcaactgcccattcaacattggatcttctttgacgcgcatgaaggtgctatctatgtcggttttagagtagctattgcggtcaccaaagttttccaattgatgctgatgttcaatcattttgcctttgcgttgagtactgcgcttgatcttcttgatttttcgacgatcctgctagtctggattgggcgataatttgggagattgtttgatctccttatccagtttatcgagccgatcctcaagtcgagtaatcacctcatccatcatttccaggttaaattcgtccctcgggaacgaaagctgcaccgtaggcgtgcttatatagccaagatctttggattgcttcacgattcatctgatcaaagcgcacggtattcttacgccagacaaaactatacttattggcatcaccaaaatcttggtaccatcaataaaggtcacatcgtcaattaagtttttgacgacgcaagtagtcaaccaactggtctaacccatcatgatcaaagtttctaactcatcggaaatccggaagcgacaaattgtccgatacgtgggcatctgttcctgggtcagccacgagctgttaagttctccaccgcaaaggtttcgattcggcactactaaagaccccgcgagtggtaggcgaaaagaacccagttcacatggcacccaaatcatattctcgaggacgaccgaataggtagtgctccttaattgagagtgaccaaccagttcatatatagtaagcaggattatctttttgaacatatagtcggtagttagaggtaaaattgtttgatccatgttataatttgtcatgttggattgtcctttcgagatgattttttgagtatcgggtgtgaccggtactctttttttctgtcattatatcaaaaaagcaggtagttaaaaatccttggatttttaactacctgcttttgaattaagggacttatgtcacagcctcagtcaattaaagttaaattcgactaaaggtaaatggttctccctacggcagtactaactgcatcaggttccttgggtatgtctcagctgatcaaacagcaccccagaccacaaaacgatattttcggtacacttgaattaaacaagattagtttgctattgtcaagcaactgcatttttctgcttaaataatataaaagaagcagtccaataattcagactacttcttttgattaccattcaattaagcttcgaaagcttcttgcaatggtggtaccacttgcttcttacgtgatacaacacctggtaagtttgcacgatcattcttcaaagtcgtcttgaaggctttttcaaccatgtctttaggttcaccaacaacgaataattcggagttgctgtccaatacattagttgccaaaacgaggaacaaatcgtagcccttttcagcggcttcgtcgttcatcgccttcttgatgccatcttcacggctgatgacatcgtttaaatcaaccgtgttgatctggtcgatacgaatactcttgccacccatggtaaatgacttagcatcgcctgaaactaattcagcgtcagactttgcggctaaattagtccccgctttaagcatctcaataccataactctcgtaatcgatgtcagcaatttcagcaagtgctttaactgcttcacgatctttgtcagtggtggttggtgatttgagcaacaaggtgtcagaaatgatagctgatagcattaaccctgctaactgagctgggatatcaatcttgttttccgcaaacatgttggtgataatggtgctgacacagccaactggttctgcacggtagtacagtggtgcagcggtgttaaaaccattgatccggtgatggtcaaccacgtgggtaaccgtaacatcagcaatatcatcagctgattgttgtggttcgttatggtcaactaacataacggaatcgacttcgtttgaaacggtcttaacgacacgtggtgcagccacaccaaaatgcttcagcacaaaactagtttccatgttaggttcgccaagtgcaacggcttcaacatcatagcccaactttgtttgtaaatatgcgtatgccattgcagcaacgatggcatcggtatctggactcttgtgtccaaaaacgagttcttttgacataaatttatcgctcctcatatcaataatgattttacatactaatcatactattaattttgctgaatttcttgtaaacgtgccaaataatctttagttttcagatattgatcaaattgcgcgaggaaatgtccaatgcgtggaatcttatctttcccgcttctgaagacgaaggccagttcaaagcgaatgtttggttcaaaacgcgcagtccaagtatcaggctgttcaccttgtccaaccacaaatgagttaggtaatgcggtatatgcgccagtcgcatcagagaaccgaagtagctggcttggtgtggtaaactgcgccacactggttggtaagtcaaccattgcgttcttaaaggattcgcgcatgacgtgattcaagtaatactcaactggataagtgacccatggtttgttaggcgtatcagcaaacttgatccgtttcttcttgctgagcttttcatcatggtgaataaagagtaagtcatcgctaatgatacgtttagattcgtatggcttccaattcttaattgattcatctggtaagtacatgattgccaagtcaatttggttgttttcaagcttatcccaaatttccttacgggtcagcatatgcaatgtgatcttcacatccggattttcccggtaagattgaattacaaagtcttcaaaaacgctgtcttcaactgatgatagcatcccaatattaatgtcaccttgagtggcactagttgattgctgaatctcatcagtagcactgtttagcacatcataaatccggtgtgtggcatccagcatggtataaccagcatcggttagacgcaacttcttaccaacggaatagaataaacgagcaccaactgtacgttccaattttttaatttgctgagttaacgcaggctgggtaatacccaaaatttgagcggcttgcgtataattcatcgtttcagacaattgaagaaaataagtcaatgtcttagatgaaaaaatactttcttgcttacttttcatgtgggaacctcctatttgggttgtccttaatgttttattatcaaaactataataaccatcttcggacaaatacgcaattattgtaatccgaaaataactaatttctaataaaaattaagacaaagttaaaatagttggtttactccgcaacacttctggaattccttccgattctgtgtcaatgacaaatgaaccgttcgaataacgattattcattgggtgctctgctggcaaaatatcgtgcaaccgtcgccgatccgtgattacttcaagcggtgacgaggcatcatctaatttaataaagtcaaccacttcatgcggctgtgactttagggcatgcagaactaatacgcctttccgcgctcgactcgtcactggcagttcactagccgacattttcttaaaggcaccacgctgcgtaattaaagcaacggtgtcatcatcgttaaccagttgcaaatcaaccactgaatccccttcgccaaggttcatcgagcgaacgccggtggtccgggcaccgttaatcgaaacttcggctaggtcaaagcgcagcgctaaacctaatcgagacatcagcaacactgatgctttggcaggctgtggcaaataagtaacgttaacgactttggcctgatccgatttcaacttttcaaacaccttggcactggacttataggtacgtcctggcaacaggttgtcaaaggctgtccgcttaatgtatccgtcgtccgtagcaatcaagaactcaccaggtgctttgagagaattaaacgcgtaggtggcgataatctcttcgtcatcggcaagaccgatagtttgggaaatgtgctcaccagtatccttccaacgggcatcagtaatttcatgaactggccggtagatcaaattacccttattggtgaacatgaacaagtgatccagtgtactgagtttttcagtgaagatcgggtaatcctcttctttaagcccgttgtcttccggatcagaagcgttataagagcgaacgccactgcgtttcagataaccgtcacggctgaccatgacaaccacgtcttcgtcaggaaccataacctctgtggaaatcttcaacggtgtaatttccgcttggatttcagttcgtcggtcgttgcggtactgcttattgatctcccgcaattcttttcgtaacaccttgtttaaagcttttggatcggccaagatttcttgataagttgcaatgcttttggccaattcagctgcttctttttctaacgccgtaacgtcggtattggtcaaacgatagagttgcagcgccacgatcgcgtctgcttgttcttcagaaaagtcgtaagtggcgaccaggttgtcccgggcatccttacgatttttacttgcccgaatggtggcaatgacttggtccagaatagacagtgctttaatcaagccttcaacgatgtgctgacgcttggctgctttgtccaaatcaaacttagtccggcgagtaataacgtcttgttggtgttccaaatatgccgccaaaatcgtctttagaccaacatgttctggtcgtttatggttgatcgccaccatgttgaaattataggtgacttgcaagtcagtattcttaaataaatagttcaagataccctgcgcatcaacgtctcgttttaattcgatagcaattgacagcccatcacgatcagactcatcacgcacttcagaaataccatcaacttttttgtttaagcgtaattcgtcgattcgtttaaccagcgatgctttattgacttcgtaaggaatctcgctgatacgaatcaactgcttgttgccacgcaggtcttcgatagctgttctcgaacgaacaacaacacggccacggccggtttcataggcttttttaataccatcaacaccttgcaggataccacccgttgggaaatcaggacccttaacaaactgcattaaatgctctaagtcagtgttgggatgatccagcaaatacagcagcgcatcgataacttcgcctaaattgtgcggtggaatatccgttgcataacccgctgaaatcccagtggcaccgttcactaataagttagggaacttggctggtaaaacggtgggttcatattccgtatcatcgaagttcagcaccatatcgaccgtttctttatcgatgtctcgtagcatttctccggcaatcttactaagacgagcttcggtgtaccgcatagcagcaggcggatcaccatccatagaaccgttgttaccatgcatttcaatcaatggttcccggactttccaatcctgactcattcggtttaaggcttcgtagatggaactatcaccatgggggtgaaagttacccatgacattacccacggccttagcggattttctaaatggtttgtcgtatgtgttaccatccttattcatcgcaaataaaatacggcgttgaacgggtttcaaaccatcgcgaatatctggcagtgcccgttcttgaataattgattttgaatagcgaccaaatcgatcactcatgacttcttctaatgtgagctcttgaatcttagttcctgccactcaaaggactcctttcataccttatttggttgatgctggctcgttatgagcttcatttgctaaattactatcgagaatgctgccgtcttcttccatagtgaacgcaacgttttcttcgatccacttacgcctaggttcaactttatcgcccattagagtcgtgactcgacgttcagctaatgcgtcatcatcgatccggacccgaaccagcgtccggccttcaggattcatggttgtttcccagagctgttctgcatccatttcaccaagacctttgaaccgctgtagtttatagccctttaatcccttagtcttagtagccagttcttcatcagtccaagcatattcgtcaacttgtttcttaccgttacccttttgaatcatatacagtggtggtaaggcaatgtagacgcggccggcattgatcattggccgcatgtacttgtagaagaaggtcagcagtaaaatttgaatatgggcaccatcatcatcggcatcagtcataataatgattttatcgtagttggcgtcttcaatattaaattcagagccaacgccagcaccaatggtataaatcatggcattcagttcttcgtttttcatgacgtcttccagcttggctttttccgtgttcaaaactttaccacgtaagggtaagatcgcctgaaatttacggttacgcccctgcttagctgaaccaccggcagaatcaccttcgactaagaataactcatttttatccgcgtttttagattgtgccggtgttaatttacccgacaatagccgttccttacgtttgtgtttcttaccagaacgggattcatcccgagctttgcgggcggcttcacgggcagtccgagcacgcaacgacttgtgaaccagcatctgcgcaaattcaccgttttccatcaggtagtagccgagttgttcactgactacattatcaacgatggcccgggcttctggcgtccccagtttttctttggtttggccttcaaactgcaggatttcttctggtacccgaagcgagatcaccgcagaaagaccttcacgaacgtcagaaccgtccagattcttatctttttccttcaacaagcccactttacgggcatattcgttaaaagccttcgtccacgcactgcgcatcccagcttcatgagtcccaccatctggcgtacgaacgttgttgacaaacgacagcaggttttctgaatagccatcgttatactgagcggcaacttcgacttcaacaccttgcttgctgccatcaaagtacatgatgtcgccaagggtttccttatcttcgttcaagtaggcaacgaattccttgataccttcttcgtaatggaaaacttcttcgcgttcctgattctgccgtttatccgtcagcgtgattttaacgccctttagcaaaaaagcagattcccgaagccgttcagacagcgtattaaagttaaatacggtcgtagtgaaaatagaactgtctggtttgaaatgaatcttcgttccagttggtttacgggtattgcccttcttgatcaaggttgtgatggggtgaccaccatccttaaactgctgttcgtacattttgccgtcacgaacaatgttaacggtcaattctgaagacagtgcgtttaccacactagcccccacaccgtgcaggccaccagaggttttatagccgccttggccaaacttaccaccagcatgcagcaccgttaagatcacttcaggtgttggtttccctgaggcgtgcatcccgactggcataccacggccatgatcggtgacggtgatactgttatcagcttcaatgaccacgctgatctcatccccgtaaccggctaaagcttcatccaccgcgttatcgactatttcgtaaactaaatgatgcagtccacgagcatcagtagaaccaatgtacatccctgggcgttttcgaacggcctcaagtccttctagaacctgaatcgatgaatcatcataagttgctttttttctcggcaccaaaaagactcctttcaacttttaattacgattttgacttagaattcatgataacgataaaattattctgtaatacagtaggaaacatgctaaaatattagccgtgacacgtcatcatgacaatggaggaatgaaacttgaaactcgcacttttattattaattgcctacctcttaggcgcgattccaaacggtgtctggatcggcaagggattctttcacaccgatatcagacaagctggctctggcaacatcggtaccacgaatacataccgtgtattaggtccgattgctggcaccgccgttttaatcttagatttagcaaagggaacggtagcaaccttactgccagtatggttcctgcatatcagcctcagtcatcattcgcccgtgcttttgctcttcggcttcatggcgattctcggccacaccgtctccatttttgaccactttaagggtggcaaggccgttgccaccagcgcgggcatgttactcgcttacaatccactgctctttgtaatcgcgtcagtgtgttttgttagccttatctatttaaccagcatggttagccttgcgtcaatggttagttttacgattatcaccattttatgcttcgcgattcaggattggtacctatctgcgttggcagtttgtttgactatctttgtttattggcgtcaccggtcaaacatcaaacggatcatgaatggcacggaaaacatggtttcatttggtctaggaaacaagcgacgacaacgtcagcaacaaaataaggactgatgatcgttgcatcacagatactatcttataagtaaaaatagagatatgtcaaaaaattattttgacatatctctattttttgaatttgggcaagaaaacacgttcttttaaggacgtgatgaattgtctttttctgacattgtttgttggcaattgattgggaatatcgtataataggaacatacgtttgctaacgataaaatcaaaggatgttaacgcttatgacgctaaaggcgattaaaacccgcatttatccctcgactgaacaacaagagaagattattgccaactttggctactgccggtttgtttggaatcagttgcttgacatgcagaagcagcgatatgccaacgagggcagttacgtcaacgaatttggcatgaactatctcattaagtgtttgaaaaaagaatacccttttctcaaagcagcggaatcaacttcattgctgcatgtaagtcgtgatttgcaccacgcctatcaaaaactgttcaaagaacacaaaaggtttccgagattcaaatctcgtaaatctcccaaacagagttatcaatgcaacgcagttaatcacaatattcaggtgattgatcagcatcatcttaaactgcctaagttgggacgtttaagatttaaagctggacgacaaccagttggcaaaattaaaaacgtcacgattcggctctccgctactggtaagttctatgccattattttggttgagactgatattgagccattaagcaacactggtaaggccattggtattgatatgggcatcgctgatctcatgattacttcggatggtattaaatatcccactgtccgatttgataaacgactcagtaaaaggaaacgttactgggaaaaacggttggcgagacgtcgtcatcaggcccaagcagcaattgcttgggatcaccacaataaagtaattgagccacgggagctgacagacttcaaaaactattagaagcctaaacacatggtcgctaagtataacgaaaagattgctaatcaacgagataactatctgcataacatcactaaagaactggttgaacagtatgatgtgattaagattgaagatttgaaagccaaaaatctgctgaaaaatcataaacttgcccgagcaatcgccaaccagtcgtggcgaaaacttcgcataatgctggaatataaatgtgcctggtatggcaaacaactggtcactgttaatccgtacaaaacttcccagttctgttctgcctgtgggtatgatgatggcaagcataccctagatattcgccagtggacgtgtccaaactgtggtatcaaccacgacagagacatcaatgccgcaaccaatatattgcaagctactgcgtagtattaaaactgactggcacggaacgtgccttagtaaatagccgtaacctctgcacgtcattcaacgaatgaggtgtaagtcagcggtgttcctagaagctcgttactttagtgacgagtagttcacgacatagctccttttttgagtaaaattttagaaaaaacggatctgaaaaccggcgttaaatgattctttagggcctgcagtatggatgctcatcttatgaatgaaatcaccatcgctatcaacgttgtccgcaatcccccaccatggttccaagcaaacaaacggtgcccgcttaggataaggtgaccagatgccaacgtatggggcatcttgcagcgtcagtgccacaccatgatcgttaagtcccgtgctgagcatcaacgtggtctcaacgtgatctaagtccaagatcaaagcatcctgattaaataaatcgtgatccaataccattggcgtagttaagtttaacgttttttcgtgcttcacgtcgttataagggccaactaatggaatctgctgataagccttcttaggcgcaaccgttacggagtaatctgaaaaatctccattaccaggttctagtggtacattaaatgcaggatgaccaccgattgaaaatggcagtgtcacgtcaccactaggattggtcaccgtataatgaaccgataacatgtgtgcatcaagggtaaaagtgacctgtaacgtgaactcaaagggaaatttctcctgagtctcgtcgctagcttccaattgaaaaacagcgtgatcgtcttcgtgttcgataaccatgaaatccatgtcccgcgcaaaaccgtgctgagtcatacggtatgtctgaccgttcacggtgtactggtcatccttcagtcgaccaacgattggaaagagaaccggtgcgtggcgaccccagaatttaggatccgcttgccacatatattcaatctgatcatcgacgctcttaacgctggtcaattcagcgccatgttcgtttatcttaacctgtaactcgtcatttttaagttcaatcactgcttaaaccccatttctgatcagtcttcacgattagtatagaccattagctggttcctttcaataactgagctcagtttaactaatctagaggctaatgcaaagccatcagcttgcgaagtcttctgaacctgactacaatgaaattaacttgaaagctaatctttcacaagaggcgataaacatgtctaaagcagtttctaatttaccaaccaccatgcgagcttgggcagttactgaaccaggtcccgtcgatggcgagaaaagtccgttagaattcacgactaaaccagtacctactcctcaacgaggcgaagttttagtgcgagtgttaacttgtggcgtctgtcacacggatctccacgtgtctgagggcgatttacctgttcatcaagaacacgtcacccccggtcacgaaattgtcggagaagtggttgcaattggccctgacgcacagcggtttgaactgggtgaccgcatcggggtgccttggcttcggtggacctgtggcgtttgccaatactgccgttccggtagagaaaatctctgtcccaattcgttgtacaccggctgggatcacgatggtggctatgccgagtacaccacggtgcccgaaggatttgcctaccgtattccagaacggttcgattcgcaaaccgcttcacccctgctctgcgcgggaattattggttaccgggcttttcgccgggctaacgtgccggctggtggccgtcttggactatacggttttggcggttctgctcacatcacggctcaattggccattgaccaaggcattgaagtccacgttttaactcgtggtaaagatgcccggaagtttgctctatcattaggtgctaaatcggccgcaggagcttatgatctgccacctgtcaaactggattcttcaattatttttgccccagtcggtgacatcgtccccaaggcacttgaagggttggcacctggtggcaccttggctttagccggaattcacttaaccgatattccacagttaaactatcaagatcatatttttcacgaaaagaatttgactagtgttgaatccaatactcggtctgatggtgaagaattcttaaaactggcagaccggttagatattcacccagaaaccacaccatatgcttttgacaaagcggatgaagccttacgatacgttaagaaaggtgatattcgtggggcctgtgttttaaagattggtgaagattaacactctttgtacaataaaagcgtttagttgccgttgatagcaattaaacgctttttttatggacttaattgtcaaattacagaatataacgtgacaaatccttgttcttgacaatgttgccgatcttgtcattcacgtaactttcagtgatcgtaatatcacccatctgcatatctggcccttcataaagcaggtcttccagcagtttttcaagcaccgtgtgtaaccgtcgtgcaccaatgttttggttctcatggttcagctggtaagccagctcagcgattcggttgatggcttcaatggtaaaggtcaccttaatgttatccgtgccaattaaagcaatatactgcttaactaaagcgttattaggctccgtcaaaatcttaacaaagtcttcctggctcaattcatccagttcaacccggattgggaaccggccttgcagttcagcaatcaaatcactgggtttgctttcagcaaaggccccagcagcgatgaacagaatgtgatcagtattaatggcaccgtacttggtctgaacttgagtaccctcaacgattggtaagatatcacgttgaacaccttcacgggaaacttcgccactgtttttgtcagatttcgaagtgattttatcgatttcatcgatgaaaataatccccgtattttgggcccgttcaatggcagcgtggttgatatccgcgtcgttaaccaaggtttcggattcttcttgaatcagaatttcacgtgcttcagaaactggaacggttcgcttgatccgcttcttaggcatcatttggcctaaagtcgagcttaagtcgatacccatctgattcatcatcgggttattgccagccatggcttgttgtggatcatccatttcgatttcaacttcggagttttccaataaaccgtgagccagttgatcagaaaccgacatacgctgattcttgacctcgtcggtaacttcttcttttggctgctcagcagttggcatgtcacccttttgcatctgagaaaacatgttcatcaagtttgagaaatcggcttgttgattttgcttcggctttttaccgggaactaataacttcactaaccggttgttggcgcgtttagtagcttcagcacggacgttttcaaattcgttgtccttttccatcttaacggaaacgtcaaccagattacgcaccatggattcaacgtcgccaccaacataaccaacttcggtgaatttcgtggcttcaactttgacgaagggtgcctttacaattttagctaatcgacgtgccagttcggttttaccaaccccagtaggtccgatcattaacatgtttttaggtgtgatctcttcttgcatgtcttttgacagctgcatgcggcggtaacgattccgtaaagcaatcgcaatcgactttttagcagcgtcttggccaataatgtactgatcaaggagcgaaacaatttcgcgtggtgtttttgtaattggatccaaacaaatccctgctttctgttgggttataattcttcggaaatgatgttgtggttcgtaaagatatcgatgtcaccagcaatgctaatggcagtttcggcgatttctttagcactcatgtctttagcgtggtggtgcaatgcggtggcagctgcttgagcaaaattaccaccggaaccgatggctaaaatgtcatcgtctggtgcaatcacttcaccggaaccagaaaccagcaacatatccttatcattcatgacgatcaatagcgcttctagtttttgtaagttttggtctgaacgccagtcttgagccagttctacggcagcccgttccaggttgccagagaattcattcagacgagcttcgaatttttcttcaagtttaaaggcatcagccacactgcccgcaaagccaacgactaccttatcgttgtaaatgcggcgtactttatgtgcagtacccttcataattactttttcgcccatcgtaacttgaccgtctccagccatagcattgtgcccattatgacgcacggcaacgatggttgttgcctcaaattttactggcatgtgttaacccctgctttctttaatcatgagtggcgcgcggaaagtaacgccgatagtcacgctgaagctgcgacttagtcacgtgagtgtagatctgagttgtggataaactgctgtggcccaaaagctcttgcacggttcgtaaatccgcaccgtggttcagtaaatgcgtggcaaaggtatgccgcagcatatgcggatgaatgtcacccgtcagactgctgcgatcaatcatttgattcaaaacgtattccacacctgtggatgtaattggatcgccataatgattgatgaaaaccacctcatgtgttttatggtacttttgcatcaatggctctctagcaaccttaagataagtttgcagcgcgtctttcgcgtagtggccaaaaggcacgtagcgctccttattgcctttaccatgaatcaacattagctgaccgtcaaaatcgacggcgtttaaggtcaacccacatagttcactgacacggatgccagtggcataaagcacttcaagaatcgcagaatcccgctttgctaacacgggatctggattttcacccgctgctttaaacagtgccgtcatttccttctcatagaagaatctgggcagtggctgtgaacgcttctttagcgtcacgtaggcaaacggattgaccttaaccagatcttcgcgaatcaagaaatcgtaaaacgaccttaaactggagatttttcgtgcaatggtcgttcgcgccttatgttcgtcatacagctgactaagataaacttgaacgtccagtttcgacactaacagtaaatcagtgttgtcaccggtatcgactaagaacttttgaaaagcagccagatcctcacggtaagccttaacggtctcaggtgaatactgtcgttcactttccaggtaggtgataaacaattcaactggtgttgccatgagaatcgcctccatgattgtaatgtatcaaaaaaccaaccctgatgcaacacatttggtcaaggttggtcaaacttaaacttcttataactatttttgaacgggttcctcgtaatcaccgtttggacaaacgacttgtacgccgcctttgatcttcttttcaactaagaagtgaccatctttcggacaatcacggcccactggcttatcccaggtaacaaagtcgcaatcaggataacgtgaacagccgtagaacaagcggtttttctttgattttcgttcaatgacttggccttcatggcacttcggacaaaccacaccaatttctttaacgattggtttagtgttccggcagtctgggaaccgtgagcaagcgtagaacttaccataacggcccatcttgatgaccatcggtgcaccgcagatatcacagtcaaaaccagctggttcatctttaatttgaatcttctcaatggtatcttgagcgtgactcacttctttagaaaacggcttatagaaagtatccacgacgttaacccagtcttggttgccttcttcaatgccatccaactgcttctctaaatcagccgtgaagttgatgtcaacaacgtctgggaaataatcttgaatgatggtattgacgatttcccccagttcggtgggttcgaatcgacgtccaactaattttacgtaatagcgacgttggatggtatccaaggttggtgcatacgtcgatggccgaccaacaccgttttcttccaaagccttaattaagttggcttcagagaaccgtgcaggtggctgagtaaagtgttgtgccggatcggtcttagtcaaggtcaactggtcgccttctttaaggtctggcagcagattatccttttctttgccgtctttatagatcttcaagaacccatcaaacttcaattttgagccattagccctaaacgtaacaccgttttgttcaatggtgacgcccatggtatccatgactgcgttggtcatttgactggccacaaaccggttccagatcaatgaatacaatttatattgatcgttggttaaatactgtttcagatcagctggcgtccgaaaaacggatgatggccgaatggcttcatgggcatcctgagcgccttctggcagcttacccttaagtggcttagtagcagcgtattccgcaccatacttttcgtggatgaaggaagaggcttcatgcttggcaatcaccgaaatccgtgtagaatcggtccgcatataggtaatcagtccttgagaaccttccttaccaatattgatcccttcatagagctgttgagcagccatcatagttttccgcgttcggaagtttaacttcttgttagcctcttgttgcatagcggaagttgtgaatggtggctgtggcgtccgttttcgttccttacgggttacttttgtaatattgaaaggttgatcacgatcaagctttgccaaaaccttttgcacttcgtcgttgtcaggtaaagcgtgtttctttccatcaaggccccagaaactggcatcaaatttagaccgctttaacttaaattcagaatcaatcgtccagtattcttctgggacaaaggctttgatctcgttttctcggtcaatgatcagcttcagtgcaatggattgcacccgaccagctgaaagcccctttttaacttttttccaaagcagtggtgagatggaatatcccactaaacggtcaagaatacgtctagcttgctgagcatccacaaggtccatgtcaatggtccgcggtgttttaaaagcgtctttgacagcatctttggtgatttcgttaaagaccacccggttcttttctttgggatctaagtttaacaagtgtgataaatgccacgcaatagattccccttcacggtccgggtcagctgccagataaacttgcttggcctttttagcttcagagcgtaactctttgatgacgtcacccttaccacgaatggaaatatagtgcggctcgtaatcgttgtcaacgtcgacacccatcttactcttaggcaggtcccgcacatgaccgatactggccatcactttgtaagtacgcccaagatatttttcaatcgttttcgcttttgctggtgattcaacgataactagttttttttgtggttttcttcgtttagttttagttgttttagttttcgtagcttttggtttcttagttgttgctgccatctaattaccccttctggtgagttttaaatatttgatgctataagattactaaatctttcacatcatatttcataaaaattagattgtcaactgaaaaagatttcaaaagctactatattatatggcaaatggatgtcgtttctgtaaaatacatacgggtaaatgctggttatttagtctttaatgacgggtattcatccaatatatcttgagccgttaagaccgctttagcccccgcttgaatcaactgattacacccgcaggagagcggatcatcaatcctccctggaatagccatcacatcacgattattttgcaacgctaaactggtagtaatcaaactaccggatttttcttgggcctgtaccactagcgtcgcttggcttaaacccgcaattagccggttacgttcgataaaatggtacttctttcccaccgcatccaggggatattctgacagcaccaattcatgttgagccatgtactgctgtaatttttgactgcttgctggatagctcaaatttaagccagtaccgataacgccaatggtatgaccatggttgcgtaaggcgagccggtgactcaagctatcgacaccggctgctagtccggaaacgatcaccagttgattttcaataagcgttggcatgagcctgttcaataccgtttccgaataagcactgcgctttcgactgcccaccacgctcaacagctgctgtgcgttcagtagttcaagattaccctgataaaacagtaccacgggaggcaaccaactttctttcagcaacgcaggatactgcgcatcaaaaaaagtcaggtattgcgactctttctcgtgtcgttccaatgcctgactcaccttatcactcataaaaccctgttcaaatttctgccgatgctgcggtaagacactggcaatttcactaatttccgacggcagcaagtttctcaattgccctggatgattcgttagccactgggcgacgagatactcgcccttcaagccgattcccggtgttaaatgtaaacggagtaaaaattgattcaaattcacgatagttcacctcatccttagtttcagcaaactacgataaattatttgaaatagtttgaaacaggggcaaacgttcgccgatgaattttagacggtcctagatcggctaaaccttgtaaatgcgccttggtgccataacccgcattatgtgaaaattcataaccgggataaagcacatcgtaactttgcatgaggtggtcccgaaagaccttagccacaatacttgctgccccgattgagacgctcttcgcatcaccgtgaatcagctttaactgcggaatgtcactatcgatctgcatagcatcgatcaataactggtcaggttgcggctgtaagtgattcactgccgccaacatggctacacgggtggcttgatagatgttcaactgatcaatttgctgggccgacgcggtaccgatacccactgcgattgcctgatttaaaatttgcgggtagagtttctctcgctgatgatcagacagttgcttagaatcgttgacttcaatcacatcaaaatcgtcaggcaaaataatcgcacagctcaccacgggacccgctaacggaccacgaccaacttcatcgataccagcaatcagttgatgtccctgttgccgaaattgccgttcataaaaaaagcgctgctcaaaagcgcgcttttcactgattagcttagccagtcgatgctgagtggtcgccatcaatttctgaacacccgcacgcggatcatcggcatattcagtaaatagcgaatcgttctcgtccgtaatttgatcaaacagctgtttaagttcacggattgaaggtgatttaggcatctgccccaccgtccgttcggtttaacgtgtagcgacctaatttactcttacgaatgtctaaaatcagtcggtcagaagcacgttcatagtcatccttcatgccaaactgtttcgttaattttaacagtagatcaacgtctgaaagatcgaaatcatcttcggtcaacttgtagcgttcttgtagtgcctttggatagtactgccgaaagaactttaaggcgtaaagcgccacatcgtcactagcgaaacgctgatctttaatggcacccgtcaacgccagtgcctgaccggtttcttcgtcatcgaactttggccacaaaatacctggcgtatccagcaactgcagtttggaagatgaccgtaaccactgctgcccctttgtcacaccagggcggtcgcccacctgagcagcccgtttgttaactaatcggtttagtaacgtggatttacctacgttaggaatacccacagtaattgcgcgaatcggccgttctttcagtcccttttgttgctcgttatccagtttatccgccaaaatagattgcgaaatatgggtcaccgttttggtggtaatgtttgccttagaatccaccgcaatcgccggcagaccctgggctttgaattttttgatccaatttttggtttgttccggatccgccaaatcacttttagtcatgatcactaaatgtggcttatttttgatgatccgttcgatttctggatttcgtgatgattgtggaattcgagcatccaccagttcaaacacaatatctactacgtgtaaattttcttccaactggcgaatggccttcgccatgtgaccagggaaccattgaatagttgccataattgttaaattcctttcataacagggggttaaagatcccatcatttcactttattgatgtaggacttattatttaagtaatttttcctaaaacaaaaaatcagcattactattttaacatagttcatcatttggatttttaaattggatagaagttaatgataattgcttttaagagaccactaccggaattctggtaaatatgctggttagttgggtcaaagcgagtagcatcatcctgatttaagaccaattgtttatcacctactgtcaacgttaactggccagctaaaaccatcacatattcttccgaatcaaggttttggttggtcttagcatgaccaacagaagtgtaactagtaccttcatccaattcgatttggaaaagctcaaaattatgatgtggagaatcagaataataaccataaatccgatagtgaccatcaggtgattgctgctgagtaatttcgttttttttaataattttattagttggctttggcccttctaatagcgttgtgtaagggatatttaacccaatacaaattttccaaatggtattgattgtgggactagtcccattattttcaatttgagacagcattcctttgctcacgccagaaagctctgcgagtttggcaaggctgatgcctctttcgctacgaatcctttttagatttctactaacaattattccaatattcattatcaaaacttcctaactgttattgacatagtattaaaaatgcattaaggttctatttaagtttaaaatattaaacgatagtattttattttaaacagcgattaagtaaaacgttaatagcatcaactttaccgtttaaaaacaaatacagaatggaggaaatgatttgtggatagtgagttaacggtttcaagcgcatcaaaagaaatattaccaacggtctttggatacatcggaattggtctagcgtatggtatcgtgggtaaggcctcaggattaaatcctcttataatcactttaatgtcattaattacatacggcggtgcttcacaattcattatcattagcatgcttgcagcacatagtcccatgatatcaattattttatcagcctttttggtgaattcccgcatgatcctgatgagtacaactttagcaccttattttcaaaaagaaagcctgcttaaaaacattattttaggtggactcgtcacggatgaaagttttgcacttagtatgaataaggtcaactatactgaacgcaaattgaattttacgtggtttaatacagtgaactttattgcctatgttgtatgggcaatggcttctttagtaggtgccttattaggaaattttattagtaatcctgacaaatttggtttgaattttgccttagttgccatgtttatcggtctactttacctccaactggtaagtgataaatccattaaattcaatttacaactactcgtagtcggctttgttttagctgcgactttcattagcattatttttattcctgcaaatcttttaacgttggtaattacactattagcttgtgaatttggggtggtgatcaaacatgccttcttctaattttattttattgacaattctaggatccggactagtaacctggctatctagaatcatgccattcgtgattttaaagaagtttagattgtctgcaaaggtcgtggaatttttaagcttcgtccctgtttcaattatgtcagttttatggtttgaaaatttgttcattcagcacttaggtcatttaccatcgttgaatatgcctaaccttttagcttccttgccaaccgttttaagtgccgttatttccaaaaatttacttgtcattgttgtagtcggtgttatctcactgggatttttaagacttgttgtaggaatgtaaatgagctaaaaatgccttcttcatatttacatatgataatccaaacaaccctttcagttaagtcatttttacacactgaattgtgtgagacaaccaattgagactgtactattaaagccattaggtaaagatatgaagattcttacctggtagctttttgagtatctgcacaaaaatgtaccgttcacatgacgtaagttttaaaatttaaatagttgaaaattcattcaattattctcgacgtttccgcaacgtccagattaacataatccaagcaatcacactaaaaatcagtaacagccaaagcgcccaccggctacctaacatagttccagccacttgtgttctccctttttgaccgctagcaacaatggctgaagcaatcgccgttcccagcgcagccgcaaactgctgtagggtattcataatggcgttgccgtctgcttgttgctgctttgataattggttcagcgtatcagtcaacacattaccaaaggccagtccaattcccaacataaagcctacgtacaagccaatgacttgaccatcgctcaacggcatacggaataatccgaacgcaatcatcgaaacgaacacaatcgttgtaccaatcaagattggtcgacgtggaccaaagtggtcgtataaacgcccactgatgggtgctagcactgcgccaagcgctgcaccaggaagcacgatcaaaccagcttgtaatgcagtggctttgttaacaagctgtaaataattcggcaagataaacgacagtcctaacgccatcatctgaaacattaagaaagcgaaaacgtgctgagaaaagctagcacgactaaagggtgttaaatccaaaatgggctgtgtttgtcgccgctctcttagaacaaatacgaccaacgcgattacgcccactatgaaagcagtccaggagaagagatgcgaaatcgtatttgaattaaattcactcacgccaaaaataagaccactgaaagctaaaattaataacacgacacttaaaatatctagctgacttggctgtaatggctgtttttgccgaatacagctaacgcctaataccaacgaaatcagaagaattggtattaagaaaacaaaaatataccgccagctcaaatacgtggtcactatgccgccaaaagtgggaccaattgctggagcgatccctgtgatcagcgtccctacccccatcatggcaccaattctcgaacggggaacctgctctaaaatgatgttaaacattaatggcaaagcaataccagtacctaagccctggacagcacgtcccagcagtaacacccaaaaagccggggcactgccatctaaaatcaggcctagcataaacaataaattagcgacaataaagagacgtcgcatcttgaatgtccgtttaaggtacgcggataacggaatcaccgctgccacaatcaacagatacagtgtggtcagccactgtacggtgctcgtgttcacactaaattcatgcataatcgtgggaaaagtaatgttcatggcagtttccacaatgacaccgctaaaagacagtaatccggtggcaaaaattgctccgattacgcgaggttcaattcgcgcctcactcattttacaacccccttgatccaatattgcagcatacgttcaaaatcagctcgctcagaagcagtaaactgttcaacaaatcccgcctgaatacggtccatgtaggcttgtgtagcctgttgaagttgctttcctttagtggtcaatgtgacctgtttttgtcggccatctttagcgaagcgtgcttgttttaccaagtcacgagcctgcatacgttgcaacagcactgtggctgtggaccgacgaatgctgaattccgtctcaatatcacgttgaaggcaaacaccttcagtacttgcgaggaactctagtatcgacatttgggtaccggttaaatcatactgacgcgcatattcatccatttgtctaatcaactgattgtccgctaatttaatcaaccgaccgtaattcgtgtccattcaatcaagtcctttcgttagctgactaacgattatattagcacaatgtttcgacgagaacaacgaaaaaaacacttagaccagttgaggtccaagtgttttttcgatttaaatcaaattatagattttagtttaccccttaacgattaaaaggtgaacttgtatttaatgatcatcctcggccgtttaggcatatgcaccccatcttcatagagttgcaagtagctggcagcctcgatgtcgccatcatcagaccgctcgtttagctccctgagtgcagccattttcagcataaaccacgaccagccacgaccaaataagcggttgtaaagttcttcatttgtttcatcttgcattgttaaatgcgcgcctctgttctgatttgcctctgttctgatttgtagttcagttactctgactattaccataacacttagttaaaagatcagccagtctctaatcttgctctaaatacatttgccaagctttgtcaaataccgtcatggacggtaaatagctggcgttttcttcgagatacttggataacacgtcaaactgcgtctcttgctttggaaaggcctgatcataaaacgcattgttggcaaactcagccacgggttcgtagtcttcgggattgcgctgcgtcattaaaaattggtagaaactttgtctcacaacgacccctcctttaggatttagactttggaatcaacactttaaactcaaatttaccagcgccgttcatatcaattttttcggcacgatactgaacgccattcgttctaaaacgttgcaggtccattgtaatcgttttttgatggacgtttaattcaacccattttggtaaattatactgcgctttaatgtaacttagaaccgcactgacgggaacgtttaactgtcccaccgccaatttgccagccttaagttgaacgttgccgttagccaatacggttggctttaatgtcagcccaaagtttaccggcagacccagtaacttcgtttgaccagttaaaacggcatcgttgtggacttcaaactgataatcaactttttgtttactttgatcttggaactggcctaaatagtaagcggccatagcgtttaactgttttttattcagattcacgttaaaactggctgccgctgctggggcgttgatgggtgtggtattttctttcggtgccgaaaacaccttaacgcccatggtaccgatccccagtacaataacggctatcaacgcaataaacgcccatttccagggattaatggttttctttgctgctgtatgttcttgtcgactttctgtgttcaaaacatcacctcaaaatctatcgtttacgccaattaacattattttgaatggcttgacttaacttagtcgccatcacattataaccctttttgttgggatgaaaatgatcttcggtggataagtaagcgttcttttccttactatcttgcgtctttaacagttgttcaactttttctggatccacgaaggcctgatcattctgccggttttccgtcttcaatttagcttgcgcactagctgactggtactgaccgcgagaaagtgttgaattgacgttgataaaatgcgttcgtgactgactttcagcaaccttttgattgacctgattccactggtcaactgatgaactgatcatcgtggcattggtaaagtaaacgtacactggattataaataccgaacaaataaacttgggcacgtgggttcacttcatggacatcagcgaccaattgcgtcagtttttgctgatactcagtcttaagcggtgccatcttttgagtcatctgagcatcactgttcaccataatgtttttttctaaggactgcaacaggtcattgccacccgctgtcagtgcaatcacgtccgctcgacgcaacgaacgccgtaacttctgattggtttggacgcgatgatcgatttgatcactgcgttcgccaccaatcccgtaatttgcggtttgcggtttaacgtaataggtctggctgagctgttgctttaaaatcggtagatatcctgaatgatcatgatcatagccgatcccttgggtcaatgaatcaccaacccccacgaccctaactgtttttaggacaataggacgtttttgctgcgtactcttggaacctgactgatgctgaagccaaaaccacccgccaccgatgatcactatcaagattaataacgccgagaaccactttaaaaatcgatgcatgtcaaaaccccttcattaagcgtatacgcattattctataagttacatgacttaaaatgacaaatgagatggtcatctggccatctcatttattttatacggccaaccgccgttatcggactaagttttagttaaatttccgttgtcacaacgctagtcatcaaaatagtaaactaacgcgaaggcacctggtccaccatgggtcgcaatgattggtaccgtttcacgaaccaaaatatcaatgttaggaaacatgggtttaagatgctttaaaatgtcgtcaaccatgccttcagcgtgtacgtgagaaataccgatggccttgatgtttggcgtgtttttcatttgttcataaaccttgtcataaaatcggtcaatggtcttcatgccacggcccttggtacggatgtttaattggccatcaccgacctgaagcacgatcttgatattcaataatgatgagattgcccccgtcattcggttgattcggccgcccttaactaggttgtccaaggtcatcacacccatgtacagacgggtgtttttctgaaccctcttggtaacggccacaacttcatcaacggatgcacccttttcagcggccttagcagcttcaatgcattgaaaggccagtgcccgatcagtagtgccgctatcaacaacggtaacatcagacttcgaaatcttggcagcttgttctgccgtatgtaccgtaccactgattgcttccagcatattcaagcagacgactggactaccatcagcacccagttcatcaaaaactttgatgaaatcgcctagtggtggctggctcgtctttgggaacacctttgaatgttccattttattaataaactcttcattagtgatggtgtggcgttcaacgtaaaccacatcatcgatcatgaccgttaacggcacgattgtaatatgatatttttcaacttcttcatctgttaaacccgcagatgaatcagtgactattttgacagttgccatgattgattataaccacgctttcttccccattgtaggtgttttcatgctacaattaattttagtgcatgaaaacgattcgataatagtatagcagatgaaccaacgtgtaacaaggcgttaaagcgcttgctaacagcatatttaaaagatattaacgagccattcatgctgatttactcaaaattttcatcaaggaggatgccccatgattcaatccaaacacctaaaaacaaagccggaattttccagaaagtaccaaatcattaatgaagtgctcaactcagttacccatggcattggggtcgggttgagcatcgccggattagtgttactgatcattcgtggtgttcatgaaggtggcgcaatgcgtatcactgcatacagtatctacggtgcattgctggtcatcttttacttagcctcaaccctttttcacagtctctacttcacccgtgccagtcatttattccaaatctttgaccactgtgccatttacttattgattgctggtacgtataccccgtattgtttggtagtcatcaaaggtacgctgggttgggtcatttttggcgttatttgggccatggcaatccttggtgtggtttacaaatgtctctggttgggtaaatttcagaaactatccacggtgatctacgtggtcatgggttggttttgcgtcctcggtttcaagcaattgttctacggccttggtgtccgcggttttacgctattagtattgggcggagttgcttttacattaggggcagtgatttatagctttaagagcatcaaatttggtcatgtcatctggcacttatttgtgctgttagggacgatcttaatgtacttctcaatcttgctatatgcctaaataaatgtgtgacaaaacttggtagattccagaatttaacgtaaaaattaggcctatcccggcgaacttggtcgggataggcctaatttttgcgttaaatggccagaatctgagttttagagcacgagtaggctatgttgacgtatcgaaccaaaggatacttacaatccaactttatttaaaaaattaattgaaatacttaccagtatcgacttgtaacacacgcttattttaccttctgacttaccactaaccgtaccgaatagccagcatcttccagtgcctttttaacggcaacaccatcggttttatccacgtgcatttcaatcatgattggtcccagattacgggtaacgattaacgtttgaatgttgaagccattatcggccataatcttacccatttcataaataacgcctttacggtcatgttcgatcatcacttgtaccacggtggcatccacgaagtaatcggtgatatctaggaagccgtctaacacgtcattagtagtgatgatacccacaacttgttccccgtccatcaccggtaacacgccaacgtcatggtgccgcatggttgagatggcatcctctagttgggcgtctttggaaatggttttaacctctttttccataatctcgcccacggtcatcttgtttaagaggtagttgacctcgtagatcgataaactggtggctttagacggtgaagctgcttgaatggtcccttctgtgacgatgccgactaatttatcgccgtcaatcaccggtaaccgatgaatttgattatccttcatcacgttcactgccatattgatttttgtatccggtgataccgtgatcaccctatctgtcatataatctgcaacactcatcgtctaacctcctagatatgctttttggacgtcttgattagccaacaattcctggcccgtccccgtcatttttacttcaccgctggccaatacatagccgcggtcagcaatcgacagtgcttttttagcgttttgttcaatgagcagtaccgtggtgccttgctctttaattgcttttacgatattgaaaatttcattaataaaaatcggagccagccccattgaaggttcatccagtaagagtagcttcggcttagacatcagtgcccggcccatagctagcatctgctgttcaccacctgaaagcgtggcggcatcctgattgagccgttcttttaatactgggaagcgtgaatagacggtttcaaaactggcatcaatttctgcccgattattttgaagaaacgcgcccatttgcaggttttcccgtacagacattccagggaagatatggcgaccttctggtacctgtgaaataccggcagccacaattttaggtgcgttttgcttttgcaaatttttaccttcgtaagtgatagtgccgcccaccgattttagtagacccgaaatcgtctttaggatggtggttttgccagcaccgttagcaccgatcagcgaaacaatttcgccctgattaatcttgaaactgacgcccttcaccgcgttgatcacaccgtaatttacagcgagatccttaacttcaagcatggtcatcgctattcctcctctcccaagtacgctttgatcacagcgtcattttgctgaatttcagttggtgtaccttctgccaataatgaaccgtgatccaatacataaatccttgaggccaggttcatgaccagtgacatgtcgtgttcaatcaacagaacggtaatgtgaaaatcacgctgaacctggcgaatcaaacgagttaggtcagccgtttcttcggggttcatgcctgctgcaggttcatccaaaaataggatcttcggtttcgttgctaaactacggacgatttctagccggcgttgaatcccgtaaggcaagtttttcgcttgtttatccaaatcgtcttgcagatcaaaaatttttagcagttcaatggcttcttcacgaatctgagcttctgttttgtaaaattttggtgaacggaatattgactggataaaattctctttataatgagccgtcatagcaataagcacattatctaatactgatagctccttgaatagacggatgttttgaaaggttctgcccattccaagattggcaattttgtaggtcttcatgccgttcagtggaattacaccgtcagttccccgaaaagtgattgaacccgtgcttggaacaatcacgccggtcagtaaattaaacaaagtcgttttaccagcaccattaggcccaatcaaggcgactaattcatcatcgttaaggtgcatattcacatcagaaacggcagtcagaccaccaaagtttttgactagattttcaacattcaaaagtgttgtcatgattttgcacccaccttcttattcttgcgattaaagagccgtttaaatgacagctctgtagaacccatgatccctgatggtttgaaaatcatgatcaggatcagtaccacggcgtaaatcaccatacgcagcgcaccgaagttttgtagagcggtatccacaacccccaggataatggcagcgacgaaactacccgtgatactcccaacgccaccaagaacaacgatgatcaagatagcaattgattccatgatgttgaagttgtttggcgcaatggtttggagatatgaagcctgcatcgaacctgcgacagcagcggttgctgcacctaatacgaaagcagccaatttccacttaaagatattgattcccattgattctgcagcaatctcgtcttctctaacagctagagctgcccgaccaccacgactatgtataaagttcacgatgataatggtggtgacacaaaccatgatataaaccacgggccaagtagcaaattgcggaatattaaacatccctgaaggtccgttagtaattttcatattattaataatgattcgaatgatctcagcagcacccatggtggcaatagccaggtaatcaccgcgcagacgcagggttgggatacctacgatcaacgccgcgataatagcgatgatcacccctacgataattgagaggtagaaggctcctgcagtcggtgttttgctaatcatgattgcagtagcgtaggcaccaaccgccataaacccagcgtgaccaagggaaaactgacccgcaaaaccaatgatgaggttcaacccaacagccagcataatgttaatcccaatggtcaccaccatgttttctagaaatgaatcaattacccccgctaagatcaaggtgttcatcaagtaaaagccagcgaccatcaaaatcaaccagcaaatattatatttcaagtttgctttcaaagtcatcacctaaaccttttctttgacgtttttgccgaaaataccagctggcagtaccagaagaatgataatcaataccagataaaccgcggcatccttgtacgctgaaaggccaacggattgaacggctgtttccaagataccaatcaagaacccaccgagagatgcacctggaattgaaccaatcccgccgacaacggcagcaacaaaggctttgatccctggcgtcatccccatcaacggatcaattgagttgtaataaagcccaattaaaacaccggctgcaccagccatggatgaccctaaggcgaaggtgaacgaaatcgtacggttaatgttgataccaaccagttcagctgcgtccggatcaactgaaacagcacgcatggcgcgacccattttcgtctttttaatgatcagttgcagcaagatcatcaacaggcaggctgttcccaaaatcaagatctgaatgtttgagacccgaaccccccagagattgtagttcacttgtttgatgacctgaggaaaattccgagtgtcggcaccgtacaagtacgacatgccattttctagaaaataagaaacaccaatggcagtaatcaaagccgtaatgcgtggcgcgtgtctcagtggccggtaagcaaagtattcaatgattactccggctgccgcgcagacaaccatggcggataataatgcaaagataaagttaaagtgccagaagttaatggtgtagtagccccaaaaggcgcctaacatatagatgtcaccatgcgcgaagttaatcagtttaatgatgccataaaccatggtgtagcccagtgccagcaaagcgtaaatgcttccaagcgaaaggccgtttataagttgttgaaagagtgttgtcaagatgtcaccctcctttatgtagttagagttccagcttggaagctctcgtcagcaggcatcctagcccgttcacgagagccccctaaagggaagctccagtgatcaattattgaatttgagtggaaccaacgactttaccattgttcagatgttcaacggcgattggcttgttggcatcgtgcttgctatcgatagtgattttacctgtaacaccgttgaagtctttgatgtttgcaagacccttagtgatcttaacggagttagctgatttttgactttcaatagcttgtttgatcatgtatgttgaatcgtatgccaatgctgagaaagttggtgcatcggtgtggtaacgtgctttgtaagcgttcatgaatttaacagcagttggattcttttctgcaactgtctttgagaatggtgtggtgtagtaaatgtttgaagcgttcttagcaccagcgatttgaaccagcttagcatcagccatcccatcagaaccaacgattggaacgttcaaaccgatttgacgggcttgcttgatgatcaaaccaatttctgagtaataacctggtgcgtaaatggcgtcaactttcttattcttgaatgaagtcaaaatagcgttgaagtctttgtccccagctgagaagtactgagtatcaacaactttacccttgaactgtttcttaaaggatttcgcaaggccagtcccataatcagttgagttgtcaccaagcacggctacgcgtttagctttcaaattgttgtagacgaacttagcaccggtaccaccttggaagttgttttggtaacatgcccggaaaacgtatggctgagctttaccattcttttgaagggtgaagtttggatcagttgcggatgggctcaatgcaggtactttagcctttgtttcgttaggaattgcggcagtaccggcgttagtggttgctgttccaataatggcatttactttatcgttattaaccagctgtgctgcaactgaagctgaagtactcgtagaagtcttgttatccttaataatcagcttgatcttcttctttttaccgttaacgttcacgccacccttgctattaatttcgttggtagccatctgaaccccttgtttcatttggttcccataacctgcggcagctcctgaaagttctaggttgaccccaatctttacggtacttcctgtttgatcatttccctgactagttgtcttagctgttgaacaccccgcaaagatgacggctgacatggcaattgctgcaattcctgtgactcgtttaatcattttgttattcataagtatttcccactttccctatataatttatgtgtaatatgtgtgatgcggcttgcctgactaacttccctcctcgtgccaaagcaataaaaaaacctcattcagtttaatgaatgaggtttgaagtcagaatttaatcatcaagccctcatcattaaaaacgcattaataagggctcaacttagtttaagcagtagcttggctactagctaatagttgcgtccttggtttttaataataagactaaattctgacgagcagaagttacattaagtttttgaacgtttgaatttttcatgtgatgtaacctcctgtcagaatttttgtacttggtgaatgatgtaactataattgaaaactcataattcgtcaacaattatttttaaattttaatgatttaatgacatatttgcttgatggtttacctcttaaacagctttatatcaacgttttaaagaaaaatattttttgatattttctccaatgtttatctctcattttaaaaaataagattatgagaatacactcattttaaaagacagtccagttaacacaaaaatcgctcagtataatgactagtgggtcatcatactgagcgatttttattgtcgttcccaacgttcaaaaaccaggccatacggattcttttcgtctggctcgtgagatatcgattcaactaactgaaactggctgtagtcaatttcaggcatataagtgtctgctttaaacgtgtgtaacacgcgcgtccgcaacagcgtatcaacgtcaggcaacagacttttaaagaccctggcgcctccactgatgatcacggtttcgtccggatgtgctttttcgtaagccactacttctgctgcattgtgcagcacttcaacgccactgggataatcagtggcagttcgcgtggtcagtacaatgtttttccggtgtggcaacggttttcggtagctggcaaacgtccggctgccggaaatgagcgtattacccatggtatgctgcttaaaaaacgccatatcagctggcagatgccacggcaactgtcccttatacccgatggcatggtgctgatcttccgcccagataaatatcatgaaatcacctctaaacggccactggtgccttgattgccggtgccggatggtaattagtcacactgatatcgtccatatcgtagtcaaaaatgctggacttatcaggattcaaaactaatttaggtgcttcagcaggtgttcttgaaagctgcgttttaacttgttcgatgtgattgctgtaaatatgggcatcgccaaaggtgtggacaaaatcgccgggttctaagcccacttctttagcaattaaattggtcagcaacgcatagctagcaatgttaaacggcacgccaagaaaaatatcggcagaccgctggtataactgacagctcaacttgccatcgttgacatagaactggaacatggtatggcaaggtggcagtgccatgccaggcacgtcttcaggattccaggccgaaacgatcatgcgccgtgaatccggatgggttttcagtgtctcgataacgtttcctagttggtcaatggtttcgcccttactagttttccatgctcgccactgcgccccgtatacgttacctaatgagccatattgggcagcaaacgcgtcatcttcaacaattcgtttgcaaaaagcctttttttcttgcttataagtctcattaaacgcttcatcaaccagtgaacggcgcccaaaatcggtcatatctggcccatggtaatcactggactcaacgaacttttgaaaggcccattcatcccaaatatggttgtgatgtttgagtaaaaattgaatgttggtatccccatgcaagaaccaaagcaattcacttttgattaacccaaagggcactttcttcgtggtcagtaacgggaatccctgactgaggtcaaagcgcatctgataaccaaaaacactgatggtccccgttcccgtccggtcagatttacgatgcccattttccaaaacgtagcgttccaaatttaaatacgcgtcttcaagcattgaaaaaactcctcattctttattcaacatactgacttaaataatcccaccgcgtcattttttcgtccaattccttgtccgtggcttcaaagtcagcctgtaatgtagctaatttatcataattatcgccgttctggttcatttttgcctgcaagtcagcctttttcttttctaaggcatcaatctcgtcttcaataccatcccactcaagctgctccttgtaagtcagcttcgttttggtttgtttgacgggtgcttccgaaacgggtttaggcttaggtgcagactttttcccacttggctgcgactttttttgattagctaaatactcggtaaattgaccactgtagcgttcaattttcccgttgccatcaaaaattagtaacttgtctgcaactttatccaagaaataacggtcatgggaaacggtaatgacggttccgttgaaatgattaatataatcttccagcaccgtcagtgtggaaatatccaaatcgttagtcggttcatctaaaaagagcacgttgggctgttccatgagtaatttcaacaagtacagccggcgtttctcaccaccagataacttgcgaatcaacgttccgtgcatgaaccttggaaacagaaattgttccaataattctgacacagaaacagaatggccatctttgtcggtcacattattccccacttcactgaggtagttaatgattcgcttatcgtctgggatcggttcagtacgttgcgtataataggccattttgaccgtctcaccaatcgttaccgtacctgagtcaagaggtaggcactgtgccataacgtttaagagcgaggattttcccgccccattttcgccggaaataccaattcggtcaccagcctgaatcaacaggttaaaatcttgtaaaatcagatgatcatctaattttaagttggcatccttgagttcaatcacttgtttgcctaaccgtgactgccctaaatctatcgacacatcctgttccgtcggcgtggtaccaagattttctttgatcttattaaaccggttgatccgtgcctgttgtttggttgaacgagcatgtgcgccggctttcatccaagccagttcctgcttatagagttgctgctgcttatggtcggcattggcttcttgctcgactcgttcagctttttgacccacataatcttggtagttaccgtcgtagtgaaatagccggccaaatgaaagctcccaaatatggttagcaacttgatccaagaagtaacgatcatgggtaacaactagtaaagcacccttgtagttggctaaatagttctccagccagtcaatggaatcaaaatccaagtggttggtcggttcgtccagcaataagaggtcaggcgcctgaattaacacttgtgctaaaccaacccgtttacgctgaccaccagacagtgttcccatctgctgattcaaatccatgatgtgcagctgcgtcaaaatggttttaacgtcgctttcggcgttccaagcatcagcttcgttcatctgtgcttccgcatccatgtattgttgctgcttcttctgatcttcagggtcctcactgtaagccgctaaggtgtcctcgtaacgccggataatcttaaagactttttgtgaacccgaaaaaatagcatccataatcgtctgttcgtcattgaattctggttcttgttttaagtacgcaatggaatagtcgttaggtgtaataatgtcacctgaatattgggccagcccagctaaggtatccaataaactggtcttcccactaccattagttccaattaaaccaattcgatcattttcgttaataatgaagtcgaccttgtcaaatagtgttttttcaccataagttcgggtcaatccttctgctcttaaggtttgcatttggtcacgctttctcgtttagatatttaattgctgcattgagcaacatgttattttgattcttcaactgtccttccaccacttgacgctccagataattcagtgcttgccccagttgcggtccgggtttaataccagccgacatcaaatcttgaccggtaatggctaacgcttttttagaatggatctgcagttcatcatactgcgccagtaaagtggctgtcgcatatggtgactcacccaattgattagccacctcattggcaattggcagtaactcactaccagtctggtaaagtagccaagcatcaaccgaatgttctgaaatagctttgacagctttcacagcaacttgaacatcgtcaattaactggttagcggacttccagtctttgagtagccgattaacttgtttgctggataaaccaaagacagcgcaaagtatcgtccaaaccgctgtttcactgcttaatccactctttaactgcaactgtagctgctcaagctgatctttgtacggcttaaagtccggacaatattggtataatcccgtatccataaaaacgtcaagtcccatggctggccactgacctaacagcatcttaacgaattccacgtgaatccgttccactgctatcttagttaacaaactaccatggtgttcgataccggtaatcgtttcgggatcaatcgtaaagttcagctgactggcaaaacgaaccgctcgcatcatgcgcaaggcgtcttcgttaaaccgtttctctgggtcacccactgcacgaatccggtgtgcttttaaatcgctcaaaccatcaaaataatcgatgattgtcccgtcagtctttaacgctaaggcattgatagtgaaatcgcgccgattgagatcctcttttaacgatctcacgaacttcactgaatctggtcgacgataatcttgataacctgattccgttctaaaagtggtcgtttcataaccagtgccatgatccaaaatcatcacggtaccatgttcaataccagtatccaccgtccgtttaaataacgatttaacctcttctggataagcgctggtagcaatgtccacgtcatggattggcagccctagcagggtgtcacgaacggaaccgcccacataataggcttcatatccagcggcttcaatcgtatcaatgattggctgtgctttaataaattcttctggtaatgtttcaattctcattttgatcggcccttttatttgatttcagtctattcaattttaccagatatccttagcataaccaactgtacttcatctgaatatgctatgatgattgaggaatcctactatggattaatttattaggggggatcggtttgtcaaataaaattgaagaaaagatccatttcgttgatttattgatgatcaccattggttgcgcagcttatgcctttgcattggtgacgtttaacatcgccaatcagctggctgacggtggtatcagtggtgtgacgctgattttaaagggattatttaactttaatccagcttattcaaccatcatcatcaacatcccgctgattatgattggttaccgttttttaggtcgccgatccatcatttacacgctttatggtactttaatgctgtctttgttcttatgggtctggcagcgagtaccaattaacatcgctctgcatcacgatctatttttagcggccatggctgctggtatcacgggtggtgctggtagcggccttgtatatcggtttggtggtactactggtggaacggatattatcgcccgaatttttgaacgctttcgcggtattccaatgggacaaaccttattatggttggatattttagtgctgttcgtctcactggtttatattgatattcgtcacatggcttatacgcttctatactcctacgtgttctctcgtctcgtaaactttatcttaagtggtacttacgcagctaagggtgtcttgattgtcagcacaaaatcacaggaaattatcgatcaggtcatgactgtcatggagcgtggtgttagcattctgcacggcgaaggtggttactcacacaaggaccgtccaatgctctatatcgttgtcagcccaagtgaactacacgaactgcaaaccatcgttggtgaacttgacgaaaatgcttttatgacgatttttgatgttaatgaagcgattggcgaaggatttacttattcacggccgactcatggcctctttaaacacgctcattaggggtgtgtttttgtttttagtttataagttaaagtaacttattattttttgctcaataaaaaagatcgccttctcgacgaccttcgtagtgcttagtaatcattgtcttcttcgttttccagtatttcagccatttcagcgtcatcaggcaccaccttgacgtaagcgtgcagcagtttcaacatctgatcacgttcccccatttcacggaagaagtaaacggccggttttaagaagtcagcttgatccataaagtatggcgctgctgcttgataataccggttggcctggtcgtagtcttccaaccgagcatacgatgtcgccagattccagtacaattgcggatccacgttatcttgacccacgtagtcagcaagaaagtccactgtctcctggaaacgtccttgtttaacgtaaagattggataatttgatcacgatatccaagtcatcaggctccagatcatggccctttttcagatacgtttcagtcaacgactcatcctctactctagccgcgatatcagctgcgtatgaccagagtttttcgttatactggtcaacacccagcccttcctgtaacgcctttaaagcatcatctaaccggttttcagcgaccagtgcttgccctaaataaggatagagactcgtatattgcggatcggtttcttttaattcttcaaacaacgtaatggctggtttataatcctttaactggaggtacgtaaaggcagtttcaaacttcacgtcaggagtcatatcacccgagtgaatctgcttcaaataacccaccgcctgctcgaatttaccagcattcgcgtacgctacgccgattcgttctaccaagttgaccgaactaaattcgggaatcccctgcttaatcaaatcaagatacagcggaatggcctttttaaattcacgcatcacaaagtaaagttccgccaacgcaaattgaatagccggttcatcaggtgctaattgcatggcttccagcaacttttgttcactgacttcaaacagttcctgagtctgatacaaatcggcagcaaccattaatgagcgtacgtaagccggcgaatctttagacacttcgtttaagagcgtcaacgcttcatcgtttttatcatcatcgatcaaaacatcagccaggttgactcgaagatcatcttcctctggatactgcttcaatagtttttcgtaaatgcgttttgattggtttaagaaacccagcgaatacagttcctcagcgagactataaagcgtatcgtcgtcatcatggcgtaacgcactggcataagcctttttaaattgatcaagttgaccgcgttctagctggtcaagcgcttgctgtgagtaactagtcattttgatcctccgtttcgttcattcatgaaagtatatgatagcactttcggcactacctaacaaacacaacgcctacgtagaaaactcgttggttagtatttcaattgattgtttagttaaaattggttgtcactgtacctcgattcgacgcgtcaatatagcctagtagcgctccaaaactcagcttccgaccatttaacacagatgatggcatctaccgaattttttcacgcacaaaaaaagccaatccacacgggattggcttttgccgtcaataaataattatttaacagcgtccttcaaagctttaccaggcttgaatgctggtactttacttgcaggaatttgaatttcggcacccgtttgtgggttacggcccttacgagctgcacgttcgcgaacttcgaagttaccaaagccgattagttgtaccttttcgcctttagccaaagttgcttgaactgagtcaaatactgcatctactgctgcagttgcatccttcttagttaagccggttgcagctgcgacatcgttaacaagttgtgctttatttgccatgaatgattcgcctccttggataatatatgatgagtacaaaatcatctcatctagccgatcaacaagtcaatcaggccactgaaataataacggcattccgtatcatttctgtttccaagatagcacacaaagcctatcatagcaaggttttttgcggtttatggccaataaatatgccaaaaagccctttttttacgtacaagtctgaaaaatgagcggaaatcaagctaaatcagtgtttaactctactttcggtgccgttcgatcagatgaacaggtgtccctgaaaaatcgaagtgttcccggatttgattttcaatataacgttcgtatgaaaaatgcatcaagtctggatcattcacaaacaggacaaaagttggtggctggatagccacttgtgttgcgtaataaacccgcaaacgccggccgttgtcatttggcgttggattcatggcaatggcatccataatcacttcgttaagtgtagaagacttaatccgcttagcatgattgctagcaacggttttgatcatggctggtaattcattcaatcgctgatgggttttagctgaaacaaacaccattggcgcataggctaaatattgaaattcttctctaacatgaacttcaaaatcatgcagcgtctggttattcttcttcagcgtatcccatttgttgaccacgatgatgattccacggccagcttcatgagcgtatccagcaacccgcttatcttgttcgcgaataccttcttcagcgttcagtacaaacagaaccacatcagaattatcgatggctttcatcgctcgcataacactgtaacgttccgtgttttcgtaaaccttaccacgttttcgaatcccggcggtgtcaaccatggtaaactcagtaccatcagccacgaacttcgtatcaatggcatcacgagttgtgccggcaatttcggaaacaattacgcggtcttcgccaagcaaagcgttaaccaacgaagacttcccaacgtttggacgaccaattaaactaaagcgaatactgtcatcatcaacttgaccttctttatcaggaaaagctttgatcacggcatccaataaatcgccaaggcccaaaccatgagcacctgaaattgggtatggatcgccaaatcccagtgaataaaaatcatagatatcttgccgcagttctggattatcagctttattgactgctagcacaactggcttgtcagcgcgataaagaatttgggcaactttatcatcagcatctgtgatgccctcacgaacgctgactacgaaaacaatcacgtcagcttcatcaatggccacctcagcctgttgcgtaatctgttttaagaatggttcatcccccatgtcaataccaccagtatcaatcatgctgaacgtgtttccaagccattcaccgtgagcgtaaatccggtcacgagtcacacctggggtatcttcaacaatggagattcggtcaccggcaattcggttaaaaatagttgattttccaacgttaggtcggcctacaatagcaattgttggcatactcatacaacatccctcttttctgttcttaagttcataacggttaaataacagcaaaaatgtcattttgaaactggcattccgtttcaaaatgacattttaatttaatgaaaatttcggttttgaaacattgattagattacttgttgtctgaatctgaacccgtttgagcgttcttcagttgatcaccaatcaaatcacctaaggtaaagccagcatcgtcatcgtcagttgacatctgagtaggtgcagcttgctttctaggtgcgcgttgctttggttgttgctgttgttcatggtcttcactgccagcaggcttttctttcaaagctttgatagaaagtgctaaacggtgagcttctgggtgaacttccagaaccttgacttgaaccttttcaccagttgacagaacatcatttggtgtagcgatgtgttcatgtgcaatctgtgaaatgtgaactaagccttcaacaccagggaagacttcaacaaaggcaccaaaactagtcaaacgcttaacagttccttcaagaactgagccttctggtgctttttcttcaataccatcccatggttctggtaaggtctgcttgattgaaagtgagatccggttacgatctggatcaactgacaagaccttaactttgacttcttggccaaccttcaaaacatctgaaggcttttcaacacgttcgtaagcaatttcagaaacgtgaaccaacccgtcaacaccaccaaggtcaacaaaggcaccgaagttagtcaaacgagcaactttaccttcaactgtttcgccagccttaagggtactcatgatttcttcgcgcttagcagccttttcttgttcaaccaaggcacggtgtgacaagattaaacggttttcactaggttcgatttcaataatcttaaaggttaacgtctgacccttaaattggttcaaatcttcaacgaagtgatcactgatcatagaagcaggtacgaaaccacgaacacctgcatcaacaactaaaccacccttaaccacttgggtaactggggcttcaatggtttcgccagcttcatacttcttttgaatttcgtcccaaactttacgggcttcaagacgacgtacagataatagataactgccgccttccttgtcgttaccgatctttgagataacaactaaatcaagggtgtcaccaaccttgatgacatcattgatatctgaaactggttttgttgaaagttccttctgtggtaccacaccttcaataccggtgccttcgataccaacgatagcttgcttgtcatcatcaatggccaatacttcacccttaacgacgtcaccaacattcaccgtttcaatgctatttaaagcatttaataaatcgttgttctcattgttattgttttcactcatacgaacttttcctccttgcgacaactctaacttatattttatccgaaaattaacaatattaccagtagcatgacgaactttatgcgaattctttttgttttttgacaattatgtcgctaattttgtccacaacctcgtcaattgtcagcgaagtagtgtctaatcgcaccgcatcgtccgcctgagttaacggtgaaatcgctctcgttgaatctttatgatcccgagtttgaatttcatcccgcagcacgtcgattggtgtgtggatgcccttttcagcattatctttaaaccggcgttgtgcccgctcttcgacactggcaaccagaaaaatcttaacttcggcttttggtaacaccgaggtaccaatatcccggccatccataacgatgccgccagcttcggcgatttctctttgacgctcggtcagatcctcacgtacggtcccttgagccgcaactgtggaaacgttattagtcacgtctggttggcgaatcgccatggtcacttctttgccatcaagaaaaactaattgttcgggatttcctggtttaaattcaattttagtcgtttttagcatggtagctaaagcgaccgggtcgtccaaagcaaccttttgctgcatggccttcaaagtaacggttcggtacattgcaccggtatcacagtagacatactgaaaacggtgggcaattttcttagccaccgtacttttaccagcagaggctggtccatcgattgcaacctgtaactctttttttgacattttgttcacccgtatcaacttatttgacgcgtaatttttgtcctggggtcagcgtcgggttcccagataaaccattgagttctttaagccgttcaacggaaatgccgttgttgacagccacccggtaaatgccttgtccttgaccaacagtggcatacttcgaactagaggtggaactcgtagttgaccgcttagacgaggccgtcttcgtagatgccgtgcttgtagacgactgcttagcaacggttgactcttggcttgtctgctgctgtgtctgtgaggtcgaagtggcattcgaatcagctgtctcactggtttcgcgtgtctttgaacttgctttagacgctgctttttttgcagaaacagacgaagctgccttttctgatgcagacttggcagctttttttcggtgtgtttggctcacagaactggtctgttcgctggaaacactcattgaattatcaggtttattcatggcactctgacgtgctaggccgtaaaccaaagcccctactgcaatgataataataattgcaactaaaataatcgtgatcaatcgattgttatgactttgtcggtggcgcttagtccgggacaaattaccttggtcgtctcgatcatccccaaaagactgatcccaaggttttgtttcagatgattgatcgtccttttttggatccatcatgtaacctcctcaaaaactttcattacgaattgtaccatagctagcactagagtgggaacttttttaaatggtccccggctcatgactctagaaattaaagagctgctttaaaatggcaggccattccgctgaagactgatcactttgagcagacgtcgcagttgccagcagtcctaagacactaaaatcaagttgtgcttcgtcactgctgcagcaatgctcaggattcgttgccacatcctgcacctgatcaaaatattgctgaatatactgtcgcttacaatcaggtgtacgcacgtagcccatcatttttctcaacgcggtgacccgctgctcacgccggctagcaaaactattctgaacttgcgcttcactataaccgtgctgcttataaaaccaaatcaaattggctttttcatcaccagccacttgcggggcattctgctgaaaataataatgaatctcattttcctggggcaccgtttcttcacttaaaaaggctgcaatctgctcgtcaccagcttgatacagtaaaatagcaacgctctgctgaccatcccgaccagcacgcccaatttcttgccaataagactcaacatcactaggaacgtggtagtgaatcacaaaccgcacgttgttcttatcgatgcccatcccaaaagcactggtggcgcaaatcacgtctaactggtcctgcataaattgctgctgaactttaaaccgggtttctgaatccagatccgcatggtacgcggccactttgcagtccgttttagcagcaagcagttccgccatttcgttggccttctttttactggaaaagtacactactcccggctcctttagtttagcgacaagctcaaccaaacgctcttctttatccgtctgagcttcgaaacgctcaacactcaaaaaaatattttgccggtctaccggctggacgatttccgtagcctggggaagctgtaatttttgtttaatatcttccctaacccgctcagtagctgtagcagtagccatcagcgttaacgggtcatgcagttggtgtcggatttgccctagtaacaggtattcgggtcgaaaatctggcccccaggtcgaaatacagtgggcttcatccaccaccagcaacccaatctgagtggactgaaacgcactcagtacctgatcttgactgagcatttccggtgaaataaagataaaatgatactcatgcagatgtcgcaaaatccagtttttctctgaataagtcatcattgaagtcaatgctgccgcccgtttttcacccttaacattcaacgtcgtgacttgatcttgcatcaatgagatcagcggtgagacgatcagcacgagttgctgggtgatcgccccgtacaattcataaatgagcgttttcccagcaccggtgggtaaaacagccagcgtattgcgcttggcggttaacgccgtcagcgcctctagctgacccggccgaaaccgactgaagccgaaccgctgttgaagtgtctgatacagttgttcagtgcttatcatctgcctgcttactccttagaatttctaaaagccgaaactgccaaaaatctaccggtaaatcttcaacttgtttaaattgccattcgtcgagcggaaaaccgtttaatcgactttccagttgagcaactaattctggtgttaaaatccgttggtaatcaaactgtcccaccggcagcatgatagccgcctccaataaatgttcccgcacggtgctcagtttcagcgaccgttttcgactaatggcttctagtgactcaccggccataaagctgcgcagtgtctgatccgcgctggcgctcaccagtgagtgattcaaaccagccagcaaggcgttaatgctgctgtttgctgcttgagaaacgagcttggctaactgacaaatcagatcgacttccatcagcctggcttcggtttcactcatctggaaatcccgggaaacttgttgcaacgtgtctcctgggcgttcatgaccaacgagcaatcgactcataaacgaagcctggtcactgggcaagtcagcgaaaacatcctgccaaaaatgataaaacacggtttgcaaatcagctccgtgaaactgacgaaaccagcgcttaacagtttgtttcacctgccaggacgtctgaagtggataatattgacgattctgataactttgttcagaaaccacttgggttgccaataataaccgttgccaaaaggtctcaacatcaacgaccaatctaatatttaaatgctgtggttgataactgttctgaaacaatttttgctgctcaactgccccttgctgcgttaactgagcattagtctgttcaaccgtcaccaatccttcagtttgtaagttgtgaaccgcttgatccattacttcgcggctgagctttttctcgtatcctaaccaggataattggtgatacctcatgccccagtaaagggtagaaaccgttcgcttacccactaaaatattttcgatgactcgaaggcgtcttgaggatgtcggtgataaaaatcgcatcagttgcgttgcatccatcgtttttagccccccttaatcgtccttatttattttcccacaccgtcatttaactgtctaggacattgaaaaaggatggccatcagccatccccttactcattatttacgaaatatcttaaatgtcagtttttaaagcaaatcggactgttgtcttaaaaaagacttcattcggtcggccacaataataaatactgcaccaaccaatatgcccttgatcaaattaaatggtacgacaccaaacaataccatctgtgacagcggaatggtgatcttcatgtgcagcactgccatgtaaaccggaatcaaaatgaacgtgttaagcaacgccattatcacggatagactaacggtaccagcaatgacagctagaatcaaacgcgtcactgtcttatattttttaacgtactttaaaacgtaataaatcggtagcaaataactgactgaagcaacaaaactcgcagcaacaccgataaaattagcaatgtcgacacccgtcatcaaccagtaaagcagtcccttgatggcggcaattaaaatcccgcccaacggtccaaacatgaccattcctaacaaaaccggaatgtctgaaaagtcaactttcatgtaggaaacaaacggtagaattggaaatgaaataaagtagagcaaaaacgaaataccagcaaacagtgacataatcacaacttgacgaatgctaaatgattgactatgttccattggatataccctcccaaaactggtcatcttcaaatgaaaacgtaaacaaaaagccgaattaattttcttcagaggaaaatcaattcggtctcacaatcgcttgtattaacccaatcttctttataccagactttactgtcggtttcgggatcacaccgaatcaactacttcgaaaagtaggtcgcggactattaccgccggtcgggaattgcaccctgccctgaagatgaaccacgctattcaattacttgtgattattgtacaaggtaaacttcaagaatgcaagttatttgtctagcttggctacccgcttgagttccttaacttcttcagggttcagttcgcggaattcacctggttgaacgcccttaagcgtcaaaaaggcgtaagtttcacgtttcagcttcataaccgggtgaccgattgcttgcagcatctttttaacttggtgattcttaccttcgtgaatcgtgagtgagataattgcggttttccgcttatcgtcactggacagcaactttgagtgagccggcgctgttcgcttaccctcgaggctgacccctttacgcaggtttttcagctcttcgttggttggaataccctgaaccttcgctacgtaagtcttatccacttcatactttgggtgagtcagctgattagccagttctccgtcattggtgagtaaaattaaaccggttgtatcgtaatctaaccgaccaacaggatagacccgttctttaatttcatcgtctaataaatcgatcaccgtcttccggtgcttatcatcggaaaccgttgacacgacttgacgcggcttgttcattaaaatgtagatcggcatttcagtttgaataggaacttcatctactaaaatacgatcgtgcttaccaaccttgacgcccaattcggtcaccgtttcgccgttcaccttaacgtgaccagaagtgatcagtttttctgagctgcgccgtgaagcaacgcccgcatgtgccataactttttgcaatcgttccatgtaattaattatcctccgagtttatctgtgcattaaatcgtttcaaaaataaatcgctattctgttcatcatccggtaccgtttgtgcttcaggcaacggtggcagatctgccaactgtttgagcccaaagtagtccataaaataatccgtcgttttatacagtttaggtcggcccggccccttcttacgacccgattctgtaatcagttgccgtaacatcagcttattaagcgtgccagaactttgcaccccgcgaatctcgtcaatttcaattcgggtaatgggttgattatacgcaataatggctaacacttctagtgacgcttgtgacaaaccggtggaactaggggcttcgaaatattgactgacaatgtttgccagtgttgccttcgttgctaagcggaccgtgtcattgctcttcaagatcaccaatgctgaatctgggtcattagcatacttctgatttaattttgataacgactggctcactgccggtaccattgagtccgttaaatccgctaattcttgaaccgtcagtcccgactcgccactcacaaacagtaacgcttctaattgttgtatcttagtcatcattcttctcccaattttgccggtttaacggtgatcggcatcacacgactgggctgatccacggcaatttcatgctgcttggtcatttccagtagtgccagaaaagtcgtcaccagctcttctctatcaggctttttgtcaaacaactgcccaaaaggcacagctgcacgaactttactgagcttaaaacgcaacgtatgaatctggcctttaaccgtgtactgctcatcgtgaatcagccgcattggtaatgctggctgccggcgacgctcagttagtgccgtcaaaacacgttgcaagtcagttgcagttagtcccggtgctaatttacctaatttaattcctgccggcaccgccatttcaggccgggtataaaatttttgccgagcagccgcctgctgtttgaaccagccagctgcttgtttatatcgctggtatttcactagccgattgaccagatcatcctgcatttcttctagactaggttcttcatcttccgtcacaggtgtttcttctaccggcagaagaagtttagccttcatcttcatcaaagtggcagccatgacaaagtaatcgccagccacgtcaagctgatgatcctgcatctggcgcaaagccgtcatatactgatcggtgatggccacaatgggaatgtcataaatatcaatggatgcggatttgatcaaatgcagcagcaggtctaagggaccgtcaaagttctgcacgtgaatcaatactggctgttcactcatgactagcctcccatttagcaactattcgagttgtttccagtgtgcccatgatgcgctgatccggatacatgtcctggagttcgtctaagatcgtattggtttgatcctcttcgcgagccgcgggtgttagcgcaatcagccgcatcaccacaaaatggggccgtaattcaacccccacaatgccagagaaatcctggttaacgtctttccacagcaacagctgcctggcgtcactattttggtaccactgcaattctgcttgcagccggtcaatttttttgagtgcgggcgcaaaagagagcaaccccattgccactttttcataatcattacgatatttaagtaacaaattgatccccccgtaacgttacgctcttggatgagctttacgataaacttctgttaagtgtttctttgaaatatgcgtataaatttgggtcgtggaaatgtctgaatgacccaacagttcctgaacgatccgcaaatcggcaccattttctagaatatgcgtagcaaatgaatgccgcaacgtatgcggtgtcacgtgtttgcgaatcccggctacactaacatagcgctgaattttttgccagatgctttgccgactcagaccgctaccgtgagcgttgagaaataaatagggtgacgtgcgctgttttagtagtagtggtcggctttgatttaagtaccggttgatccagtcaatggccacatcaccaatgggaataatacgttccttattccccttaccgatggtctgaatcagccccatctcaaggtgaagttcacccattttcagatggacgagttcactgacccgcaaaccagtggcgtacatcacttctaaaatagcccggtcacgaatgccatacttattggtagtatccggtgcagctagtaaagcatcaacctccgcaacggtcaacacttgaggcagtggccgtccctttttcggtgctttgatttctgccattggatcaacggccagctggtcattttgaaccaaatactggaagaagtgacgtagcgtcgacaccattcgagtgacactatttcgtgccttgccactgttttgctgctgctttaaaaaattaaggatcgtcagctgatccactttgttcaggtcagtgatgtgttgtttcgtcaaaaactggtgaaactcttttaaatccaaacgatacgaactgatggtattggccgctagaccacgctcaatccgcaaatcgtgcagaaaattctcaatctgctcgtccattttgatcacgtcccgcttcagtcaaccataagtaaccgtcgtgctgttcggcgaaccgttgcttcatcaagtgtcccactgcccgtttgaactgacccttactgataccaaaataatctttgatatcagccggatcactcttatccgtgaaggcgactttgccttcaggtgcatgttgcaaggttgccagcagcataagcgcatcttctggaatagcctcgtaagcccgtggcctcaaggataactttaaggtaccgtctgggaattgacttaccactcgggcatttaattgttgccctaagcgcggttcttcatcacgctcttctggtggaatgaatcccagattatagtcactagtgagcaccatggtaccagtgagcttaagacgataagcagtggcaacgacgtctttattgattaacttagacttcgtggctactggttgtgagattacccgatagagcgcttcgtcgcctaaatcgccccacatccggcccttcttatcaagggtgatggacagcattaaacgatcaccgcgttgtggccataagctagcaatttccggtaaattatccagtgacaccacaatgtctttattaggtagaccgatattcacgaacacgcctagtccacgttgcacgcgaaccacttcgccaaaaccataatgatccacttgaactttaggcgcatcacgtgtgatctgcaattggtgctgttcgttttcgtaagcaaagcccttaaactggctacccagttttaaaggctttttgatttcacccttatcaagccgaaaagtcaggccattggtttggacaaaatattccttgtcgttttcatcagttacttcgccactaataatccggccgagcaactgggttaattcatcattcattttagtatccccgttcgttctcttatattacacatcttttgatattatcgcacatattgaccggtggtggtagtttattctcaacacagtgcccctatggaaactaaaaaagcctagccacaagggctagactttttcaatatcagctaattaagttgattaaagtgcgtttgaagcaccgtggtaaacgacaccgcgacgtgagtcaacagtaatcaattcaccatcagagatcttttctgaggcaccttcagcgccaacgataactggaatccccattgagataccaactacggctgcgtgtgaagttaagccaccgttttcaacgataacggcgctagccttttcgatagctggcaagtagtctttgtcagtgttcttagtaaccaaaacgctgccttcagtagtcttgctgttagcttcttcagcgctgcttgctaatacggctttaccaataacagtgtcatcaccgacaccttggccacgtactaactttgaaccgatcaattgaaccttcatcaggttagtcgtaccgcgttcgccaacgggaacaccggcagtgatcaagatcaagtcgccttccttagctaagccggtttcaacagctttagcagctgctaaatcaaacatagcatcggtgttagctggcttttcagcaacgattgggtatacaccccagttaaccatcaagccacgacgggtacggtcatcgaaagtaacggccaagatgttagcatctggacggtacttgctgatcatacgagcagtgtagcctgattcagtagcagcaacgatggtcttaacgcccaagctcttagcaacacgagcaactgaagcaccaattgattcagtaacgtcagcattagctaagtccatgtggtcagtaccaaagtctttcaaagcattttcagccttgatgtcgatccggttcatagttgcaacggattctactggatattcaccgttagcactttcaccagaaagcatggttgcgtcagtaccatcaaagacggcgttagcaacgtcagatgcttcggcacgagtaggacgtgggttttcttgcattgaatccaacatttgagtagcagtgataactggcttgcccaaaacgttgcacttacggatcaagcgcttttgtaccaatggtacgttttcagttggaatttcaacacccatgtcaccacgagcgaccatcaaaccatcagaaaccttgatgatatcgtcaaagttgtcgataccttcttgtgattcgatcttagggaagatttggacatgttccatgtgcttttcttccaataattcacgaatgtccataacgtcttgtggcttacgaacaaatgatgcagcgataaagttgatttcgtgatccaaaccaaaacgaatatctgaagcatccttttcagtgatacctggtaagttgattgaaacgccaggtgcgttaacacctttacgtgaaccaagcacaccatcgttttgcatagtaccaactaattctttgttggcgtcgtccttttcatcaacaaccatgtcaagcagaccatcgtcgaataagacgtgaccgccaacactaacgtcgtcgaataaaccaggatatgtgaccgcgatcttatccttaacaccttctaaggattcgtccatagaaatccgaagcttgtcaccagtgtggtactggatcttaccgtctttttgaacagtagtccgaatttcagcacccttagtatcaagcatgataccaacagtcttaccagtaatcttttcagcttcgtggacgttgttcaaacggcctaaatgttcttcatgatcaccatgagaaaagttaaaccggaaaatgttagcgccagcctcaataagctttacgattgtgtcgacatcggtactagcgggaccaagtgtacttacgatcttggttttcttcataagaaaaatctctcctttgagtttaagactgatttacccttgtgataattatcacagctaaaccaatccaatttggaatccgtttgttattttagcacttttcaaatttaatgtctgcggtgttttctcaaaaactgaacatttccaccataaaagcgttttcatgccttttcttaagacaaacttaacgctaaattttaatttttcacctgtaagaccacgttatggtcacctaaaatttgttctaatggtgccactaattgctcactggctggcaaccaatattgctgatttaaaatccgtttactgtcatccgctacccggtaaataatcaccggagtctgaccttcatgtgactttaaaaattgattcaactcattcatggtcgccatttcatccgttacttcagttagcctcaagaaccaccgactcccctgcaacgctttagttgtggactgttccggttttaaaggcttgacctcggcggcttgagtgactgaatcagccaccacctgcagactgccacggttagtctccactttaccggtaacgacgatgacttgttcttttgccagccaagtagcaatgcgacgatacgtattcggaaaaacggtaatgctgatttcaccggtcagatcactagcggtcagaaatgccatctggtctccgcgcttggttctaatggtccggatacgcgtcacgtaaaccaccagcgtcacgtgctgatcaacactgagatcaccgaccgaaaccgcactgcgctgctgagctaagtcagcatactgctcaactgggtggcctgacaggtaggcacccagatactcgttttccttttccaaccgttcgttcagcggcagatccggctggtgcttgattttgggtgccagtgcttcaaacagatccatactgctgccggaaagttccacgctacttaagaattccggcagactggcaattaattcagctcggttatatccaaagtcgtcgaaagcaccagagtaaatcaatccttcaatgaggtcagctttcagccatttgggatctaatcgcagcaaaaactgatgcattgacttaaagttgccattggtttgacgctcagtcatgatactttgcagcaggtcacgacgcatccctttaatcgaagctaaaccaaagcggatctggttattttccaaccggaaatatgcaccgctatggttaatgttaggcggtaagatcttgacctgatgccgtttagcctccattagatataattttgtcttggcactattatttaagactgaattcaataaggccgtaaaaaaggctgccggatagtgtgcctttaggtaggccagctcgaaggccattttactgtaagcaaccgcgtgtgaccggttaaagccgtagttggcaaaccggtcaatataatcaaaggtggcctcagcggcttcaactttgtgcccaccagaaacggcaccatcaatgaaccgtttacgcatggcttccatggtggcttttttcttcttgctcatggcccgccgcagcaaatcggcctgacctaacgtgaacccagccatagccgaggccgcctgcataacttgttcctgataaacgatgatgccataggtcggcgccaggatcccctttaatgaatcgtccggataagtcacgggttcttgcccgaaccggcgtttaataaagtggtcaatgttttccattggccctggtcggtataacgcattgacagctgccaccagttcaaaattatctgggtgcagtcgtctcaaaacgtttttaataccgctagattcaaactgaaacacgccgttggtatcgcccctttgaaagagtgccaaggtgtcagcgtcattcaaattaatttggctaatatttaaatcgtgtcccgtctgcactttaacgtatttcaacgcagcagctaacaggctgaggttacgtaaccccagaaaatccatcttcagcaaaccgacctgctcaacgtagtccttggtatactgcgtcatcagcatggtttccgacccgttttgaaccggtacgatctcagtcagtggctggtcacttaacacgatccccgctgcatgagtggaataatgccgcggcagcccctccagtttagaagccgtttcaaacaacagtttattcgtcgctgaatctgccactaagttttgcagtggctgagactgctggtaagcatccttcaaggaaatgtggaagacactgggaatcgttttgctccattcactgagttcatagggacgcagaccgaacacccggcccacatcacgaatcgcttgtttggtggctaacgtcccaaacgtgatgatttgacccacccgttcatggccgtacttttggtgaacatattctaagacttcttcacggcggttatcgggaatatccagatcaatatcaggcatctgcgcccgttcttcgtttaagaaacgttcgaagagtaaccgatattgcaagggatccacatccgtaattcccagtacataagccaccaatgaaccagctgccgaaccacgaccagggccagtggtgatctgcgcccgcttggtaaattgcatgacatcccagacaatcaggaaatagtcgttgaaccccatacggtcgatcacatctaattcatgtgccaaacgttcttcataaggcttagcatccgtcacctgattttcccgcaaacgtcgggttaaccctgtttgacactgcgtcagcaagtaagtcttagctgacttgtgatcaggcgtttgaaatttgggtaactggggatgctgaaactttaactgcacctgacaggcttgagctacggtttcagttagctcagccgctgcttttaaccccagctcttcgtatacactggcatattcagccgctggtcgtaaccagtactgcccagtcttcttctgcgcatcggctaaattactgatagtggtaccgtccttgatcgcatttaagacgccaactgcaaaccgatcatcggcatctaaatagcgaacttcaggaagcgctacaactttgacccgcgcctcagcagccaatttggtcagcaactgacggacggtggccgactgagtgggtgcaacgccaatcaataaactatcagcatcaacgatttgacttaaccgcgccaataattgattcacattatcttgctccccctgatcaagccagtattgcaactcgctttcactgggtaaaatcaccattaaatcggcgaaccactgcttaacttgcgccactgtcaccggttcttggtcaggtcgcgtctgcaaataagacgaaatggccatcaaatgttggtagccagcctgattcttagccagcaaaaccattggaaacgtctgctcgctagcaaaaatgcccgctaagtcagccgttaaaccaatcacgggctggacgttgtacttctgacagatttgatagaactcaaccgtgccatacatgacgttgcggtcagtcagcgccagtgcctgatagccccgctgagccgcggttttcaccagttcttccaactggttggtactctgcagcaaactgtagctgctgatgacttgtaatggaacaaacgccatggttcatcggcttcctttctcgttaaactttcgaactccattataacagagtggttcattttaaagctttcatttttgctgacaatatgctaaaatttcttttgattgcgaggtgtctacaatgaaagcattagaagcaaacttggttgttatcttttgggcagtcatttttggtgaagtcatcggctacatcggtggccaattggaagttatgacctacgtacctgcacagattggtatcgtagccaccatcgctgccttgattttcaccaatggcgttaaattagttgcaaactcagatacaaaagcaaaaaattaaccataactaaaagcggtagtcccattattgagactgccgctttttttgtcttttcaattaattaatttcactatccacgtgctgatcactgacagttgaactggtcttaaaggtaatcccgttacccgcttcgttcatcgtcagttcaacgctgctttgcgcactgactttaccgccaataatcaacttcgctaacggtgtctcgacaacgctggtaatggttctttccaacggccgggcgccataggctggtagatagccgcgcttagccaaccaattggtggcttctggcgtaatggtcaacgtgatctgctgttcagctaatcgtgcagacaaccgctgaatcagcttaccgacgatctgctcaacatctgccatggtcaacggcttaaacatgatcgtgtcatcgatccggtttaagaattccggtttaaatgaccgctgcagcaaactagccacctgttttttggcatcgtctgaaatttggccctgagcatccgtcccctccagcaaaatatccgaccccagattagaagtcatgatcagcagggtattcttgaagttaacggtgcgtccctgactatccgtcaaacggccatcatccaatacctgtaataacaggttaaagacgtctgggtgggccttttcaatttcatcaaacaacacgatagagtatgggtgcctacgaactgcttctgtcagctggccaccttcttcgtagccaatgtagcccggagctgcccctactaaccgggaaacggattctttttccatgtactcagacatatcgatccgaatcatttcgctttccgaatcaaacaggttttccgccaaggctttcgccagttcggttttacccacaccagtaggccctaagaacaggaatgaccccagtggcttacttgggtcttgaaggcccgcacgcgaccgtaaaacggcatctgagacggcctgaacagcttcatcttgaccgatcacccgtttatgcagattatcggtcaagtgcagcagcttttcacgttccgtggcaaccaagcggttaacgggaatcccggtcatcttagccaccaccgccgcgatttctttttcagtcaccgattcttcaaccagccagtcaccggagtggtccttatcttccatggctgccagttcctttttcaattggggaatggtaccgtgctgcaagaccgctgctttatccaaatcatactgtgcttcagcttcactaagatcgtgattggctttgtccaactcggtctttttctgacttaaagcatccaaggactgtttttcatcttcccagcgggcgttcaaactcgacaccgtttccttcacgtcagctaaggttttctggacttcttttaagcggtctttagaagcttcatccgtttcctgcttcaaagcagcttcttccacctgcagccgcatctgctgacgccgagcctgatccaattcggtaggcgctgagttcatttccacccgaatcgatgccgatgcttcatcaactagatccaacgctttatccggcaaataccggtccgtaatgtaacggtcggataacttagccgcagccaccaacgcgttatcgtgaatccgcacgccatgatggatttcataccgctcacgtaatccccgtaaaatggtgatggtgtcatcaacggaaggttctgctaccggtactttttggaaccggcgttcaagcgcccggtccttttccatgtactgccggtactcatccgtagtggtagcgccaatcaaatgcagttcgccacgagccagcatgggtttcaacaggttaccagcgtccatactgccttccgtcttaccagcacccacaatattatggatttcatcaatgaacatgatgatatcgccgttagacttcttaacttcgttcaaaaccgccttcaaccgttcctcaaattcaccacgatacttggcgccagcaatcaacgaccccatgtccaaggaaaaaatcgacttgtttttcaggttctccggcacgtcaccgcgggcgatccgttgggcaagaccttccacgatggcggttttaccgacaccgggttcgccaatcaatacgggattgtttttagtctttcgagacaggatccgggtcaccgtcatgatttcttcatcccggccgataatgggatcccgcttgccgctgcgcatggctttgactaaatcggtgccatacttttctaaggcttgaaagccttcttcttgattttttgacgtgattttttcacctccacggatctcagtcactttgtttttcacttgctgcaaggtcaacccctgctcattgagatagtcaccaaaacggctaccgctcatctgaacgactgccagcaccaaggtatcgctagccacgtactcatcgcccagatccttgcgcacttcatcggccttctgcagcagacggtacaggtccggcgacaggttttgaccataagctacgttgctgccttcaacttcactgattgaatcgatttcgtggtctaattcggtattcagtttgtccatgttcagaccaagctcactaaagatctgccggtcaagctgacccggttggatcaaaaatttaaatagatgtgagactccaatcgactgctgtttacgattaacggcgatctgttgggcctccgcaatggcgtcagtgacggattgcgttaaaatatctgggttcattaaatgatcatcatcctttactgattatgctgaatcattcatttcttggttcattctatcataggtctccatgaaaataaaaataatttgaccttttttgaccaaactattttaacgggcttttcgccggtttttcggccgcttttgaaacacgtcgtcagctggtttgaacccccaaaatttgtgaccgcgataggtttgttcagcaagtttgccgtgaacggccatgtctttgccccgtttagtcttgatttgaaactggatttccttgcctgccagtagatccgccacttcttgctcggaaaaatggtggccaccccagacttggttgaagttaacttctttgccactggccgtctgaccgccagttttcgccttcttgggatagtgcttcaccagtttttccggatcacctaaattagttttcaatttctcagcattggccaccatgatcggtaaatcgtggtttaccgtctgcgtagccgtagtcagtagttctgtcggctctaatttaaacgcccccacttggtccatcaacgtcatcaaccgcttagtggcgttggtactgctgatgatggtgccttcggtgagaatagcagaaatggtgccggtatccgtcatggataacgctcctcgtcgttctttcattaacgcagtagtgcccgcggtaatctgtgacaacgtggacactcgggtagccccagtcccgatgttgtggtgctgcaagtagttcatcagccacttcatggttggcttcaccggttttttattagccccttcgaagatgaaaggcgaggcggttttacccagctgttgcttggcagccccctgttcctcatccgtgtcgctaatttgccgggaactgtcaaaaatcagcttgtaattcaaagctaccggaatgttaaaggcggtcttaaaggccggatagtccttcagttccgcggtagtatgatcaaactcatagtcttctcccagcatggccagatagttcttcgccaccaccgaataaatggcgggaccagacttgccgtatcttgctaaactgctcagtgaactaggcactttttcaccgggacggttagccccgtgatccacgctaccgttagtgacgtgggtaaaccgcggtttgcggtgcgtcagcaatcgttgatccacgtccaccaccgccgcaatcttgggtaccagcggcaataactgataaaactgcgccatggagatcttagaatcatccgtccggggataactgacgatcttggcttcatacatcttctgatacgtgctgagtacttctttagcactgtaccccttaggcgctaagatggacgccaggtttgagagatccagtaatttcggtggtgccgagtggcgacgcaccgttttaacgttggtaatggcactttcatggtactgttctagttcctgctttgcgtcggcttgcttctcgtgacgccatttggccgcttcctcttcgtccttaaaccgccggacaaaaacgtgttccgcattatcctgaaacttcacttcgtaaaacggcttgcgtttatagttcttaatggccatgagctgttcgtacacgtggcgcaccatcaaggacttcaaacgtccctcacgaactaccttgaccggatagcccgcctgtttggtcaccgtggtggcaatccgcgttagctgcatagacagaaagtcccatttgctgcgggcatccgactttaagtagtcaccatcctgcatttggctagtaatcggcttgatctcccgaaagccgctttgaatcgaacgggcttcttcatccgcgaaatacagccgttttactggcttttgccacttaatagcattaataatctcccacgctagtagttcgccttcaccggaaggatccacgtcggtagcaattaccagcgattcacaatcagccaccgactttttaatctcggctaaatctgacttagtggattttttccgccccgttcgcggattttttgccatgataggccgtttctcccaactgaaatcgttgatctgccaaggcaagtgttccaatttccacgaacggtactgcgtcgctttttctgctggcacctgatcttttgggtcaacaaattccagcaaatgaccatgggaatgaacaattcggtaggtgtgtccttcaaactcaccgctggtaccacctagggcgctcgcgaagttcttggccgcactggctttttcacataaaatggcgtactccgtcatgaccctttcccccttataatttaaaagagttttagcagtcgattaaactgttaaagctcctttggactgtactatgcctgtttagcatttaaactaatgatctttaaaatcacatccgtggcttttgccatggtctgttccgacacgaattcaaaccggccgtgcatgttttcaccgccagcgaagatgttcggtgtgggcatgcctaaaaacgagatcttggaaccgtccgtaccgccccgcactggcgcgatgtctggtttgatgtccaggtcgatcatggcttgtttagccagctccaccacgctcatgtctttttcgataacttcgcgcatattataatactgatctttcagtgtcacttgtaccgtaccagcaccgtatttggcgtttagctgatccgcaatcccggcaaacaatttcttacggtcctcaaactgctgacggtcgtgatcacgaataatgtaccccaggtcggccgtatccacgtcaccgctaattttgtagaggtgaaagaagccctctctgccagccgttttttcgggccggtcgtgttctggtaaagcgttatgaaaatcgatggctaattggttagcattgaccatggtgtccttagccgaaccgggatgaacgttggtcccggtaatgtggactcgaccatccgccgcgttgaaggtttcgtactccaattgacctagtggcccgccatccacggtataggcgaagtcggcaccaaagtctttaacgtcgaaatgatcagccccagtcccgatttcttcatctggtcctaaccccactttaacggtaccgtgcttgatttctggatgggcgactaggtaagccatagcggtaacgatttcggctaccccagacttatcatctgaacccagtaacgttgagccatcagtggtaatcaaagtttgccccgcgtaattcaacaaattgggaaatacctggggatccaacgtatatttgccagctgaatctagtttaatcaccgaatggccgtcgtagttttcaacgatctgcgggttgatatccttgccgttaaagtccgccgtatccacgtgggaaataaagccaatggtgggaacttgttcactcatattgctgggcagtgtcgcaaagacgtaaccactagcgggactcacatgcacgtccgtcaacccaatatcagtcagttctccggccaaagttttcaaaaagtcgacttggttttgagttgacgggacggtatcactatcttcatcggaacgtgtttcaaccttgatatactttaaaaaacggggaattagctcgtcatattgcatcgtcgtcaccctttcaaataaacgtaaatggatcggtatttaattttgatggttcaatttcaatttgccactggttttgctgtgcccactgcttaaaaagagccgttaagtggggcttgcagatactttcaatgtggtgaccaggatcgatcactgggaaatgagcggcaatcatatcgtggccagtatgataataaacgtccccggtcacgtaggcatcggcaccctttcgctgagcgatcttaaagaatttcccgccgtcgccgccaagtaccgcaatccgttgtacgggcttatccatgtcatcagcaatgacccgtaaaccgtcaacgttgaaaacctgcttacagtgttcagcaaactctcgcaccgtcattgtcttagacaaatcaccgatacggcccatactaaattgatgcccttcatgatctaatttggtcagttcaagggctgggtgaccgccggggtaaacctcgttaacagcagccaccacggcctgcaatttcgcattcggcacccgcatctgaatcgccagttcatcggtactgttgcgttcaccaacggggcctaactctggatcagcaccctgcatcggcgtaaaccaagtggtaccgttccattcgtagctggcaccagcataccgcgccatgtcaccggctccggcacccaccatggctagccgcactgcatccgcatagaccggctgcacgtgaacggtcaggagataattagtttccgtcacgccatccaccaagccaaccgtgttagttaagcctagcgcttctgccagccagtcgttcatcccgccctcggcactgtccagattagtatgggccgcatacaccgtgatgtggtgttgcaataaggtggcatacatctggttttgcgggtcgtccaagtctaaattacgtgccgggtgaaacatcaccggatgatgagcaaagattaagtctgcgcccaccgcaatggcttcgtccaccacttctggccgcacatcaagcgtcacaagtactttgtgaaaatcagcttccagtgagcctaactgtaaaccaatgggatctttcggttcagcaatcgtttttggcgcaaactgctcgaaccgttcaattaacgttttaaccttcatttaaaatgacctcctgaatttgatcacgttcccgtttaaaggccgcaatttttgcttgcggtgcgttttttgcctgcttcatggtagcaatcacttggtcaagccgggcttgttcttgacgccacttctgttgaagaaccggactcttttcccgtaataagtaaggaccaaatttcagttccgtagccgtataagtcactggtgtttcaaccggatcagccacaataatttcgtaaatgtgaccgtcttcggctaaaattcgttccgccacgatttgatagcggttattctgcagccagcgccgcacgttatcttcacccacattgggctgtaaaatcaaccgttcatggtgagttaaatgcgacttgccactttctaaaatattcgtgatcagcgtaccgcccataccggcgatagtgacagtgtcaatcttgtcgtctggctgaatggctgctagtccgtccgccaaccgtgccgtaatcgtatccgtcaactgctcattttcaatctcagttaacgcattgtgataaggtcccttcaccacttcgccagcgatcgctgcagtaatgataccctgtttggctaaatggactggcagataagcgtgatctgagccaatgtcagctaaccgtgcgccaggtgaaacaaaatcggcgacggtttgtagccggttggataaatgtgtcccgttcatacgttcattcctccacttcaatctcgtaattccattataggctagagcccgaacctagcacaacattagatactgtttttgtgggctgttgatgtgaatccctctgtacaaaaaagtacggcacagtcgttaaaccgtgccgtactttttaatgacaaattattttgcaatgactgaatcactcatcatcgcgtttacgccgtttcagaccaaccaaaccaagcatactggtcaataacccgaggacacctaagcccaccgtggcttgactttgctcattggtttgaggcaatttatgctgagcttgtgagccttgttgctgattggtagctgaagcattgctgcgagtttgcgaaactgaaccattctgactctcagccttcgcagtggttcccgtagttgatcctgcaccagctgctgcagaagtcttcaatccttcagcagttcctgcattgctgccactttcagttgatgactgcgaatcatcaccattcgtctttccagatgtcgctgttcctggagcgggcgtcccaggcgtggtcggctcagttggtgtaccagtcgggttaccacctggctgtttttcaggaacaccggtaccatcagatggaacggatggctccgttggtagacccggttttgttggctgtgacgtaggtgtgtaagtaaccacaacgtcctcgttatacattggcacatcttgtgcaaccacgctgcctaaagcttgctgagcaacttgacctggttttacagtataacctgtcaaatcaggcgcagtttgctcgtaataagctgccgttggcgtagcaacactcgtaccagtgacttcatccgtcacaacattccaagttaccttttgaaccgttggtgctggaacctcaccagtatagtttggatcattcacaacgtagtgaatcgtccgcgtggtagtggttgtagtataagccatcgcgtgagtcaaatgaatctgaacgggtgcgttgtcgccagccttgaacgtatacgttccgttagccgcttgaccggtagccaacgtgtatttagcaggcttgttatcggtgttccaacttgctgtaccatcagtgacaccttctagcttcgttggtgtgccaacaacagcaccgttgttagcatcatccacgtattccaccgtggtgctttgcggatcagccttaaaggtgacggtaacgttggcatctgcaggctttgtagtagtaaccgcattgacaccagccggaaccgtagtcttatctggagtatagccagctacccgtggcgtatcaacttcgtaatagttaccggatggcgtgtacgtcgtgtcaccagtcacttcatcggtatttgtcgtccaagtaattggctgaactttgactgctggattttggccgttggcaacaccggtgtaggtgattgtccgggttgtggtaccggtaaagccttcaggcaaatcagttgtgtgcttgtgcgctaacttaattgtcagattatccgacgtatctgttgtaaaggtatatggtaccgcctcaccttgtccgggtgctaaaacgtaattagcaggtaccgttacggtatacgtacccgttccatcggtcttaccattgagtgtttgaacatcaccgatagtggcattgccattatcaacatcaacgtaggtcaccgtcaaatcagcattaccagcactgtaagtaactgtttcatccgtatcttttggcatggtggttgtaacagcgttagtttctaccggcacactggctttatctggtacatagccagtgatattaggggtgtttactgccccgtaatcgcccgatggtgtataagtcgtgacaccggtaatttcatcggtatcagtcgtccacgttacggattgaggaactgagtctgggttctttggtgcaccagtataagtgattgtccgcgtcgtggtaccagtaaagccttcaggcaaatcagtcgtgtgcttgtgtgctaacttgatcatcagattatccgacgtatctgttgtaaaggtatatggtaccgcctcaccttgtccgggtgctaaaacataaccgtctggaatgactgctgtgtaggtacccgtttcatcagtcttgccagtgattgttacaggagtcccaaccactgcattgccgttatcaacatcgacataggtcactgtcaaatcagcatcgccagcactgtaagtaaccgtttcatccgtgttttttggcatagtggtcgtaacagcgttagttcctaccggcacactggctttatctggtacatagccagtgacatttggcgtatttactgctccgtaatcgcctgacggtgtgtaagtcgtgacaccgataacttcatcggtatcagttgtccacgttacggattgaggaactgagtctgggttctttggcgcaccagtataagtgattgtccgagtcgtgctaccagtaaagccgtctggtaacttggtcgtatgagcatgcttcagcgaaatagtaatgttatctgacgtatcaaccttaaaggtgtagttcaccgaagttggctgattagcgtcaaacgcaacatatccagctgggataaccaccgtgtaggtaccggtctcatcgaccttgcccgcaagtgtttccggcgtaccaacgaccttattattgtcatccttatcaatataggtcaccaccaagtcggcatcgtttgctgagtaggcaacggtaacatggctatctgtcggcactgtggcagtggcggtatcagttccggccgctactgttgctttatccggggtataacccgttatcgatggtgaagtaactgccgcatagttaccagttggtgtgtatgtggtgatgccagtcacttcatccgtgtctgccgtccatgttagtggctgactgactgaaccagggttcgtaggcgcaccggtataagtgattgtccggtgagtagtgccagtgaagccctttggcaagtcagtcgtgtgtttgtgcgccaacttgattgtcaggttgtcggacgtgtccgtgcccgctttaaagatgtatgataccgttccgtcttgtccagcagctaaaatataattatcgggtactttaacggtataagtaccagtttcatcagtcgtgccattgagcgtttctggatcacctacgaccttatcattgttatccgtatcaatataggtcaccgttaattcagccgaatcagctgtgtaagtgacagtaatcggaatatctacaggcttagtcttggtaaccgcattggtaaccgctggcacactgtctttatcaggcgtgtagccaggaatgtctggcgaattgactaccgcgtaattgtttaaaggcgtatacgtagtaactttagtgacttcatcataaccagtcgtccagttggccggctgactgacagaagctgggttgccgctagtaacacctgtgtaggtaatcgtccgtgtagaagttgcagtgccctggtcaataatgtgcttcaagtgaatctgaactggcatattactatctgctttgaagttgtaggttccgctggtaacctgatcctttgctagttgataaccagctggcacctgatccatgctccaatcgatggaaccaccaggagcgccagaaataacctttggcgtacctacaatagcaccgctgttatcatcatcaatgtattcaacttgtgtgctgacgtgaccaactagttcatactgaacaaaatcgccatcgtagttagactgcgctatttgcccaaactcagctacaccatcagttgaaccatcaacaatcgtcggtgttattttacctgaagcatccgtcaccaattcatagccatctggaattaaatcctgatcggtagatgaaaaatctgaaagttgtttaggataatcattcgtaaatgtatctaccccatcgttaagtgttttactcagatcatcaagagcaatatattgatcatcaccgttaacatcgacatagtgataccgtgccttaacggttgaagtacccgtaattgtgatagaagcttctttacttgctgaactaacatcagctggagcaccatctccgtagaaaatagtctgcagataaccagttttacccccttgctgattgaaattatcagttgtcccaacgatgggaattctgcctgtagaagtattagctttgattccggtaaactgaattacaattgaccgaatcgaagaccaatcattttcacctatttgatcagcggtcacatagccagttgtatctggggcagttgcattagcattgactgtctgtagctgtgtagaatacaaaacagttgcatccattggggtgccatcaccatttggagtcgtgtaatttgctggtaatttaatcggacccgtcagattaaatgtatactgcgatccgtctttacctgcagttggcaaattaatagcaacacttgcattatgttcactagggctatcacttgatggagtgtaaacgataaaatcgtaaaactttaatgattcatcgccttgtttatcactagtaccattctgtacagcatcaatgttttgattaccctgcgctaacgtagaattgaaaaatgaaggagcagtttcaatcttccagtcaccatgaccattttcaccagccaataggtacgcattaggattattttcaacaaatgaaagatcagtaggcttcgtcgtattcatcaactttgttgttggtgaaacaatgtaaatagagtatgggtaactgcctggtaatgcatcaggatcattagctaatgtaaccgcaccccaatgaccagttacctgacccatatcaacagtggttccagttcctgcatagtcaattttaacaacggtctgaccattgtctgcagtaaattctgagacttttgcaccagttgccttagttaacaacgcaccggttggatcagtagtcgctggatttgtaactggatcgtctgtataccaccctaaactattaatagaagcaacggtcgttaccttcggaattacaaaatagaaggtcggctcatatatcttatttgtggtctgacccaaaggatcattgtatctaatctgaagggtaccagcacttggattacctggatcagtactacgagaatgaggcaccaaatagccttgagcaagtgcaacattgtccacaattgtttgagtagttgatgctgaagcctgtggcgttacaccgttagcgtcgaaagcaatttcgagtttagatgttagttggtcaccattctttagagctgtcccattatcatacttagcggataattgaccaacggcattaaaactataatctttacccaagtcattagcatatgaacctggtgccaatttgtttggtgaaaaaactgcagttctaattggagaatttttagtgaccttagcttcatctcctgcattaacagttccagtttcagtagttccatctgccaatgtaaaggtgtagctccaactagaggtatctggcatataacctgatggactgataccttgaacaggtgtcttaatactagtaatatctaacccactaggaattgtgattgtaaatttagcatttttagcctcagctgctgaattaaatgcaaagccaaaactattgaggtactgaggattatcactagcgtcctgaccaagttcgagtttatctggagcgagagaagaattacctttaatggtaggtactcctctactctcttgcgttgcatcagcattggctgcaagaatagttacgctccaaggatcagctgaatcagtcaatgttccaccatcagagttaatgacttgagagaaggtcacatcactatcagcagtaagtgtttgattaacatcagtttgactcacatcaaaagcaccaaccagtttgtattttggcgccttaccttgatcctgttcgtatttttggtttccttttccggcaggaacatcgataataacattcgttcccttcccaccaggttgggtaattgttgaaccatcaacaagtccgttaatttgatttgtactattagtgtccaaaacaaaacctgttggcaccggaattgtgattttcgcaccaccatagttaaccgcactatttacacgataagtagctgaagtatcgtcttgaataccatcagcttcattcacactgacaccaaaaacgtaattttggttaggtaaaattttggtaaccgtctgtgaatccggatacaacaacgaaacagtcgataagttagttataggttgaattcgttgggtaaacgtaatcggtgtttggctcactccgtttactgaataggtaattgtcttagtcactgtcttaccagcatctggtatgacactatactgataatcggagttattccctaaattaattttaatgacttgattggtagtcgcattggttgtgaagatatcggtaatcgtgtgtgatccatcagcattctgaactgtagttgtattcccaactgaacggtttaaaggaatggcttgatcaaaagcatacactggtgtattcgcaggaatattaatctcatatacatcgcccgctttagcattaacattcaagttaagcgttaacggactctgcgcattagtaccatatcccacagcgttagttgaaatcgtcaaaggtgcagtagtagctggttcccctgccaccgcatcgatttcctgtggttcatgagttgcagcataagttgctgaagcactagcctttgctgcattcaattgatcttcagttggatcaaccagcgttttggaagctgttggttgtgttgtcgctggcgttgctggctgttcagtagcattgtttgctggagtagttgcggagccactgtttggcgccgttgtattttgtgccgtattgttaccattagttttcgcggtagttgcaactgaatcacttgttgctggcgcatccgtttttacaggattagcattttcactggctttcgaagcagtattgttggttgcagttgtccctgcgctgtcagcgtttgattgattaccgacatttgacttcaaagccactgagctagctgtttgattggcaactgctgcatcgccagtctcattagacaccgtttcgtttggatcctgcgtattagtagtattgacagcagcataagtggtcatactgccacccagcaataatcccgcaccaagtgctaaactagcaaggctcgcataaatccatcttgttccagccttgtacgatttataatgttctttcaaattagacttaatcgtccgaatatgattatttttgccaaccattttaatatcccccttaaaaaagttgtttacctacttaactaaattaattcattaaaacgcgtcgccttaacgcttacttaaaccccacatgaactaacaaaatcgaccctgtttattgtaatttttcatcattctcccccttttttcctttattgtaaggttaatcatttcacaagtaaaggcttacaaatgaaattaaaatgattttttaattaaattttaatgattataaatttaagatttacatggatgagatttctccatcttcgacacacaaaaacaccttgatcaaggccactttcgaccctaatcaaggtgtttatttatattactcagtttaattactcatcatcacgtttacgacgtttcaaaccaactaaacctagcatactagtcagcaggccaagcaaacctaaaccaacttcggaatgattttgctcattggtttgtggtaacttgccttggctagcagcagaagtcttggattgactgcttgaaacagttgctgcagcaccgttaacgtcctgcgtcgttccagcgtaaccagtatttccatcagtagttcctgatgtgccagcatttcctgacgttgctgaacccttttcgcctttttcaggagtcgtcgagattgcttcaccaggagcaggtgtttccggcacaatttctccggtaatcgttcccgtccccgttggtccttctggtgtcgttggtcctgttggctcagttggttcaccagggacaccctcgccatctgatggtgtcgtctgtacatcaggcgtataggtgacgacgacatcttcgttgtacattggcacatcacttgcagccacactgccaagcgcttgttgaccaactttggtttgactggcagtgtaacctggcagactaggcactgtctcttcatagtaaccggtttgcggcgttgcgacgctgacacccgttgctttatcagtggccacgttccagatcactgtctgaaccattggcgctggcgtttgacccgtgtagttaggatcatcaaccacaaagtgaaccgtccgagttgtcttagtcgtggtgtattcaatcacgtggttcaaatgaacctggatcaattggtcactaccggctgtaaactgatacgtgccgctgccagcttgaccagcagccaaactgtaaccggttggcttattgtcagtattccaatcaactttcccagaagttttacctgaaagcgtcgttggtgtgccaacaactgcgccatcattatcgtcgtccacatattccagggtgacagtttgattatttggcgtataagtgaccgttgctgtttcgttgtctggcaaggaagttacacccgtataggactgttgagcaacactcagcggatcggcggtatagccatcgagcgttggggctgtttcttccgcataaccactttgcggaatggcaaccatatgcccgttgacttcatccgttgtcacgttccaagtaatcgtctgcgtcttggctgccggaacctgaccggtgtaattaggatcgtcaaccacatacgtaatcgtccgggtagttgtggcagtggtgttatcaatgatgtggctcaaatgaatctgaaccgtttgattatcatcattggtaaactgatacgtgccactggttgcttgacccttagcgagtttgtagccagttggaatattatctgtgttccaagtagctgtgccagaagttttaccgttgatagttgttgggttaccaacgactgcaccaccattggcatcatcgacatattcaacttgagctgattgaacatttggtgtgtaggtcaccgtaactgtttctgggtccggtaatttacctttgattgcagcaccataattctgtggctgaactgtctttgaatctgcagtataaccagggatttctggagtgttctgactgctataaccgctctgtggaacggcgacactagcgccattaacttcatccgtcgctacgttccatttgatcgtctgcgtctgagtttcaggtacttgtcctggatagtttgaatcgtcaaccacatagttgatcgtccgggtagttgtagcagtagtgttatcaatgacgtggctcaaatgaatcttaatcgtctggtcactgctattcgtaaactgatacgtcccgctagcagcttgacctttggcgagtttgtagcctgctggcaagttagttgtatcccaagtagcggtgccagaagtcttaccagtgattgttgttgggttgccaacgactgcaccaccattggcatcatcgacatattcaaccgtagcgcttgctttatttggtgtgtaggtcacggtaatcttttcaggtgctggtaaattatccttcagcactgccccataattcaacgtttgaactgtcgttgggtcagcggtatagccgttgatcgtcggtacatcttgctttgcgtagccgctttgtggtacagcttcgcttgcgccagttacttcatccgtggcaacatcccacgtaatggtttgcgtctgcgtttcgggtacttgaccggtatagttagcgtcatccaccacataggtaatcgtccgagttgtcgttgctgtactgtaatcaatgatgtggctcaaatgaatctgaaccgtttgattaccggcattcgtaaactgatacgtcccgctagcagcttgacctttagcgagtttgtagccagctggcatattatctgtgttccaagtagctgtcccaaaagtcttaccagtgattgttgttgggttaccaacgactgcatcacccttcgcatcatccacatattcaaccgtgaccgtttgagcatttggtgtgtagatgacggtaactgtttcactcttcggcatctgaatggttgcgacaccgccgtaattctttgcagcaatcaaagtacccgcagcgttatcaattgttgcggtatagccaggaatcgtgggaatggtttgagcagcatagccaccttgtggaacagctacactagcgtgagtaacctcatcagttgccacatcccaagtaatggtttgtgtttgcgtttctggtgtctgaccaggatagctggcgtcattcactacgtagttaatcgtacgggtcgtcgttgccgtcgtgtaatcaatgacgtggctcaaatgaattttcaccatttgattatcatcataggtaaactgatacgtcccgctagcagcctgacccttagcgagtttgtagccagttggaatattatctgtgttccaagaagcggtgccaaaagtcttaccagtgatagttgttggattaccaacgactgcaccacccttagcatcatcgacatattcaaccgtgaccgtttgagcatttggtgtgtaagtcaccataactgtttcattcttcggcatctgactcgttgcaacaccgccgtaattctttgcggcaaccgtggtaaccgcaacgttatcaattgttgcggtataaccaggaatcgctggaatgttttgaacagcatagccgccttgcggaacggcaacactagcgttggtcacctcatccgttgccacatcccaagtaatgatttgtgtttgcgtttctggtgcctgaccaggatagctggcgtcattcaccacgtagttaatcgtccgggtcgtcgttaccgccgtgtaatcaatgacatggctcaaatgaattttcaccatttgattatcatcataggtaaactgatacgtcccgctagcagcctgacccttagcgagtttgtagccagctggaatattatctgtgttccaagtagctgtgccagaagttttaccgttgatagttgttgggttaccaacgaccgcaccacccttagcatcatcgacatattcaaccgtcaccgtttgagcatttggtgtgtaggtgaccgtaacagtttcattcttcggcatctgactggttgcgacaccgccgtagttcttggcggcaaccgcagtcgcagtacccgcaacgttatcaattgttgcggtataaccaggaatcgttggaatggtttgagcagcatagccgccttgtggaacggcgacactagcgttagtcacctcatccgttgctacatcccaagtaatggtttgcgtttgcgtttctggagcctgaccaggatagctggcgtcattcaccacgtagttaatcgtacgggtcgtcgttgccgtcgtgtaatcaatgacgtggctcaaatgaatctgaaccatttgatttttatcgttgttaaattgatatgtgccagtagctgcttgacctttggcgagtttgtagcctgctggaagattgtcggtgttccaatcgactgtaccagacgtctgaccgctgaccgtttctggcgtaccaactactgcgccgttgttactatcatctacatattcaacgatcactttttgtgcatttgcatgataggtaatctcggtagcgtcaccgcctggaatgtcactagcgtccataccgttataagtcacttgatcgactttatcttggtttggtgtatagccgttgattgtcggcacagtttgttcactatagattcccgttggggtagcgaaacttgtgccagtggcttcatcagtggtgatcttccaagtaatggtctgtgtctgagtttctggcacttgaccagtgtagttcggatcatcaaccgtataggtaatcgtccgggcggtctctttcttaccgtaatcaataacgtgattcaagtgaatcttaactgtttgattatcggtgttcttaaattgatacgtgcctgaagcagcttgaccttgggctaactggtaaccagccggcaaattgtcggtgttccagtcagctgtgccagaagtctttccagtaatcatcgttggcatgccaacgactgcaccattgttgccatcatcgacatattcaacagttgcttgctgcttgtcagcatggtaagtgaccgtgacggaatcatcatctggaataccactagcagccataccgttgaaaacctcttgatcaacctgagttttatcaggtgtatatcctttgattttcggagcagtttgctcactatagatccctgttggagtagcaaaacttgtcccagtggcttcatcactcgtaatcttccaagtaatcttctgcgtctgagtctctggcacttgattggtgtagtttagatcatcaacaacatacgtaattgtccgcgtcgttgtcttggttgagtgatcaagaatatgggtcacatgaatcagtaccggttgattattatcagccgcaaaggtatagatcccactggttgcttgaccagcgaccaactgatatccagctgggatagttggcatcgtccaattggctgtagcacctggcgcgcctgagatattctttggggtgccaacaaccgcgccaccgttattatcatcaactaatttgacctgcgcactggtttcacccaccaattcatactgaacgaaatcgccatcatagtaatattgagcgacttgatcaaatgcagctttgccatcacctgacccatcaataatagttggcgtagctttacctgatgcatcagtgacaagcttatagcctgttggaatcaaggcttgatcatcacccgaaaagtcagcaagtttagtcgggtaatcattctcgttaaaagtatctttattatcgttaagggtcttgttcaaatcatcaagatcaatatacttgtcagcaccggtactgtcggtgtaatgataccgcgccttaatcgttgaagtccctgtaatcgcaatcgaagcatcgcccttaggattaacactggctttggcaccattgccgtagaaaatagtttgtaaagtggccgttttacccgcttgctgattgaagttatcggttgtcccggtaatcgcaattctacccgttgaagtattcgctttaatatcgctcatttgaatcaaaattgaccgaattgaagaccaatcagttacttgatcagctggaacatatccggttgtatcaggagtcgttgccgttgtcaccgcttgtggctgagttgaatacaagactgttggattaattgcagtaccagtaccatcaccattcaccgttgtgtaatttgttggtacaacgactggcccagtcatcttaaatgtataattctttgaatcgcttgccgttggtaaattaatggcaacgctggctttgctatccttcgcatcctcatctagcgaagtataaacaacattatcgtaaaaggttagggccgtatctccttgatcatcactagttccgttgagaaccggatcagtatcggtattacctttggcaaacgttgtgttgaaaaacgaacttgcagtgacaatgtcccaatctccggaaccgccctgcatcaaaagcgcattagggttcccttcagtatatgaagtatcaacaactttagtcgtatttccaagtttagatgttggtgacacaatatacatcaggtaaggatatttaccgggcagtgcatccgcgttgtttgttaaattaactttagcattctgtccaggatcacctatatttgtattaatggtcacaccagtacctgagtaatcaacttttgcaacggtacgaccatcatcggctttaaaggtactgattttagcttgtggccaaccggtgatacttttaattgttgttgctgttgggataacaaagtaataggttggttcaaaaattttagttgaactttgtccgtaatttccaccttgcgctcttaagtcgttgctatcgccagtgtaacctggcatcgtacttttttggtccttataccccattcctagcgcaaccgcttcaacgacggtttgctttatcgacgcagacttggaaaccgtcgttcctggatctgttgggtcagcatacgataccgtgattgttgacgtgagctgatcgccagtttgaactgggtccccattatcataagtatgagatagtgccccattaacaaacaggcttgtagaattagctccactggctttaaagttagctcctggtgccagagtattcggtgttaaaacaatggttctgattgacgaagcagatgatggtgtaatctttccacccgcatttaccgtaccagtttcagttgacccatccgccaaagttaaggtgtatgcatagcttgtagtacctggcatgtaaagacttggtgttattcccgaatcaggcacttgaacactcgttgcgtcaagaccatcaggaattgtaattttaatttgagcacccgttgtatcactaggcgaatcatatgtcagaccatatgccgaaagatacgctggatcatcagtgggatcatcatcaagtagcagagaagtatttgaagccttagcatcaggagttgtactgttaccaaccgcagagccaccagtattgactcccaaaattttgacgctccaaggatcaccagttgccttcaatgtatcgttatcggaattcatcacttgattaaaggtcactgggctagtcgcagtgagcaccgtatcagtagctggttgggtaatatcaaacgaaccaataaatgtgtatcccttaccatcattttgaccattttgatagttttgataccctgtccctgcaggagcagtaataacaagatccgtaccaggcccattgggttgcgtaatggtttgaccatccgaaaatgcattacttgcattagtttcatcaacatctaacttgaaacccgtcggcacaggaatagtaatcgttgtaccaccataattatctactttattaatccgagttgaagggtatccattatctaaaacgccattaggttcattaaccttgattgagaacatgtaattcttgtctggcaaaactgccggcactttctgaacgttcggaaatgtttgaacaactggcgataagttaacggttggagtgattgtctgtgtaaaagtaacgggcgtttgggcaaccgtattctctgaccaagtaatcgtcttagtcactgttttaccaacatcattcagggttccttgacctaaataattattgtttagagagaaagtaattacttgagtagttggagtggtagtcgtgaaaacatcagtaatcgtacgagtaccatcagcattttgagcgaccttcgttgtcccagcggctgctgctagtggctgcacagacttgtaaccaaaaacgccgctgtcggccggaagattaatcacataggtgtcacctgcattagcagcagctttaaatgtcaccgtaaatgaatctttagcaccagaattatacccaactgccggtaccgataccgtcagcgttgcatccgccgtctgtcccggatctcccgccactgcatcaatctcctgcgcctgatgagtcgcgtcataaacttgttccgcgctcttcttagtcgcattcagctgttccttagttggattaaccaatgtcttggaacttgctgacggttgcttttcctacgaactggccgctggcgttgcatccgcagttggtgtacttactggcttagtagccgttgcatcacttgtcgttgcaggtgtgttttgtgcagcagtatctgcactcttcccaacgctcgcggtagttgtatcactaggttttacattagcgctaggctttacatcagcattagcgctttcatttgcattatcagttgcttgtttatttgaactatcgacagcggtcgtattgctagtatcagcaaccgttgtacttgctttcaacggtactgtacttgctgtttgcgtcgttgccgcactgccagcatccttagtcactgatgcagccggatcctgcgttgtcgtcgctacttcatcagcgaaagctgttgtgcttcctaacagtagacctgctccaagagctaaactggcaagactcgcataaacccagcgtctaccagccttgtatgctctataatgttcttttaaattcgacttgaccgtccgaatatgattatttttgcctaccatattgataccccctaggtttgtgacctactccaaatcatttaattaatctgtctattttaatatcaaaaacaatgtcgagacttaaaaaagctcctagtaaaatatcaactcgttaaatttaatgttatttgtcatcattctcttcctcttctccatcattgtacgggtataaccgttataagtaaagcacattaactaatctaatctctctatttttttaaattattgcaaaaaaatgagagactcatttccttgaaaaatcaagtagccgttattaatcaaaaaaagcgaaagcaccttgatcctagtcatcactgactgagattcaaggcactttcgcctaatacgaaccatgtttaaattcttatcgttttactcatcttactccaagaaatccttcagttgctttgaacgtgatgggtgacgaagcttgcgtaaggctttagcttcgatttgacgaatccgttcacgggtaacaccgaagactttgccgacttcttccaaagtacgagtccggccgtcatccaaaccgaaacgaagacgcagcacgttttcttcccggtcagtcagggtatccaagacactttcgagctgttctttcaacagttcgtaagcagcatggtcagctggactggtagcatcgtcatcttcaataaagtcacccagatgagagtcgtcctcttcaccaattggggtttccagagaaacgggttcttgcgcgatcttcaagatctcacgaaccttttccgttggcatatccatttcagcaccaatttcttcaggcgtaggttcacgacctaagtcttgcagtaattgacgttgaatccgtatcaacttgttgatggtttcaaccatgtgaactgggatccgaatcgtccgggcttggtcagcgatggcacgtgtgatggcttgacgaatccaccaagtggcgtaagttgagaacttaaaccctttacggtaatcaaacttctcaacggccttcatgagacccatgttaccttcttgaatcagatccaagaactgcatgccacgaccgacataacgcttagcgatggaaaccaccaaacgcaggttagcttcggctaattcttgttttgcttcttcgtcgccctgttcgatccgtaacgctaaggcaacttcttcgtcggcagttaacagtttaacacgaccgatttccttcaggtacatccgcactggatcgttgatcttcacgccagatggtgcagaagtatcctttaattcactagcactgactttcttggcagctttaacggcacgtgaatctggatcaccgttttcgtcaacgacactgataccagcatcttcgaccttttccagtaaaccgtccatctttttggcacttaagccaaatggtgaggcaattcgatctgaaagttcatcataggtgacttgaccctttttcttgaagtcttttaccaggtccttaacggctttatcgtaacctttttgatcaaacgccttgcttgtcgtcttgctgcttttctttgtttcttttgccattagaaagccccctaagcttgtttttgagactgcttttgttgctgtagcttaatatactcgatcacaagttgacgaacgcggtcgttatcgcccaaccgccgtgcttcttgtaatgcctgttctgtttcgccaatttttttggttagcggtgcgacattcatgatcaactgaatataatcatcgatctcgccctcgctagttgattcatttaactgcatggattcaatatcgatcaccaggttttgtaaatgatcatcgtggataaaatcaacaaactgtgctggcgcgtaactctggtgggtctcaaagtacccttgtgccagggtatagatcagctgataatcatcgtcaacaaaattaaactgtggcatcccggtcacccgcagccacacatcgtggtcgtggagcatccggtacagcaacgcccgttcagctttttccaccggcgttcgcttaaccacttgctgttgttgcgtctgtggctggctttgaccggtattaactgctggtcgtgctggccgttcaggcgcctgcttggctggtttcaccatggctaattgctggcgcaggctactcttatccagttgaaaactatcggccagctgggtcagataaacgtcttgctcaactggcgacttcactgttgcgaggatagccaagatatcattcaagtattgaagcctgccagtatccgtatcgacatcgtactgggtcttcaaataccgcatctcaaaggccactggtgtttcgcgagcggattccaacgcgctggctaacttcgcctcaccgtacttttgccggtattcatcgggatccattccctcaggcatctgaatgacacctaacgttaaactggaattatcacgtaaaatggatagcgcccgttgcgtcgccttttgacctggcgtatcaccgtcatagcaaacgtaaacttgcttggtgatccgctgaatggcgtagatctgctcttccgttagactagttcccatggaggccacaccattatctacacccgattgatgggcggacatgacatccatgaacccttcaaacaagatcaggttaccctgcttgcgcacggctccccgcgccagatcaaagttaaacagtaccttacgtttattaaacaattcggtttctggactgtttaaatacttgggctgatctggcatttgtttcaacatccggccagaaaaagcaatctcctggcctgactggttgcggatgggatacatgatgcgatccacaaaccgatcacgtagttcaccatcctggttttcaatgaacaaaccggaatgccgcaaagtctgataatcgatcttgcgggtttcaaagaacggcttcagcagttgtttgctgggggcataacccagaccgtaatctgaaatcgtttggtcagtcaacccgcgctgatgcaagtaatccaacgctggctggcccatttccgtgttcatcaaaatatgcgagtaaagtttcgttgcatcttggtgcagcttgatcagctgattagtcggtgactgcggatcaccgtgctgaccggcaccggttgctgcgttgacgatctgctcgtcaagtgaaacgtgcgaaaattcagcaactttcaccactgcttcttggaagctaaggttttccagctccatcaggaacttaaagacgttaccgccccgaccgcaactgaaacagtgaaaaatttgcttgtcttcagtgaccgaaaacgaaggtgtccgttcttcatgaaatggacacagcccaaagaaattcttcccttgcttttgcaattggacatattgactaataaaatccacgatatcagttgcatcgcggacttgttcaattacctgttcgggtattctcgccaacggcgcaacccccttcatttaacaaccaaatcacctatcaaaacatcgaaagtaacatgcggatacattgtcaaaacagattcatattcattattaatttttctttttttgcaatctaccgcgtacgtagttatatcatatcaagtaaaggctatatgtgcaactaaaacaccttcatatgtagtcaatcaaaaaataaccttttgcttgattatacgaacgtatgtttgtataatgatgataactttaaaaaggtggtgttgagattgaccaaattcatcaatttaacaggcgtactgggtgctgaacccaaagtgatcaagcaagttcccacgatgttgtacattcccatcataacagttgacgggcaaacattacactgtcttgtggtgcaacacgcgttagatttcctgtaccgtgctcgcgcaggcgctaagattgccgtttatggtcactataatcagcgccgtcagttcgtgatcaataagtatttcatccaggcccaagtgtcgtgagttattttggttctcagctgaactttcacaaatcaagattagagaataattaaaaaacaccttgacatttcattttctcaagtcgataatgattcactattagctgtcacccagtgagatgaagctaaactacatactaaagtctgtctaactgacggactaaccaaaggactgagaataatgatttcacaaagtggaccacaacgctacatatcagacaataaggcttatgacgaattaccagggttcatggccaagttaaaggtgagaacagtcttatttcttcacggcgagaaatcattagctgcagctcaaccgtatttgccagcatggcccgacgacgttaaggtcgttgacgtgccatttggcggtgaatgttcatttgaagaaattgaccgagtgagtcagattgctgacgacaacaacgtcgacatggtgattggccttggcggtgggaaagtcttggatacgtctaagagtgtcacaaccggtactcaccgttacctagttttgattccaacgctagcaagcaactgttcgccatggtcagccatttccgtgcattacaaggaaaacggcgaacacattaaccataatatttacttggaaaccgctaatttaatgctactgaaccccaaggttattttgaactcaccaatcgagtacttcgtggctggtattggtgacaccttagctaagttctacgaatccgagttgattttccagcaattaccagaagatcagtacaccgtagcgctaaccatttctcgtcaaatggctaacaactgcaaagatgttcttctgaaaaactccatcggtgccgtggctgacatgaaagctggccgcttaacaccacgctggcgtcagattgctgaaaccatcatcgtgatggccggaactgttggtggctggggcgacgactacggccgcgcctctggtgcccacgccattcacgatgccttgactattttcccagcaactgccccacatctgcatggcgctaaagttgcctacggaatcttagttctgctggctattgaaggcaaaactgacaacatcagagacttgcttcccttctaccacgagctcggcctgccaactaacttggaagacttgaacctcggtggcatctccgacagtgacatcgaaaagattgccactgctgcagcggatccaagcacacaaatgcacttcgttccaactaaggaaccagttacagctgaggtcgttaaggatgccatcttgacggttgaagatattacagcttttgtcgaagaataaatgttttaaatataagttctaaatagagcagcacgataattttctaagttaggaaattatcgtgctgctttttatattataccgattggtgaaagccacccaaagtaactttggccagttaacagtgactttttagatcttctaaattgttgttgtaactttaggtgaagtcattgttctacttctaccacgccttgattatatcatgagacgtgatatttttgtattttgtacatttgaatctgttaaattaatccaaacagaatttaggacatttttcgacaatgtcccacttgtgtaaaatccccataaactgtaggtaaacatagcctcacatgatacaattttaaatgttgcctaccctacatcgcaacggttgggaggtggacacagtgttcagttttttagtagcaccccttgtggtttcaattatttctatttggtttacggattggttaaatcgtaaacaccacaagtaaagctttgggcaacaaactaacccacccgcttttagcgtaaaaaagagccttagcagccacaactgctaaggctcttggtgttcacagtgttcagtttttacaccactaattatatcatctttcccaaccatagcaagcaattataacttaattcgtaccacctcgcacagacttaattcaattcggttttctaataatgattactgtgccgtcaatcccccatcaaccgtgaattctgcacccgtcgaataactggaatcatctgaggccaagaaaagcaccatcttagaaacttcttcaggttcagcaattcgttgcaacggaatcatcttggcaaattgttttaccgcctcatccgtatcaccctgatgaatcatcggtgttgagatcacgcctggatgaacggagttgacccggatatgatagtgtgccagctccagtgctgcagccttggtcatcccgcgaacggcaaacttcgtgtcggtgtagccaatggcaccgccgactaaaccattaatagaagaaatgttcacgatgctaccagaacctgcttttttcatttcagcggcagcatatttcattcccaagaacacactcaactgattgatcttgaagattttcagatattcatccgtggtgatgtcaaacagtgatttggcatatgtgataccggcattattaactaaaacatccagttggccaaaatgagcaatggtctctttaatcaccgtttgccagtcggcttcactagcaacgtcttgcttaacaaagatggcgttgtctcccaattcagccgctaatttggtcccagctgcttcattaatatctgtgatgaccactttggcaccctcgctaacgaacaatttagcgtgcgaggcacccataccttgtgagccacccgtaataattgctacttttccggttaatttattcatagtgattatcttccttttgtaagcgttttctattctgtcaacaataactttccagataacggttcctgcacctatttgttactagcccttaacgcatttagccagcgtttcgcgaatcgaagcaggtacgtcatcagtcttaatacctaagaatgcttgcgtctccgctggatctgagcataactgctcctcttgtaactgttcagacagcaggaggttaatcccgtgttctttgccagcctgatcaacttcagcttgagcggcttccagttgtggcttcatttgatcaaatgaaatcactggtacttgcgttttaccggtctgacctaaggccgccacaatcatcgtatagaactcctgataactgagattataactattaattgcaaaggtttgtcgatgtttaccgttctccagcgcaccaacggcagcttcgccaacttgctcaacggtcacagacgaggttgccccctttagagctgggtagacggactgatcacggatcatatcaacaaacattttccataatggcattctgcctggcatggtaccaaagatataaggcaatcgcagcgatgtcaccgtcatgccaccttcaccttccgcaaaggctacctgttcctacaacagtcgggtattaacgtatggctggtcttgataggttgggtatttagctgccagcttaatcgcaaactcactattataagaatcaaataacacaaaatgactgaccccggcctgccgtgctaatcgtgcaaatcgctgagttggtagaacgttcgcttcataataaaaacttaaggccggcttatccggaaccgcacgttcatctgcaccggcggcatacataaagccatcgcagtcagctaataagtcaacaatttgtgaatcactgagtttgttcatatcaccaagagtcagttcgacctcttccgggagtaaatcagcttccggcaatggtggtaacgccattgttttgacctgataaccgcgtgacaacagttccttgatggtgtaataacccaaaaagccggtgccacctaaaacaaacactttcgacattagaatccctcttttctagactgcttgataattaattcacaaccagtataatagattccaatagcacttcagtaacaaaaatcggttaagtgttcaaattgcgtgggggtgatagcatgaatcaaaattttccgtatgtaagtaccaattatttatcgggtcagtatcagccacaagcactgacgattgttcatcagtacctgcaaaacactcagccagctcacttttcggatgaagctgagttactcgtgattactgatggtcagatgactttggaactaaaccggcagccaatcaacctgtctgccggtgaaattatccagctcatgccctatcaaatgcagcagttaaagctatctgataatcaatcggtggcgctttttcgaattcgtttgtctctgggactactcttactttcttcaacggacgaagcgcagtattcaaaagcccttaaaactactgaccgattctacccaatcgtgcgggtcaacacgactgaacagacttttttaactcagttttgccaagaagttattcgtcaaaaacaattaccgttaggcggatcgtcaagtctgaacttatctttagtttcttacgtgatgtatttgtttcaaacgggaaccaaagtcccgctcccaaagcaaaatatggagcccgcttggcagtggttaaaatacctgcagtttcatcatcaatcagcagtctctctcacagaggtcgcaaaagtctttagtgaagatgaatgtaccattcaaaaggggctgctgagaattacggggttttcatttgatcaattactcaatcaagtcagaatcagaaatgcaacagctttactagagttttcggcgctcaccattcgccagattgcaaacatttgcgggtatcattcagttggcactttctactatcaatttaaagaaacgcatcatctcttaccggtagaataccgcatgcaactcagcacgcatcagcaacttgtaggtctcagtgacggctgggtgatcggcgtttatctgctggaacactgttatgaacccttgaccgttgaacaagtggctcaaacattgaatttttcagttgatacgattaccaaccgcttaaaagcgcactttggcttaacgtttaaaccccttctcaacctcttccgctgtgaattagctcgaccgctcgtcttagcctcaaagctgacttttgctcaaatcgccattaaagctggctaccacgatactgtaagttttgtacgaaactaccgaaaagtgtggcaggtaacgcctaacgttgatcgtgggagcggggcaaaacattaatataggaaattaattaaactgttaaattcattaggacattatttcagacgttttctaactttgtcccagttttgcaaagtctctgtaaactgtaggtaaacgggacttcacatgatacaattttaaatgttgcctaacccacaccgcagcggttgggaggtggttccgttgtttagcgtactagtagcaccccttgtggtttcattagtttcaatttggtttacggactggttagaccgtagacaccacaagtaaactccagacaacactctaacccacccgcttttagcgcaaaaaagagccttagcagacaccactgctaaggctcttggtgttccgttgtttagcttttacaattcctattatagcatctttcccggccatagcaagcatctccgactaacccgaaccattcacggacaatactagaactagcactcttcaattcacaggtaacgtacttcacttctaactaaaagcttcctattatatttgataatcacccaccaacccagaacgttcaacggccgtaccaccaagtgttaatgatggcactaaaaaagagccccagcagccaccaccgctgagactctctcattcctataagatcacacctattgcttttccttcactgaatgcttaaagtaccgtgcttcagcttcttttcgcaacttcactgcttcattgaagtcgtaagttgcatgattcaatacatatctgccatggaacatcagccgggcaacgaaacaatgcgattgtttgtcgtaagaaacaccgatgacgccggtgcggttacgcttccccttatataagctggagtagccgatgccgtcttcgttctttaacgaatttccctgattcgcgatgaacgaaggattgcacttggctgctttactggacttttcccggcgtaaacagccacagctacgtgttatcccgtgtcgcagtgcatagccgtctgcttccacgtaattgccacaatcgcaaaggcacttccagcgagcgttaccattatttgtcttacttttagctctaccaagtaccaataagcgaccaaacttttgattcgtgatgtcaattagtctgctcatacttcatcatgtcccctcatgattagatttacatcctcaaaatctgatacctacatatcctcagttgcgcgttgccgcaaccttgcttagcgactgaatatattggtcaaacggcacttgttctttaacccaaggagcgtccggattctggtccgtcagcttgaggtgatccactagcgcctgaacgtttgaccaaatatcagcgttgtgctgtaccagtaaccagaaagcctgatccacccgagaacgctcaatatcaggcacttgcttgatcaaagtataatatcgcacacaagctttggcgaattcgtcgctgtagatcttcgggtcgatcatccgcaaagtttcgaaatactgactcagcatggtgatctgctcaacggaaacggtcgacggcatcggtgccatcacttcggaccggatatcacggctcataaactgcgcgtaggcaatctcgttaacttcaatgtccgatcgcgacagactgttaaccagtcggctgtaaaattcatccgagtacttcccggaaacttgccagtgcacgcgatactgcttcaggaaactgcgcttgaaccagcgtccccgcgccgtcatgaagtcgcggcccactttgtattcggtggttcgtgtccgggtcatgtcttgttccagcactagcccagtcagcacatccgcggcaggattctggtcggccatggtactaaacgtctggatcacgctggtctggttcagcagaccatctggccccatgaacatgacgaagtcaccggtggcagccgccacgccttgttcaaaagcttcttcccacgacaaaacgttatcaggattttcatagcggatatcgatatttttgaataatctaaactgatcaacatctcgtaaccgatactgaccgttatctaccaagatcacctcaacgtcacggaaatcaatccccatttgattgttgatcgatgatagtggaatcgctaaatcatcttcccgtgcatcgttgaccgcaataataatactgattcgttttgccatagtcttctcctccttgtatttttactatgtatgagaagacggcgtcatcgtcgtcttccctataagaaaggccgcatcatcgcgggggacattgcgacatgcagcctctctcactatgaatccgagctagtagtcatgggggttaaattggaaatgactagtagagggactcatgattattatcgtcgctatcatgacgcttgcgacgagtgatgccgtaagccaaggtagcttccataatagtcatgccgacacccagcattacgagtgctgaagtcgatgtttcattggtctgtggcaaagtaccttgagccgcagccttaccattaccagttgtaacaccattaccattggtagcatcaacagcagttccacctgcgacagcttcgtggatcgttgaagcaccgccgttaccagcttcgcttgttggaaccatgccgccttcagtatcagtagcagtggcaccaccagcttcggtaaccagaccgttgtcaccacctggagtcgtggttacaccagtgccaccatcaacaccagttgaagtaccagtgtcgccatcagtaccagtagaggtgcctgtgccattaccattaccagtattgccgcctggaacagctgtaccagtagtcgtcgtagtgacggtgttggtaccatcgctaccacctggagtattagtgttaccgccaccattaccaccagctggagtggtcgtggtgttagtggtgttgtcaccgtcactgccaccgttgttgatgatattagtgttatcgccaccgttaccaccatcgcctggagtggtcgtgttcttaccaccggctggagtagtcgtcgtagtcgtcgtagtggtggtcgtcgttgaaccatcagtgtgagtaacaaccgtcacaatcttaaccacagtggtcgttgaaccatctggattattagtgactgtctctgtcttagtagtggttgtagtatcaccagtattgccggtgttaccattatcgccacctggagtcgtcgtgttgttaccattactaccggctggagtggttacaacgttgatcgtcgtggttgaatcttgaccattttcacctggagtagtggtcgtagtcgtggtagttgtcgttgaaccgtcaggattagttgtggtcgtcttagtcgtttcagtcgttgagccatcactgttagtggtcgtggtcttttcggttgtggtattagtcgtcgtgttagtggttgacgtcgtagttgaactcgtcgtgccttgaccattatcgccatcaccattgacgtttacagtattggtgttcgtaatatctggaacatcgctaccggaaccgttgttatcagaaccgttattaccggaaccgctgccatcatttggtacaacgattgaaccagcattgctgccgtctgggtaagtgaagtagtaagtggtcgtgccggcttctttattaacgattgtctttgaaggatcaatctgaggagtctgaccatctttgccgtccttaccgtcaacaccattcttgccgtctttgatgacgtagttggtcccgttcaatacgagtgtccagccatcgacattgccgtcagcatcgtagtgtggcttgatagttggcgtagcgccgtccttaggagcatccacagtaccaacagataccttttcaccagcatcgttagtgtagtagaagttgtaagcgacagtgttgccgtcagcatctttgacaggttcaacattaggagtcttgccattgacaccatctttaggtgccttgacagtcccaacagtggtttccttgccattctcgtcagtaacgtagaattcgtaagaagtggttccatcgtcgtccttgacagctttgacttgaggcgtttgaccgtccttgccatctttacctttatcaacggtaacttttgaaccatcgctgaaggtgatgacagtgttgccatctgcatcaggggcataactctcaactgagatatccttaccgtcttgaccatctttgccgtcttgaccattcttcacgatgtaatcgtgaccatctaacgtgaaggtccagccatcaacaacgccgttagcatcgtagtgaggagcaaccgctggggtctcgccatctttaccatctgtaccgttcttaggtgcatctactgtaccaagcaagaccttttcacccttgtcgttggtgtagtagaattcgtagctaactgtgttaccgttagcatccttgactggctgaacaagtggagtttcaccatctttaccgtccttaggagcagtgacattgccgacagtcttagttgagccatctgggttagtgacgtagaactcgtagtgagtgacgccatcttgcccaacgactgctttgacatcaggcgtttgaccgtctttgccgtccttgccatctttaccatcagcacccttgtcgatcgtaactttgttgccatcgctgaattcaacaactgtattgccatctgggtccttagttgtgctcgtaacggtaatgtccttaggtccatccactgtacccatgttcttttcagaaccatctgggttggtgatgtagaactcgtatgacttcgaaccatcagagttggtgatttccttaacctgtggtgtttgaccatccttaggtgcaggaactttaccaagatccttggtagaaccatcagggttagtgatatagaagtcgtatgaagttgagccatctgggttcgtaacagtcttaacttgtggagtcagaccatccttaccgtctttaccgttagtgacgatgtaatctttgccgccaatagtgaaggtgtaaccgtcaaccttgccatcagtaccagtatgtggtttaactgatggagtctcaccatccttaggtgcaggcacattaccaacagtcttttcggagccatctggattagtggtgtagaagacgtatgacttcgagccatcttcattagtgacttccttgacttttggtgtttgagcatcttgaccatctttaggtgcgtcaacagtaccaaggtcagtttctttgccatcttgaccaacggtgtagaagacgtatgaggtcttgccatcttggccgacaacagctttaacttgaggagtctcacctgcttcgccttgatcacctttgtcgcctttatcacccttagcacctttatcaacagtaacagttgagccatcgctgaaggtgatgacagtgttgccatccttatcagtggttgaactcttgatggtcaaaggttcaccgttcttaacggtgtagtcgtgaccgtcgatagtaaatgtgtaaccatcaacgttgccattagaatcggtatgtggcgtttcaccatctttaccatccttaggtgcaggaacgttacccatatcggtggtagagccatcagggttcgtaatgtagaactcgtacccagtgacgttgcctttggcatccgtaacaggtttaacctgtggcgtctgtccgtctttaccgtccttaccatctacaccatccttaggcgcagtaactgtacctacgactgtgtcatcggtaccgtcgcccttaggacctttgatgaagaataccaatgacttcgtaccatcaggattagtaacttccttaacgtctggtgttgtaccagcagcgccatctttacctttatcaacagtaactgtcttaccatcgttgaaggtaacgactgtgttgccatctttatcagtggtgtaactagcaaccgaggcatctttaccatctgtaccattcaaaacagtatatggaacattgtttaatgtgaaggtgtagccgtcaaccttgccatcagcaccagtgtgtggtgtaacagttggagtttcgccatctttaccattcttaggtgctggaaccgtgccaacaatctggtcgtcagtaccgtcaccctttggacctggaatgtagaactcgtaagaagtgatgttgccatcggcatccttgataggtttaactgatggtgtttgaccatccttaccgttagtaccatccttaggagcaatgatcgtgcctacgacattgtcatcggtaccgtcaccctttggacctggagtgaagaagacaagtgtcttgttgccatctttgtcagtaacttccttaacctgtggtgtttgaccatctttaccagcagcaccggcagggattgtgagcgtcttaccatcagagaaagttatcagtgtgctgccatctggttgaagtgcgtgactcaagattgttaaatcagcaccatccttaccattagtaccattcgtaccgtttttaccaggggcaccattcaaaacagtgtagtcaacgccgttcagagtgtaagtgaagccatcaaccttgccatcatcaccagtgtgtggtttaacagttggcgtttgaccatccttaccattcttaggtgctggaaccgtgccaacgatcgtgtcgtcagtaccgtctttctttggtccttgaatgtagaactcgtatgaagtgacgttaccatcggcatcagtaactggcttaacttgcggagtttgaccattagtaccattgataccatctttaccattcttaggtgctgtaacggtaccaagtgatgtgtcgtctgagccatcacccttaggtcctttgatgtagaactcatacccagtgacgttgccatctttatcagttacttccttaacagaaggtgtagcaccatctttaccattagctacttgaataacttgtttattatcctcggcacctggcgtagtacttggcgtagtgatggtgatcgtagtgccgataaccgtcttaccgtcagtatccaattcaggtgtagtggtaatcactggtgtaacaccgtctttaccatcagttccattcgtgatagtgccaacagtcttgccatcttcagtgatggtgtaaccagtgaccttaccatcttcatccttgatttcagtaaattcaggtgttgtaccatctttaccattagtgatggtaccaactggcttgccgtcaatcgtgatgttgtagctagtattgccatctttatcagtaactggtgtcaatactggtgaagaacctggatcacccttatcacccttatcgcctttagcaccattcaaaacattgtaatcaacaccgttgagagtgaaggtgtaacccgtcttaccatcggtaccagtgtacggtttaaccgttggtgtagaaccgtccttaggtgctggaacgataccagttgaaaccttttcacctttatcgttggtgtagtagaactcgtagctggttaccttaccgtcgttatccgtgactggttcaacttgaggtgtgttaccgtccttaggtgctggaactttgccaaggatctggtcatctgagccatccggcttatcgccaggaacatagaagaccagtgtcttgttacccttgtcatcggtaacttccttaaccgtaggcgtcttaccgtcttgaccatcagcacctttatcgatagtggctgtattgccatcagagaaggtcacaaccgtgttacctttatcatctttcgaagtgttagtaacggtgattgacttcccgtctttaggtgcatcaactgtaccaaggggcttaacagaaccatctgggtttgtaatgtagaactcatactgggtcttaccatcgttagtaaccgctttaactgaaggtgtctggccgtctttaccattagtaggtgcgtcaaccttgcctaagacagtgtcatcggtaccatcattctttggacctggaacgaagaattcgtattgaaccttgccagtattcggatcagtaacttgcttaacttgcggtgtctgaccatccttaccagctgcaccggcaggaattgtaagcgtcttgccatcagagaaggtaacaagtgtgctgccatctgcttgtggagctgaactcaggatcgttaagtcagcaccgtctttgccatctttaccattggtaccattcaaaacagtgtaatcaacgccgttcagagtgtaggtaaagccatcagtcttgccatcagcaccagtgtgtggtttaaccgttggggtttcgccatctttaccattagtaccattcttaggtgctggaaccgtaccaacaatcttgtcgtcagtgccgtcgcccttaggaccaggaatgaaaaattcatatgatgtgacgttaccatcggcatcagtaactggtttaacttgtggcgtttgaccatccgtaccatctttaccattcttaggtgctggaactgtaccaacgatctgatcgtcagtgccatcaccctttggacctggaatgtagaactggtatgaaacaacgttgccatctttatcaagaactggtttaacggttggtgtttgaccatctttaccgttagtcccatctttaccattttcgatgttgatcttttgtggtgcatcagtagaacctggtgtggtaatggtgattgtcgtaccgataatcgtcttaccatcagttgccaattcaggtgtattggtaatgactggcgttacaccgtctttaccatcagtaccattcttgatggtgccgaccgtattgccgtcaacaacgatatcgtatccagttacattaccatctttgtccttagtttcattaaaggtaggtgttgaaccatctttaccattttgcaaggtaccaaccgtttgatcaccaactttaatagtgtaagtgccggttggtttgccatttgcatcaacgtcaggtgtgatgactggtgaatcacccttgtcacctttatcacccttaggaccttgggcaccattcaagatagtaccggagtctttaccgtcaataaccagcgtagttccaatttgagtcttaccatcagtacccatcagtggcttagtggttacagtagaaccatctttaccattcttgagttcaccggctgggttgccgtcgatggtgattgcatagccagtaacgttaccagcatcgtccttttcaggagtcaatacaggcgatgaaccatctttaccattagtaacttggatggtttgtggcttgtccgtagaaccaggcgtggtaatggtgattgtggtgccagtaaccttgccatcagcatccgttgtcggagtctgagtaatgactggtgtagcaccatctttaccattggtaatggaaccaaccttgttgttatcaaccaaaatgtcgtagccagtgacgttgccgtccttgtccttaacagggctgaattgcggtgttgaaccatctttaccattttgcaattgaccaacagtcttatcgccgaccttgatggtgtaagtaccagttggtttaccgctgccatcaacatctgctgtgatgactggagaatcaccctgaggaccttgggcacctgtatcacccttggcaccattcaagatagtccctgagtctttaccatcgataaccagcgtaacgccgacttgactcttcccatcagcactcattaatggcttagtggttacaacagaaccatctttaccattggtgagtgaaccaacaggcttgccgtcaaccgtaatcgtgtagccggtcaccttgtcaccatctttaacttcggtgaactgaggtgtagatccgtccttaccattattgacagttccaacagtcttgtcaccgagagtgatgttgtagccagtaacgttgccgtcagtgtccttaacaggtgtgaagactggtgtaacaccatcggtaccgttcaaaatagtatcttcatccataccgttgattaccagtgtggttccgattctattgttgtctttatcataagctggcttggtagtaaccatcggagtggcaccatctttaccgtttgtgacttcgccgaccttggtattattcagcataatgtcgtagccgttatcagtcttaacaaagtctggcgtagcaccgtcttgaccattaacaacattgacagaattgccatcaccatcagtaatcgtgtaaccagtagtcttaccatctttaccaaccgttggcgtgatagttgctgacttaccagcttcaccttgtggtccttgagcaccgttcaaaatggtaccagagtctttaccgtcaataaccagcgtagttccaattggagtcttaccatcggtacccattaatggcttagtagtgacaactgaaccattcttcagtgagccaacaggattaccatcaactgtaatagtgtaaccagtgacattaccttggtcatctttagtttcagtgaattgaggtgttgccccatctttaccattttgcaaggtgccaacagtcttgtcaccaactttaatggtgtaagtgccagttagtttaccattatcatcaacatctggtgtgatgactggtgaatcacccttgtcacctttagcaccgttaaagatcgtaccggaatcctgaccattgataaccagtgtggttccgatttgcttaccattttcatcagtagctggcttagtcgtaaccgttggtgtcttaccgtctacaccattggtaagtgtgccaactttagcaccattaatcatgatatcgtagccagtatcagtcttactcaacgttggtgttgcaccgttagaaatcgtaacagtctgtgtatcttttcctggcgtggtaatcgtcagcgtgttgctagtaacgttacctgcatcatccttattaggcgttacagtaacgactggcgtagcaccatcttcaccattcttgatagtagcaacatccttgccaccaactgagatagtaaagctcttaccgtcttgagatggtttaatctctggtgtagcaccgtcatagatgtaggaaatggtatccggatcgccatttgcatgggtaaccgtaactttaacaccgcttacacctggcttatcagtatcggttacccgttcgctggtaatcgtgtcaccagtatttggaactggcaatgtgctgacatcagtatcatcagtaccatcgccctttggacctggaacgtagaagaccaaagttggtttcccgtctttatccgtaccaggcttaactgaaagaggcgtgccgttcttgccatcagtaccgttcttgacggtgaatgaaccggctggttgaccattaacagtcatgttgtacgtggttgtgccgtcgccgttatcaacaccctttggatcaacgactggtgtagcaccatctttaccattccaaatcgtttgggtagtatcaggagtaccatcaccatgtttgatggtcaacaatgtaccaccgtttggatggtcagcatcggcatcaactggtgttgctgtgattgtgtcaccgtccttaggtgctggaatttcgctaataactttatcgtcagtaccatcgccctttggacctggaacgaagtaaactaacgtcttgttaccattaatatcttgtccatacttcacttgaggtgtctgtccattagtaccatctttaccattcttaacggtaaatgaaccagttggtttgccatcaacagttaactgatacgtggtcgtgccatcaccattatctttaccagcatcaacggttggtgtagcaccatctttaccattccaaatcgtttgggtagtatcagcagaaccgtcaccatgtttaacagtaatctgtgttccaccatttggatggtcagcatcgccatcaactgaacttgtggtgatcgtgtcgccgtcctttggtgcaggaatgtcacctaagtcttgttcaggtgtgtcgccgtcagctggaataaagaaggtcaaaattttattaccgtttttatccgttccaggcttaacacttggcgttttaccatccttaccattttcaccatcgtacaggtaagtgatggttgggtcgcccgtagcgtgggtaacggtgattttaacgccaccgacaccttgaacattagtctccttaacccggtctgcggtgatcgtgtcaccggcacctggcattggaactgtaccaaggtcgtgttcaggaacatcgttgccatcagcatctttaccagcagggatataaaggattaaattgccgccctcttctttgatagaagggtcgccgttggtgttgctgctaccatccgtaccattcttaatagtgaagtctttcgacgttggtgtaccatcttcagcataactggtaatggtaatcttttcgccagtaaccttattggcatcacttggatcatctttaatatccgtctgcgtaatagttggtgcgttcaagacaacgaagtctttggtgatttctttaccatccttgtcaaacgtgccagtgccaacgctgacggtcgtaccaataactgtcttaccatccttggacatcttaggagccgttgtaatcgttggtgtaattccatccttaggaatcgggatcgtcccaactgattgatgatcgccattaggcccagtaacgtagaaactgtatactttcttggtagggtcattaggattattaggatcctgaatagtttcaatttgtggtgaaaccccatcagaaacagtgacttcacccactttagctcccgctggaatatccgttgcagttagagcagcttcaccctttgcaggtgtgagttcatcaccagtgtagaagtaagtggtgtgttgagctggagtacccttagtagcatctcccggtgtcgtaactgtaaatgaatggatggcttctggtgtaggttcttcaaccgtaccgattgaattatgctcaccattaggtccagtcagatagaagctgtaaaccttcttagtaggatctttaggatccgtaatggtttcaacttgcggtgtttgacctgctgcaccatctttagtctccacatccccaataattgggttcttagcattttgaacatcttcataagttgctggagaatcagcagtaacatctgacccatctgcatgctttgtcggtacatcaccagtgtagaagtaagtggtgtgggtacccttatcagtatcatcgacagtgactgagtgaatggttggtgtaataccattcgtaccattgaagacagtagcaaccggtttagaatctttagttacctcgcctacatagatgtagtaacctgagttattaggttggtctttaactgcaccagcatcaaatggtataaccgaaatcttaggtgcctcggcagttccaccaccagtacctggcacgccttgatcacctttagcaccattaggaacaaaggcataggtgacactaccatcagggttggtaatcttaagacttgtaccgccatcagcagctttgttgtctttcgtagtgttatcagtaccgtccttatcaacagtaccaagttggtaagtgccgtctttgtcaaccgtagttggttcgattgttggtgctttaccatcaacaccgttcgtaacgacaacactgctaatcgtatcgccatccggaatgtctgtgttatcaacttttccatccttgttagtatcagtaaccttaggacccttgtagaagtaaatcgtgttggtcgtggcaccggtattagcatctgtaccaggaaccgttaatgattgaatatcaccggcacttggcgcatacgttaccgtagtttccaaatcttcagggttgccttcaacatccaaaggtacgttttggtcatcgaccattgcgttatcaggtgtgtagccagcaactgtaggtgatgcaagtgatgtaaagatcttcttaacatcagtatcagcagtccctttgccatcttcggaagaacccgtaacagcatatgatacagtcttcagaacattgccttgatcatccttaataacctttggtgtcaacgtcaaagtttgaacagcatcaggagcaacagtaacgctcttagtagtaccgtctgactgcacttcatccttcacatagtgaatcgtccgtttaactgtaactggtgtaccatcgactgtgttgcccgcattcagacctggtttagcagtgtagatgatccaaatatcttgaccatccgtactgtactgagtatctgaaccagatttatcaggcatcgtatcgtacaaaccaccattaggatcagcagttgcgtagtagtacaacgtgctggtatctaatgtaccattggcatcgtcaagcttcgtcgtaccatcaactgccttaccgggtgttgtagctggaatggtgagctgactagtgtaattatcaccggcatcgccagaaatcgttacagatggtaggacttcagttccacccacttgctggtaaacataatgcacggtagcggtttctttttctggtgcatacgtaaccgcacgatcaatctcaatctgtgagttatccgcgtccttagcaatcttcagcggaacatcaacgttagctgccttctgatcatccgtcaactcagcgccggttgcggtgttcgcaaatgattcagtgtagccaggttgcttttgcagttcattcgtggtgagctttgcgacgttgatcgtatcagtcccatcagaaacgttaccgtcagtaccaacctttgcagcaccattagcgttcgtcgtccatggactataagtgatggttggatctgtcttgccctctgtaaaggaaaccgtaaccgtccgataaaggtcgtaatccttcaattcttccttagtcgtaccgtcgccaactggatcgccgtaagtgacgtattcagtcactgccttagtcaacgcgttgcgactagtttgatccgtatcgccaggattgtctggcgtaaacgtcgtgttggccttgcgcagataagtgtagaattctgcaggtgtcgtagcgtcatatttttgaccagtaaaatcagctttttgtacggcaacgtagccgtcgtgggcgtaatcatacaattgggcgccatcagttgaaatctgagcaccagtaacaccgtccaacggcactgcagcaacctgattaccatcgttaggtgcaaaacctgtagtcttcttggtgttggaaacatcaatatagtgaatttcagcaccggctgacttagtcgcactcaacgtgatggttactgtttgatttgctttgcttgcgatgtctttaacgtcaacgctaccatcaacagtaacgtcactggcaccaacagtagcatcaactggcgttgcgccggcctttgaagcacttaaggtagcaccgttattcgcagttgcctggtggttttctggaattgcaaatgtacctgaatcaccgtaaccagcggcaagtagtttcgcagcatcagtatcgttgtctggattggtatcagacatatcagtaacgtaggtcttagcgttatcttcgctggcaaatgctaaccacgtgctgcttggcgtaatgcctgtgaccttaccactagcatctgtcgtagccttgttcgttgtttgctttacccagtaaagggtttggttatccaatttaagcccagttgaaccatcacctgtaaaggtaaatgaacgtgtagactggtgttctgcatcgctaggatcagtagtatcaaatgcagtcttcttaaccaggtatacataaccattagcactcttatgatcaagctgatcctgtgtgaacttgccacttggcaggttttcctgaacaacaaagtagtcaggatacttcgctaaaacagtaggttcatctgtataggtgattggatcgtcaacgttaccaattggcactggatcagttgttaatacatttgttttacctgttgatgaatcttttttaatatcatctggagtaaatcctgatgttttaccagaatcagtcacatcaacataactgacttcaccagcattcaacgttgggtcattcagctggaaagtaacatcaactgtatcagttgctttatccaacttatagttaatcttggcagtaactacaccagttgccgcacctgaactatcctttgcaatgtcaattgatgccggctgaccacccacaccttcgtcatagactgaaggtgtgattagtttattaggatcagcagcttctggattaccagcagacgggaaaccaattatcggctgcttattcggatttgcccaagtgtatgtggtcttcgcagcattgattgtcttagtaatcgtctttgttgcatcatctgggtctggaacggtgtacgagtatgattgcccactcaaaagagcgttcaaagcttgtgaaacgtcaatactgggaatatcagctgtttctgctgttaacgtcttatcataaggtgcttgagaagtatacgttacatttcccgtaccctcttgtgagtacaccgtttgattattctgattaacgattgatacttgcacattagctgaagttgtattttgagccaacaaactattccaagtgacttggtgaccggtaattcccgtagtggaatcatcagtaaaaccaactgtcttcccgtttgttttagcgtcagcaagcatattcaacagcatatcacgttgagcatcagtaaagtgatacgtataaactgattccctaccagtattattaccatatagcggtgcggtcgttgcacttacttgccccgtcattgttgctgttgacttatcagcgtcagttagcggcttattgggatcacttatggcaacatagaagtgttcattgggtttaggcaaagcgacccaaacctctgtatcgggatatgcttggttatctgtaccgaatctaaccgaggatgtcaagaataatccgaaggcattgccgttgtcaccgtctggaaagtcaccacctatattttccatatcaatatggttatacactagaggatcactcgaaatagagattctgttacccaaaccatccttaccattcgaaatgaaggacgattgcccggtaattgtcattggagcggtggtattactgccagtccctgaccagccggcaaattgtttgattgcagcaacttggctttgtgttaactcatagtcgttagccagattaatagtcaacgtattagttgcttgatcataggtaacagatcctttagcaggagtgtctaccttagttgggtcagtcttatcataaaccgcctgtggtatcccaaattggttatccagattaaactctgaagtatccgtcgaacctgattcagctggatctaaagccgtaatctcttgggctttaccggttttagcaaactcagcagctgcagcagtcttaaccgcatcaataagttgcgtgtctgtactgcctaagtcagtcttttggatatccgcactcttggctgaagcatccgtcttggtatccgttgcggattgctgtgcgcttgcgtcagcagtcttgctactgtcggtagtaggtgtctgcattgcgtccgtcttagcggcggtttgagtagccgccttagtatcagtagctgctggtgcggcagtctttgaactgtctgcggtagctgccttagtcgttgtctgcgttgcagccttactatcagtagtaggagttgcggcaccttgagtagttgttgcttgagctgtactgtcagctgaagcactctttacggctgttccctgttgagtctgggctgcagcagctggagtactggtcgcagtacttgtattgtgtaacgtgacctgcttaggcgcggtcactgattgatcgatggtagcgacattgctgtcactaccatcggttgctgttgtatccgctttaacttcttgcggtaaagcaaacgctgagattccaaatgtcagcgttgccatcccagcaactagccaacgtgttcccgccttatagagcttataacgtacttttcgctcggcagtatcacgttggagcttattccgattgaacttatacttttccaatgaaatttcccccctcgtaaattttacggtgtaccgtttagggtacacccgaaaaaagtataaaatctgaactgaggcagttgtctcagttcattttttattaggaggatttttatgatttatggctatgcacgtgtcagcagtaaagatcaaaatcttgctcgacaaatccaaacattatctgagttaggcgtggataagatattcgaagaaaaggcctcgggtgccaccttatcccggccaatcttaaaacagcttctagctctactggaacccgaagacgtggtgaaagtcatcagtctggatcgactgggtcgcaatgtgaatgacgtgaccaatgtgatcattgaagtccggagtaaaggcgcgcacatcgactttttggatatgccttcatataaagaagttcatgatgaaaacacccgtaacttactgagttccatcaccatcgaactgcaaaaatacctggcagctgaagagcgtaaaaaaatcctggaacggcagcgtcagggtatcgctttagccaagctacggggtgtctatcaagggcgtcccattctttatgggccaaatgtctctaatttagatagaaggaagcaatactttgaaattaaacgactattgaaatcagggacaccagtacggaaaattcagcaactcactgggcgaagtttgaccctaattcagcggatcaaaaatgagctttcaattcaatttaaagtataaaatatttataaatgtcgtatatgacattaactttttcaaacatttaatttgcttaatgataggataaattattaaattattcacggcatttaataattattcacggtaaaaaatgtgattttactaatacggggttgtacttttatgtatcggatgatatattttgcgtgagtttagcgaactagaatctcagcttggaggaggaagaaagcgctaagaaaaatactagtttactgaacgttttgcaaagaagtttttgtatgtttaagggtgtaccctaaaaaattatgctcatgacccacctttaatcaaatcttaataaatatacacttgaaaaaaagtttgtcattttttttgatttttttaaaaaaattggaagagactctggggtttccgacttatacagttaaactgcatttaaccagctgcttggatatgttgagtaccaaacagcaatcagcattgacttttcgaaccgataaggaataaccgtttagaattccgtttcgggtaactgcccgtaccggtaatggttaagatcatcatcgacttcatcggtgcactccatgaagccaaccttgcctaagatgagtccccgtttatatttctcaatcttaatcatgagttttttgagcgtttcttccgaatgatgctcacctaagtccgccatatcaaacgtaggacagattaatgctgtctgttgcttgatgaagccagcgatggccttgcagagttcttggcggaactcgactgaacgtctcgacatcggccactgcaaaaccaggtgatggtcaacgatcacgcggctgcaattatctggaaagtcccagatatcgcgtttgtattgccagcgaaaccaggaccggttagtggcgacgactggccccgctggcatgagccaaaaatcacggcagacgtacggcaccccccttttcattttcagcgccttagccattgtgtgacgaatatcgttgtaataatccatgggaaagtgcttccgtagacgtttcaacagccgattaggtgtcggccggactttgagcagtcgctgatcatcatacaagatgatgctattatagtgactttgggcgtctgcgcagttgataatggccaaaacgtgatcccagtctggtagaaactcggtatcctcattagcgggtaccacctcgtcaagttccagttcgtcgggtatgagatacccttgttgttctacttgctgacgacaatttggttccaaatccataaaatagctcactgaatttttctccttatggggaagtattttttgtttcgagagcatcataactggaatagaccaaaattgaaagtcaaacgaatcggcggcagctggcggattgggctatttgggtgctggtcgattagatgggcggtatgggatatttggcggtaatttatagcttagttgtgattagcattttgagcaatggactatgtcatagtttcccctagttatatgtggacgtactctgggttgatccgttagttgagttttaaagggtatcgattgatgttttgaggtgtctgaggtagaaaaaattttttgaactttttttattttgggggccttttgggagacatcggtgaaggtacgtagacttgacttggttccattctctggtaaaagactaaatgaataaatgaatgaacgttgtcattaatgacacctcccttctccgtaatcagatgtgcattactttgaaagtcaggcgacctttgtagttcacggaacttggatggtggttacaagagttgttgggaatttgacacaatgtttcgctgcatgctttggcggtggaatggcataactcgaggagtacgatggattcaagacactgtttaatattgagttgcgtattgaagatatcgagctttccttaactgaaatctctggtacaatgagtttgaataaagtaaatcatgatcaacacagaaaagagagccatgcgacggctctcttttttggtgctttttaatctatcctcaaagtagcaaatggttcatttttcatgaaaataacgacatatttagtttagttaaacagactatgatccccagttgcagctaaaataagaactaattcgtcgtgttcaatgcggtaaataacaatccactgatcatattcttgcttaaatttcagcttagattttgatttataccttgccggatgaaactcacggtacccggcccagttaccatgcaatgcgtggtcatcaatttgctttaaagcttcaatatcatgctcgtcaattgcacgcaagcaaagtgaaaccagttcgactggatagtgcttcttctttaacttcttaaattcgcgtttgaaggtgggcagtcctttaatcttcatctaaattttccgtccacttttcaaaatcatcaatatcaccaatagtttcggccatatgatgttgatcttcgtattttgcttgctgggcttcaggagaatccagaaagctgactaatttcacttcgttattagccgcttttactaaagataaacggacgtactcagatacagttaaacccatcttggccaaattagctttagctcgatcattaatatcttgggtcacacgggtagaaatagttttactctttttgacattttgcataatctagccctcctttaaaatgtttactatcgtattacatttttatcttaacaattaacgataattttagcaacaaattaaatgttcatcgtgttgataaggagtcaacaaatagttttgtctagtttatatcagaaatatcactatcagaaaactaaggcttggtaatcaaaattttcttagctatggcatccggctgcttccccctcacataatcatcaaccacactaatcaatcgattacgacttgctaatctatcctgatattccttcttcgattctatttcttcgtctagtctatttatcttagggatagcatcaatgtttttcttgttttttaaaataatttctggtttctcatttgtatcgaaaattgcttctaacagttcccctctttcagtctcatactttaaatcgatacttaccatgtacgaattcgctttatgagtccaagtatacggcacaactaccaattcctccttagcactgataagcggtactgtcagatattcggtacgtacttctagatctactttcttagcattatacttttcacgttttttaaatttgtcagtttctggaccacaaatatattccaacttaattaaacaattgtaagcatcgtgattaaaggtattagtaatacctaacagtttgtcagttataaaacggtcttcagtggtgaaaattaaggggtaatgcccacttcttcgaaaagttggcgtcagtacactcatataggaatcaccatgcctaaaatcattatccatccaggcttgataatcgtggttgtaaataatatgctggttcaatttcaaccaccttaggtatctaaagctaaactttggtctaacacttacgtccttcttttcctcaattcgtagctccttgtccttctgctttcgctcatcttcagctttttcctgatcctgtttatttaatttaaaaaacactattaagattgatacaccaccaaaaagcgctgaacaccagccagataattcaataaaagaaccagattcagtcatgtactgaaatgaatacacgagtatgatacaaataatagcaaccaccaattcgttcaaaacccattcgaaataactcttctttttgttattcttatctttcactttcctcaccattcattctcaattgaacatttcttctttcgaacatacgttctaattataccatttattatattcaatcgatccaattaaattcaatcagtatcataatacataatcactatgtctaacataagaacgtaaaatcatacatacttatcattacgcgtctaattatacagttaactatctttgtccctatttcgcaatttaggtatttcaggggaacgtatgtgctaaaatagtacttgcgttagtgaagtaagttaaagcagattatatcgaaggatgcgtcgcacatggataacctcagtgctgaaatagataatatcgcgaataactggctaaaatttataaagaatagcagctcgtttacaatggcaagtgaaaatgaattacgtgtgaacactcccttttctgactcatttggtgatcaaattttattaatgattttgctgactggtaatctttatacagttacggatcagggttacacgttatggaatttacaaacacatggtgccaatttaaccgataagaagtctcagcgatttaaaaatctgatggcaatcctcggtggaaataatgccgagcttactgacaacgaagcgattcaaataagcggtagcaaagatgaactcccacaaatcatcaccggcttaactcaaacactgatacaagtttctgctctgatttactgatatagatacaatgaaaggatgttttgccatgaatcagacgacggaacaaaccaagatcacccagtggggacactcaaaagctgtccggattcctagtagcgtgattaagcaacttgaccttaagaatgacgataagctttcagtgactattgaaaatggttcgattgtgctcaccccattggaaaagaagcttaccaatatttacgagttgtttaatggctgggtcgatgatggcgttagggatagtgaagttgattggggtgaagcccgggggaatgaatttaagtggtagaacaagcgagtatttaaggtaaaccaataaacggatggtgagaacctaagaaaaatcaagccaacacctacattaaagattatacaaacacatttgtagtcaacgggcattcctatccggttactgcccccgcgcggtttgactctgagataaacatgttgattgacgactctgagttagatgatcgtgcagcggaaaaggcccgtgagatttatcgagaagaatttggcctactatcccctgaaaggatcagaaattttcggaatcgcttaactctgaaccaacaggatttcgcacagttaatcggtgtcagtcccaacacgatggcgctttacgaagcgggtgcgtttcctaccacagcacataatcgattgttaaagttgctgatgcatgatgatcgaaacatccgcgattatattgctgctaatgcacagcaaataccaagtcgtattcaggaacaagttaataaagtgctccgttcgggtgattaaattgactgtattgactgcaactagtaacatatgaactaaggaaaagacggttcgaccgtttgctaactaaggtactgctgaacgttagttattaagaaggctggctgatgtattttacattggctggtcttttaatttacccataattaaaaatcctgaaaagtattttacttcgctggcctttttgtgctgaaaaacaaaaatcttccaacccatgtaggtcagaagacttcactttcacgattatgcattaatatgtcatttctccctcatagcggctttagcaagccgatgtttcttacgctcattcagccaaagcaaaataaagaaggccccactgctgagggcccaagcaagacccgataatactgccagccagagcggatgggaaaagatggtgatgatcattaacacaaaagcaattgtatcaaatttactattgattcgattccatttatcatatggggcaatccatacctttgcggttttcattattcgtcatcagctttcagaaatttagtggttgtattcttctatcattttaccattaaaggcggtacacatctcgctatgcccaacagagaatgaccgtataaccaactgatcactgcaaccttggaaaatcccagtctataagtcatcatccgccccgccaaatttacggaaaacttctgccattaaatgcgtttctttgccacttccttgatatcgtttataagcgacctgggcaacttgcttatcgtattcatcctcaaattgttccattgagtacttcttaatcaagttagacagtgtgatgccgtagaattctgccatgtagtgcagccatttcttttcggaatcgcgaacacgaacagtaatcattgccatgagtggtcgcccctttctgtgtttcatcgtattacatgctggtagaattgcataggaatgtggtttgagttgacctgcagtaaattaaagactatattattggaaattgtcggatcaaccctcgtcatgcgcgatggcgtactctgcaactgcttcaacaagatccgacgaagccaacacactgggggtaattgtcgtggagaatacgaacgtgagatttagtattgaacatgcaaatttaaatatccagcccatccatctttcagcaacagagaagaaacaaattattgacacatcagcagctgaggtgtttggaaatccaacggtacaggaaatactacgggaactttctaagctttaattttgtcccagccttttgatgatttgacgcacttaggcggccatgctaaactacaaccattagttgctaaccaggcttcgagaaatcggagcagacttggttggcctttttttgtggaattactgatgggtgttagtcccttaatatgcaacattttgcgggttatgtatcaatcactgtgatagtagtataatcgcctttggaagaccagcctgcatccgttcaacctaaaagttagccaatttcgttgaacttggggcaaatacaacagccttgacgactgcaatctaaggagcgatttcatgaagttaaggaattatgtattattaggtgctgcttccctttcattgggaacagtagcggtggtagcacagccaacatctgcatcggctaaaacggcaattccagcgaggtttcgtcatacgtgggaaggacatggatatggcaacaaattcattttaaaggtttacaaatatcacgttgattttgatcagaaaagccaggggaagaattactggcaaaaacgttactataagaaacttacgaaaaatcattacgcaatattgaaacataatgaagaatctaacacacttgaataccacagtagtcacatgatatatatgatctacgatgtacaaagagttcatatgtaccgagttaaataacagcaaatctggtcgatccatcaccagaattcttaaagtaaaacagcacttcaatttccacttttggaaattgaagtgctgtttgtttattactacaaataaagcatcctatcagaaacttctttactttaatgcgtgaagttttccccaaaacataccaaacaattttagggctcttgatccagattgagttccagaatcttaaccctaccctctaaaagtaacttaggtagtaagtttttccccttattaggtattttatctccataactttccaataagcgactcaccctatcaaactgatctctagctacttcgtcagatgttttgttaccataaggcgaatagtagaaaattaattgtatattctctgaatagatattgtaataatcaaagatcgcctgaaaatatgagtaatcagcctgagataaagaatgaccataaaaaattagtttgttaattgacttgggtaatatttgtggtgtgtcagtattaccagctaacctcattatgcgataggttttagtgaacttgtaataaggtttagtggcttcaatatcatctgaatcaattccaaagattggggcattatcaagcgtactgtgaatgtttcgcggaaattgtaggttatcggattgaggtttcgtatagttaaaattaagtaggttaaagggctgatcagacaacttttccaaacgctctgccgcatcctttttataatcactatcctcagccaacttttgtgtcaaataagtagcaaagtgttgttcaaatatttttaactgttgaagtaaatattcacttaaatcttcatttaaatttccattttggggattaaatccataaacatttatcaataaatatgtcagtttctgcgtgattatatctgtttgactggcatccgataaatcgtaaaagaaaccattatttttgccaacagaattcaccacgttcctcataattcgaatataatcagatatcccttcaaattgggtcatctggttatctgttgaatttttagaaattcgtaaatttgttaaggtccgtactctcttcaattttcgcttaaaaaaatcccctaagattttctcaacatcataccaatactctggtttcttactttgaaagtcaaagtaatttgcccaaaatccctgagctgaagctgacaactcggataaactagactgactttcactactataatcatctaagtataacctcttattgtctccacccagtttcttgatagtctccctagtaagcaagctatttttctgccgacctgaattaattacggcaaatccaggtgattgtaaatgtttcgttgcaacataatctatcttgcttttgttcgtcaagaatacttgagtactgtctgattgggtagttattgttttaaagaagtcattaaaatttgactttagacctaaggaagcatcaaaaccgttcccgattataatcaacgacctgacagtttcatccaataattttgcctccattaattttcattttaacgttgaaaattttaaaatacttgaatcttttgtttttagctcattctagcaagtttgaggccatatctttaatatgttcataatttatccggctgtcgacccagccttatcacggagcatctctaaagaaatttcgctaaaatcatcagttccttcatttttcttgagaaatttaattaaaaatgaactgtatttagtggccttcaattttgccccttcatcagaaactgattccaccttgaattgataaagaagttttattgactttagcttaggtatactaacacccaaaatcgttaaattttcgtcctgttgtgggatcacaacgttaactaattttccaactgcatcacctttgatttctgcaccggaaacattccagactttatcaacaatgttaagttcagcatacttgttgtcttgaataaccgtatcataaagcgcatcgatctttgaaatatctgagtctgtaaaatttttattcactccaaaggtaacattgtaatattgctctatttctagcaacttctcatattcttcaagagagacacgaagaggtgttaattgcggaaatccttccgacttcagtcctaaatctttaccattaatttttatttctttcccgctaattacattttcaagtaacggtttcaaatcaacaatttctttaacatttttcgcctttgctaagtttatgttgaaggtaagattaaagcttttgttcttctcatcaggaatttttattgttagttgaagtaccttatcagaaggtgactgcaatacgtatagatgcagtaattcatctgtatgcatggggataggctttaagcctaagttaatgctttctccaccaaattcaaaagtaagaaaagtatcctttttaggggccagggcttttatctgaatactatcgtcgccttttaaaccacgtcctgttcgtaagtcatcaactttcatttcttgattattcaaatatatgggagtatctctttcaaaagtaagggtggtctgcgttctataaagaactttatttagattatctggcgtaatttgatctcttacatgttctagttcaggattttgatctatgatttgttcaataatattatcgtacgtttcgcctttaaaagtaacttgtaatttattgcctggacctgatggtgacaatatcagattcccatcatattctttgtatgttagtccagctgctaagaaactgggaggaaggattgctttcaatcggtcttgtggaattttagtctgttgctcaaatggtaaaagctcctttttaaaatcagaaaacattttaccaatccccctttaaaatacttaaatccgtaattttgcttgctaattttaactttgtctcctgtttttcaaatgttttatcaataaaactcagaagcttctctacgaacgatttatcttcaacaataatgtaattaatattgtctgctgtcaatttcagattattttccggatgagattgtaattgactagatagtacattcaaactctgctggttgtgcataatggcatcatcctcacgaatattatcaatcaatagtgaatcagattcagacggatcaagattggggatatgtcgccactcatgctcgtcgtgaaaaatcgtgttaggttcaggcacaccattaagcacctgctttccttctacaggctttgaaaactttaaaacagttagcagtgcatcgcctgcgataccctctcttttctcgccgccatttaacaaactattaattcctgcactcagatctttagctacaggtgaatctttgtttaaataatttaccggttggacttgatccgttggtaccttgtctttggctaagccaattccaaaatttccataattaacacagtggggtaaaattttatgaaaattaatgtcacaaaaacatagcattggaatgcaaagattgcggattaatccttgttcattctgtaaatttaagtactcgacattttcatttacataacgaggcataagtgccatttttgctaaagcggcttctaagtattcgtattcgcgcatgaagttaaagagagtgttggcactctctttaaaccgcttaggctcagaaggtttaccctctgtagcggaataaaaagtttcttctgacataattattattttcctttactcttagtaatgatcaatatcgatattccagtactgtgtgcaactatctatggtcatgattgatggagactaaaatagcttcacattcaacattgaaatattttagttatcaatgttaaatatgaagcttggtttcaaatctcttactatttgatagtaatctacccttgccgataatcatccagcatagaaataatagaatcctcattgaaatactttggtgattcatccagatactgatcaaagaaacgatcatcaaggctgaacaattttaccaaaaagtttggcagaatatgctgctgttcaaagaactctttggcgttaataagttgatgatccaaaaccagtttaactaacgctctaattttacctggcttcaaaggaactagcttatcatctaaaggttcaagatttttataccctaatttggataatttaccccaaaagtatcgatgctcctgataagacattaatccaagatggtaagctcttagctccatggcagctattgaaacagcgtatttttgcttcaggtcaatataggaatcgggatttgattttcgagtgagttgttgaaaatcttgggtgaacgcctttttaggcagcaaaaaagcgcctgcaaaggtatttgcttcactctctaattcatcaacttctgatttatcaagaatagccatatcaacgtcaacatgaagcaaaatatggcctagttcatgcgccaaatcgaagtttctacgcactgctgactttttgatgtttcccagcacaatgaacgtccgctcagatgtcgatgcactgtatgcatcaatggtggcgccgaggtctttttccacaatatatatcccactacgctctaacacatacatcaaatcacgattatcagtaactttaagtactttccgactacctttagcaacagtctcaatcagctgattgcgcgccatttcagggttcttttcaatgtagttctggacccgtttttggagatcagagatagtcgattgtggaagtttcaaggtctgctcaaatacatcaagatagtaattctgaaaatctaagaatctcagttccaagcgcgtcttctttcgagaatcacgatccttagatcggtatgcaacctgggattcgtcaacactcctctgtaactcaccattctcaaaaaaatacttcgactcaacattgaacaaatttcggatttggtttaaaacctcaatcttaggaataacgtccttggtttcgtactgccaaacagcctgttcagaaatcgacagtttatctgccaaattttttctggacatgccattgagctctctaagattaactaatttctcgccaaaaaacataccaatcacatctttctaaagaagttacccattttgaatattttgatcgccagtttcttcttttttcgaaggtacctcgtaaccaaatgaaaactcaccatttgaataagtgctgtctggaatacgatcatttttcacagcagccaattcttcatcgccaatttcgacattactcttttcaatatatggtgttaagttgtccgcaatatataaggtcatcttttgttggttgggtaccgtcaaatagatattcttaatcattttattttcatcagtatcataagtcactatgtagaatcggtcaaattgggctacatcgccattttgagctttaaattccgctaagtcactttggttcggtagatcgtataaatccaatgacatttgaccaactaaatcacccttaagttcaccattctgcacaaggtgattgttagcacgcgcaaaatcgaataagtagttatccttgttagcatcagcaggtgctgcatcgaaagttttcctagctgaagtcgcatttttcaccaagatcaagtatttgttattgtttgaattcagcgtgatttgcaggtatcgccaagaacgtcctgccttcccagcagtacaactaaggccctctaaactttcacattgttcccacaccttagaatcgacatgatttccacgagtccaagcataaggcatcactgattttaagtatttcgctggcacgcttacgttccgccaaatatgacttataaccagaaagaatgccatctacaattttttgattcagttctgggtcgagttttaagtctgtcatgtataccaacctctttcagattttatagttcaagtatacactgtcttttaattattcacagtattttattgattttttttaaagtaaatatgatatatgcaatatttttattatattattagcattgagcgaatcattttcaagaaaataaatatcaactattctctaattcaatcaacttaatcgcgaataaacatttatatctcaataaaaaaagacgagcgttcatcacccgtcttataacctgtcactattaccattttgcttagctattacttcactcacattaacagttggcataatgtaactcggatattcattcgacatcattgtgagtgtggatatctcagttcgaagatacggataaagaactgcgactgcattattacggaccagactgtcaggaccaacattgtctttatcagcctctgggtgatacgtgaatgacccagtaagcgtacatgtgacctcaaacggcactttcgaatctctagtcgatcccactaaaactgacaaagtcacatcaatatgattggcattaatgtgattgtttaccgtaatttcgggatttaacttgatatcgctttttgatgtcgcctcgtaggtcaaattccgttgatattgcatattatcaacgtggtatccctcaaattctaatgcagtcattatgctatccctccaaaattagttagcttaaactctttatcaaatttgcttaacttgatggttttatatttaggtgtgtgcgaagcataggtagaagtagctaaacgctgatttaataactcattagtagttttgggagaatttattttgtggaaagtaccatttcgataatctctttcagcacttctgaataaattttcctgatacttgacctgtactcgccgattattttctatctgggtcagagtggatgacgcgatacctaattcacccgcaaattctctaactgacaatcccatattttcccgcaatgttctaatttcttgtggtgtcatataccctttacgcgtccgataagcatcaaaagacctttcaacattttccatcggatgatcaaagtcactccacaattcaccatcagaatcttgccaatagtgattttccactagtaaatcatcaacatctttaaccctaaccttctcaagcgtccagacctcagtgtacaagtctgttgtacctaattcttcgttgtaaaacctctttttagtcgtcattttaatgtccccctttacacatccagacttcattatctatattttagcatttctgtatctcaggaaatacggctttgcctttaatctttcataaagcgattgaaaaatagatattcctaagatcaaaagtaaatttcgtaacttgctgaaacgcaaatctaactactatatagtttcgtaaatagtcacgtgatagttttcatacagtcacaccttgaacccaaccaaccagcgtgcaatactaaaactaatattaatgcatttagaaagttgggtgaatcatatgtatcacatgatcagttttgatttagatggcactttagctgacacttttccggtaattttgaagtcgtttcacagcacggtgcagcattttactggcgaacagattgacgaccagcagattttcgatacctttggcaccaacgaacaaggtatgcttcgcagtttattaccggatgtgccattagataccgcttcggattacttttacgaggcttatcagcaagcccacgaaggcttacggcagccgtttcctggcattgtagatttactcaagaagttaaccaatcacggtatccaaatctctttgctcactggcaagggtcagcaggcatgtgatatctcattggaaatgctaggtttgaccggctactttaagcccgttttggtgggctcgccggaccgtaacgtcaagacggataacctcaaacgtcttttaaccactcagcaccttactccaaacgaattagcatacgttggtgacgctaccagtgatatcaaagctgcccaagccgctggcatccactgcttttcagtcgcttggtcgcctagcacgcagttagcaccgctgaaagctgttaacgcggatatttatgaaacagtggcggatttgcaggtaaaattactgaattaaacagcctattacggataaacgcaaatcacttatcaattataaaaacgcccaatactctgcttctttcgcagagtattgggcgttttctaatgatttgatctaaaaatcaggctgccttgctagtacccgttcgataattcaaacggaagcctggttgaacgttaaagatatagatgttaaaccgaatcgcgtggctgccgattgattcagcttgcatttccaccccgtttgctaataagttattgccagcaaagactggtttaacttcgtagcgcacgtaatgtgagcggctgcttcgtaaataactcgccacttggttttcatacttttccataccgggtgcgttcagtgatcgcgttcccgtcatgagattctttagattattattttgaccggttaactggtagccgattaaatgactccggttgtaaagccaccccccatgaccgcgtttattgtgccaaccggtagggttaacgtatagcggttgacgctcagcgtgtggcatcagccgtttgtttaacatggcatctgccgtggtcacccgattcaaccgatccaggttcccgtaatgctgccaagcacccttcttaatactcaatcggtttaactttggttgatcatgattgatgatcacgatttgctgcccgtgatacttgagtttttgcaaccccgaagcgctggctttggcctgcttgatatgcttcacaggcactcgtttgacaactgtacgacgcttcacgtggcgatgatgcgttactcgcttgtgatgcgctgttgcctgatccgttgcagctaacgtcaagcccctgtgcttggcggtttgtaaactgaccttgaacacttttcgcgctcgatttaacccacgattatggcgatggtaaaagtagtgcttacccgttctcgtgacgtaaaccatggttgctgcattggcattatctggttccccagtaatacccgctggtaccgcaaaaatcgtcatggcgacaatcaatgacagtaccgttttgaacatcttcgacatattctcttctcccaaacagactagtaatcagccgttattattaaattagtaactggttaattatacaagtcatgatatattggggtcaatcataaatctgtttaaatgataacagtttattaatgtaagcgttttaaatttcagctcaaataaaaagacgttcagcatcatacactctgaacgtcttttgtgttattttaatcgaccctaattcacttttggctgtacataataagtcaccacagcacccttcttaacgttaaacgttcccggttgggtaccgaagaaattattttccgaataagccccaacgtagccagcaggcatctgcatatattgataagaatcggcatagttatcgaattcataaccaaaactcatggtggttttaccaactgctgcgccgaatggcacgattactgaacccaccgttttattggtatcttggtcaacgtaattaaccgttaccccgtgcttagcagtaactggtgcgattcttttcagcgagccgtctttgatgtaccctgcgatgtggctgttggataaatctgacacttgcagccaacggtcaccctgccgagttcgggtgacagcgcccgtgattacaaacacatcgttggcatagtcggctgaagaagctttattaggcatattgacgattgctggtgaaaccactgggctaacatccagtggcaatgaatacaccttggccgtcccatccgttgcggtacccggattggctaaccggtaaaaaccagaagcttcggccgtggtaaccggacttttctttagcgtttcaaacatggttacaccaccagctggttgggtcttggccgcgtccttataccgaacgacctgatccttataatccgtggtcttgcccgaatagatccagcctttcaccttgttatccagtgaagccactttaagatattcacttttacggtttgttgtggcggtttccagccacatgaacgtatccataccacgttttgatgacgcatatttttttaattgttttgttgttttaacgactttggcaccttttagcgtacccactttgttgtacagcgcgtttttaccggtaaaattcacgtaggtacttgattgaaccagcgtgcgcgacgttttaaccactttcgcataacttttagcttgtgccgtgactgagctggcaccaattccgccagcaaccaaacccactgcgagtaacccttttacccatctatttaacatccgttttccccctaattgattaatcactataccctaacaagttgattttaacatagtcgtgaaatcaatagcggtatttttccaacaaaaaaccagcctgagcctccgccgctcaagctggtatttgatttcagtttcattaatagcgtaccttaattatatcacttttaacccggttgtcgagtaacacagccagactgggctagaagtgcgttagaccaattatttacttaacgatcaactggttaaggtcgccgagatgtaagatcagatcagataactgacttaactggctgagacggttgttcttaacctgttcgtcatctgccataaccatggtagcttcgaagtaatcgttaatcactgacttcaaagcggccaaagcatcgtagtaagcggcaatatccaactctgacgcctgcttagcgacttgatccacggcatcgtgaagttttggttcactatcgttatcaaataaactggtatcaacggcagttaccttactcttatcagccttctgagcaatccgcagcactcgagttaaggcttcgatcgtgcccttgaagtcatcatcgttttggtgatcgctcaaaacttgcgcactggtaaagttgtccagcagatcagtatttggtccgccaatgacggcatccacgatatcgtgcttaaccttttcacccaataaggtgactttgatccggtcacgtaagaagtcgccaacggctttaacttgggctttttgatccaaatcaggagccacgttagcactagtttcagcagcaatggcgtcttccaccatctgctggttgaaatgccacttgttggtacggatgatccgcacgatcccagtagcttgacgacgcaaagcgtatgggtcattagaaccgcttggaatcataccagcggcgaagaaggtcaaaatactgtcgattttatcagcaatggccaagacagcaccaacagtggattctggtaaatcaccatcggctgagatcggcatgtagtgttcacgaatagcttgggcgactactgggttctcaccgtttagtaaggcgtacttttcacccatgaccccttgcaattcagcgaattcaccgaccatgccagtcactaagtcaaacttgtagatgtgagcggcacgaacaagatccttaatctgagtatcatctagaccaagctttttgcccagattttcagcaatgacagcgacccgctgcatcttgtcatacatggtactgatcttgtcatggaaactaaccgacttcaggcgttcaacgtagtcttcaacggtctgcttctgatcttcttcatagaagaacatagcatcagataaccgggcagccagcacacgttcgttaccggcaaccacgttttgaatgtggtcagcgttcccgttacggactgaaacaaagtgtggcaataacttaccgttttgatccagcacatagaagaaccgttggtggtcacgcattgacgtgatcagtacttcgtctggaatagcgaggtacttctcgtcaaagccaccggtaaaggcagtgggccattcaaccaggttgttaacttcttccaaaagatctgggttcaacttgatcacccagttattgtctgccgcaatcttttcaatctgttgctgaatttcagccttgcgcttcttagcatccgcaatcacaaattcgttcttcagcgcatcttcgtaatcggtggcattagccaacgtaatggtcttgcctaagaaccggtgaccgcgcgtcttccggtcggtagtgatatccaagatttggaatggaatcaccttgtcatctaacaaagcgaccaaccatttgattgggcgaatatattcaaagtgataactgccccacttcatcatggttgggaaagtcatgccggtgacaacatctttcaaaccagccaatactgattcaacggattggccagcaatgtgtttttcaacgtaaacgtactcggtaccctttaactctttaaaagtaatatcgtcaaccgtgacgccttgcccacgggtaaagccttgagccgctttagaccagttaccgtccttatccagagcgattttcttagctgggcccttaacttcctggtcaatatccggctgtttgtcagctaaaccactgatttggatggctaaacgacgtggtgttgaaaagggcttgatatcatcaaaactgatgcgttgttctttgaggtacttcttggttttttgaactaattgctggatgcttggcgtcacaacgtgagcgggcatctcttccaaaccaatttcaagtaaaaatgtatgtgccattactttttatcctccccgtctgccaataatgcttgccgtttttcttcgtccttgatcaacgggaagccaaattctttccgtttatcaacgaaggctctagcaacactgtgtgccatccgacgaatccgagacaggtagccggcccgttcagtaacggaaacagcaccacgagcgtctaacaggttaaaggtgtgagaacacttcaaaatgtagtcgtaagctgggtgcacgagaccgttggcaatctgcttcttcgcttcagcctcgtagtcgtcaaacatctgcagcagcatctcttggttgctcttttcaaagctataagtggagtgttcgatttctggttcacggaaaatatcaccgtacatcacgccatcgccccattccaagtcgaagacactgtcaacgtcttggatgtatgaagcgagtcgttcgagaccgtaagtaatttctgaagtgacagggtccacttccaggccaccgacgatttggaagtaggtgaattgtgagacttccatcccatcaagccaaacttcccaaccaacaccggcacagcccattgaagggttttcccagttatcttcaacgaagcgaatatcatgttccaagggatcgatacccaattcttttaaactgtttaaataaaggtcctgaatattttctggtgaaggcttcatgaccacttggaactggtggtgttgatataaccggttagggttttcagcgtaccgaccatccgctggccgccgtgatggttcaacgtaggccgcgttccaaggttctggaccgattgcgcgcaagaaggtgtagggactcatggtaccggcacccttttccgtatcgtaagcctgcattaacatgcagccttgtgcggaccaatattgctgcaaggtcaagatgatttgttgcattgacaatttcttggtcaaaactaattcctcctattgtgtgatgacgatgacaaggcacaaaaaaacgtcccaacgtagtcttgtagacctacgtagggacgaaaattgattttcgcggttccaccctacttctgggatcaccccagcagcttcgtttgcgccagctctaaaagtgccaatcgattcacgatcactccggctcacacttacccgaagtcgctgtttaaccgtcgaatcaaccctcttttttcattgccgatcactattcaattctccattattttaagcgtctggaaaataaaagtcaatctcgattggtaattacttcagattgagttcaccttgccttaatgacagcaaaatggctaacacgattaagacaaaggaaaacgtaaaggccacgtgcatcccagaaatgaacaattcaggctgacttggcagataagtagtgactttggtatgggcaatgaaactcatgacgctgaacaataccgtagtagaaagcgccgtgcctgaaaccatgccgacgtttcgtgccaatgcgttgatactgccggcactgcctaactgatccttgctgaccaccgacatcacaatatcgctgttgggtgattgaaacagccccgtgccaattgccatcaccacggtaatcatgccgtaaacccacagtgaactgtgcaggtccaaaaaccagtatcccaactgtgataaggcaacggtacttagccccaatgtcacaatcttagctgggttaaaacgatccgctagcacaccgccgattggaccggcaatcatgctgacgactggaaagataatcatcagcaaccccgcctgaccagcacttaaccgccgtgcgtcttccagatagaacggcatcagcacaacggtgaaaaaattagagaagaagattaaaacggctgcaccgatgccgtaagaaaagggtttgattttaaaaatactcagtggcattagtggcactgaactatgatgttccgcacggatgaaccacatcaaggatagtatcgcaatcacataacccgctagtggcacggcggtgaagtagcccacctcttgaccccagaaaatggctaggaaaaggctcacgatcaataacgcaaaggacgcaaaaccagaccagtcgatttgtttatccgctgattctggcgttgattttggcaggacaatttgaccaagaataatggcaaaaatacccaatggcacgttgatccagaaaatatacccccagctaaaatgagacagcaccagcccaccaaccccaggaccggccacggctccaaatgagacaaaagtaccgatcagtcccatggcttttccccgctcctttaaactaaacgtggcggtggtaatgccataagtgttggacagcgtcattgccgaaccaatcccctgaatcacccgacccagtagtagccattcaaaggtccattgcagaccagagatgaaggaaccgatgatgaaaatagccgttccgatacgaaaaattttaattttgccatacatatcacctaatttaccaaaaaatagcaataacgcactaaccacgattaaataaatggacaccacccattcaatcttattcatgggaataactaactgtttggccatgacgggcatggcaacgttgacgatactggaatccaagttactcatgaaagcaaaaatgccgatggaaagcaaaatccaccagcgccgtggctgagtttcgttcatcttaacaacccccaatctactcttaatggcctgattataactggaattagggatttagggtgcgctaaagctcaggttaattgatcgtttatatcaaactataccaatttgcaatttaatcgtcagcaatttaattgttttcattatccccttgatttttacacttaatattgtgaactaaacgattcgttttttaattgtcttaaaaggattttgaattaaatatcacaagcaaaggggttgtaagcgaatacaaaaaagggtatcctcatactgtatcagaaaggttatagaaggttaaccaatttatttttaacctcgttttttataagttagaaggaggaatcatctaatggcttatgcaacgatcaatccgtacaacaatgaagctgttaaggaatacgcttataccactgaagcagaattacaggcggccttagcaaccggccatgcgctttataagaaaaaccgtaaacaaccggtagccgaacgggctaaaatcttacacaacgtggctgccaagttacgtgaacactccgctgaactggcacgcgcctgcaccatcgatatggggaagttgcttcgtgaatcagaaggcgaagttgaactggttgccattattgccgactggttcgctgatcatggcgaagaaatcctgaagcccgaaacgattgataccatcgctactggaacggccgaaattcaccactcagctaccggcatcgtcatgatggtagaaccttggaacttcccatactaccaaatcatgcgggtcttcgcacctaactttatcgttggtaacccaatgattttaaagcacgctgccaacaccccaaccagcgcccaaatgtttgcggacgttgtggcagaggctggcgcgccagaaggctcattaaccaacctgttcctatcatatgataaagtcactgaagccattgaagatcctcgagttcaaggcgttgcgctgaccggttcagaacgtggcggtaccgctgttgcggaagctgctggtaagaacctgaagaagaatactatggaactgggtggcatggatccatttattgtgttagatgacgctaacatggacgatgtgattgacattgcatggcgtgctcgcctctataacacgggtcaagtatgtacctcatctaaacgcttcatcgtgatggataaggtttatgatcaatttgttgaaggtttgaaagagaaattcagcaaagtcgttcccggcgacccactggatcctaaaacctctctggcaccgatgaaccgtgagaaagctaaggataaactgcaaaaacaagttgatgatgcgattgctgcaggtgctaaggtcgtttatggtaacgaaccaatcgatctgccaggtcaattcttcatgccaaccattttaaccgatatcgacaaggacaaccctgcttactcagaagaaatgttcggcccagttgccgctgtttataaagtccattctgaagaagaagccattgaactagctaacgacaacccttatggcttgggtggtatcgtctttgctggcgacgctgaccacggtgctgaagttgccgctcaaatcgaaactgggatggtcttcgtgaataacttcatggtgaccttaccagaattaccattcggtggtgttaaactttccggttacggccgtgaaatgagccacattggtgaaatggcctttgtcaacgaacaactgattgttaagactgacaaaccaaacttggataatgttgcgggtggtttagtcgcaactgatcctgaataatgattcctaattgaatattttctggcaaacaaaacgtctgcaactcggtccttgaccagttacagacgttttgtttttggtcgacagaataatttacccacgcctttaaatcataaataatgccaataagaagcttgatattatcaagtctaaatcgtggcaatctgcaattctgtgttgtatcctgtccaaggaatttgaagtatggcatttggaggaggaataataatggcacgtttagaaggtaaagttgcaattattactggtggtgctggaacgcttgggtttgaggatgcaaaattctttgttcacgaaggtgccaaagttgctttggctgatatggcagaagaagctggtcaacaaagggctaatgaattaggcgatgatgctatctttgttaagttaaatgtcactgatgaagcgagttgggaagctgcttttcaaacagttgaaaagcagtttggtaaggtaaacgtccttgtaaataatgccggcattggcgacaccccatcctacattaaagatttgtcagtggccgattggaataaagtaatggctgtcaacttaactggcgtcatgattggcgttaaatatggttttcaacatatgactgaagaaggcggctcaattattaatatctcttctgttattggaaacgttggtttagctcgagcagcagcgtattctgctgccaaagctggtgttcgggaattaaccaaaaccgctgctattgaagcggctgaactaaaattaccgattcgcattaattcagtacatcccggttgggtagatacaggaattgttcctgaaatgatgaaacagcttgctctagagaagacgccgattaaacggatgggccagcctaaagacattgctaatctattagtctacttagcagctgatgaatcagagtttgcaaccgggtctgaattcgtcattgatggcggctttttagcccaacaattcaaaagtggcattaaaaaaacgcctgcaatcacgttaattgcgggcgttttactttactcatctttctgattatctaacggttgccacttcatcatttgatccaaaaagcgttttgacttgggatagaccccaatggtgtctgaataaatcatatccagcgctcgtcgcaagtgctgcttcgtttcttcgtgaacgctaatggttttgagtttggttaaatcaacggctgaaaactgccgcaaataataaatggtccgctgatctaaatctaaccggttagggtctaagtgccaatgtgcttgacacaacagcccaccataggattcagaataatcaaagggcagatccgtgcgaccacaaatcacgcactgccttaagttgggttctaccccaaacaaactcatcatttggacttcgaagatgttggtaatgatggcttcatccagcccatcattaattaaagacagaccgtgaaaaagccgttgataccagccaccaagcggttggttatcaggaattgccatatctaataacgacatcatatacgtggcataggcatttttagaaatatcctgagcgatattagtgaagttctcggtatccttggccgcgttaataaacgacaggcccggttcccgaatatcgccagcgtacacgccgtaagtaaatggcaacaaatccgccgtcattttaaagccgcgttttttggcaccacgaatgaagaacatccgcttgccagcttcttcggtaaaaaatttaatcagcatatctcgttcacgatacgccttttgatacatgacaatgccatgaaaattcatgagttgtccggccattgtatcaccacactctaataatcgtctttacggtacccatatgattgtaacgctgaagacttgtcacgccagcccggaacgaccttcacccaaagctcaaggtaaactttatcgcccaacagattttcaatatcctggcgagccagtgtcccaatcttctttaacatggagccgcccttaccaatcaaaatgcccttttgcgttggccgatcaacgatgatggttgcctgaacatggattttctgttcgttttggcgactcattttatcaacgaccactgcaactgaatggggaatttcctgacgggtcaactggaagattttttcacggatcagttcagaaaccacgaaccgttctgggtgatcggtcacctgatcatctgggtaatactgcggcccatgaggtaacttgccaaccaactcactcagcagttcttcaacgttgttaccttccaaagcagagattggcagtacttcttgccagtctaaagcatctttgtactgatcgatgacgactaataaatcgtccggggtaatttgatcaatcttattaacaactaaataaaccggttttttaacggttttcagacggtcaataataaagttatcaccggcgccacgacgttgttccgcattgaccatcatgattacagcgtctacttcgttaagggaagacaaggctgatttcatcatatagtcccctaattcactcttaggtttgtgaatccctggtgtatcaataaaaacgatctgagcatcatccgtagtgtagattccctgaatcttgttacgggtggtttgcggcttatcagacatgattgccactttttgacccactactcggttaagcaaggttgatttaccaacgtttggtcgaccaacaatggctacgaaaccacttcgataatttgggttatccaaaataattcttcctcctataaatgaacgtgaaattcctgcaacagttctggaataaaaatcaaacagccaatcaccaccgcaaaaaaggccgcaatcaaaacgccgccggcagcaacgtccttcgcttttttagcctcatcatggtacttacgaccaacgattaaatcaacaattgattccacgacggtattcaagacttcagccacgaccaccacgaaaatggctaaggtgatccaaagccactcataggtcgtcaaatgtaaccagatccccatgataacagcgatgacagcaaagctgatgtgtttacgaaaatttcgctccgtggacaccagactatatatgccatccaaagcgtgaatcagcgactggaaaaaattgcgatttttattaacttgtttatcgtttaagcccataagcgtcgagtatatccctttgcagtttgaacatcactttttcgtcttccggctccatgtgatcgtaaccattaagatggagaaaaccatgaacaactaagaagcccagttcacgttcgtaagagtgttccaggtattcggcttgctcgcccactttatcgacggatacaaaaatatcgccaatgttttctggaatctcctcttccaattcttcgtccatcacgattggaaattcatcatcttcagcactgtcttcaatggcgaagctgatgacgtccgttgcccgatcaacgccacgatattcgcggttgatttcttgaatccgatcgttattcacaaacgtaaccgacatttcggtattttctttaagcttaatgtacttgccagcgtattccagcacatccttaactagctgaacatgttcttctggaacaccgtttttagtttcatcgtaaatttctaaatccattttttatactcgtccttatttattttcaactgcttcataggcattaatgattgccgcaactactgggtgtctgaccacatcatcggccgtaaattgtacaaaatcaatatggttcacgtgcttcaaaataccggttgcctgcaccagtccgctttgactgtggcgtggcaaatcgatctgagtaatgtcaccattaacgatcatcttggagccaaagcccaaccgggtcaagaacatcttcatctgcatgttggtggtgttttgggcttcatccaaaatcacaaaagcgccatctaaggttcggccacgcatgtaggctaacggtgcaatctcaatcacaccgcgttccattaatcgattggtatgttccgcgccaagaatggcgtacaaagcatcatagattggccgcagataaggatcaaccttatcctttaggtcacctggcaaaaagcccagactctcacccgcttcaacggcaggacgggtcaaaatgatcttctccacgtcgccgcgcttcaaagcagcaatcgccatgaccacagccaagtaggttttacccgtaccggcaggaccaacgccaaaggtgatatcgttgtgtttaatggcatcaacgtactgccgttgaccgtagttcttaacccgaacagcacggcccttagcatccttgatcaaggtttcagtgtacagatctaagaagtattccaaggtacccttatccgccatcttcatcgcactgaccacatcagcactattcagctggataccttgttggatcagcttatccatatttttcaaaatgtccatggctttttgaacctgaaacggctcaccggcaactttaatggaatttccaaatggatgaatcgtcacgtttagcccctcttctaagagcgaaacgaactgatcctgcgcacccaaaatagccactccctgctccggatttgctaagatatattctttttcagtttgcgtattgtcagccaaaaaatattgactcctttacattaaaatagatttcttagactattatacgacaaagcaaacagaaaagctcgaacaagtgttacataagcgattagcccgctgtttttaaattaaaatgcagcgtttcatttatcacactatagctaaattaccactccaaatatagcatctttgagttatgatattgcttagaataggaggggatattttgaaaatacttgggattcttggggcgcacaagcaagatggcttgaccgccaccatgctgaacaccgttttaaacagtgtaccagcaccccacgtcacggagaccatttacttggaggattatgcattccaccctgatcaaggagaacatcgcgatccagtcttagatcagctcactgacaaactgttggaaagtgacgtctgggtactcgctgcaccaacatattggggtggcctagccggtaaattgaaagattttctagactgtatgcgcggtcgactggtgcgttttgatcacaaagggggcacgcacccagaccggttcaaaaacaaacattatctaagcatcaccagctgttatgccggaacagttgaaaactttgtctctggtattacagataacacttttcgtaccattgataaaattatgtctgcggcaggtctcattaagattaacgaattggtcctgccaggcaccctgtttatgaagcaggttccggctgccaaactagcagcgtgcaaacgattgggaagcaaattaatcactaaaccgaaacgagatgacaatacattgaaacgttatattgaactgttctgcatggttgctgttatggcctttttaacgatgggtatccagtttttatttcacttaatttctgctagtgaattttggctggtctacgtcagcttcgtggtgattttctttgtgttgctggctagtattttgcatttctttactgttgtgaagcatcggcgacgttaatagatattgtatatagcaataattaaaattgtatattacaaatgggcacctatttttagatatgggtgctttttaatttgtcacctcaaggacctttcgtcgcaggttttgagttgcttttaaaggatcaacagctttcataattgctgagacaactgccacaccatcaaccccagccggtttcaccgtttccacgttatcagcatttaagcccccaatcgcatataccggaatattcaccgcttgcttgatagcttttagcgtatcaacactggttcgaacagtttcaacatgggtagtcgtgggaaaaattgcgcccactcccagataatcggcgccctgttcaaccgctaactgagcttgattcatcgttttggtggttgcgccaatgatggcatccggtcctaatatctgtcgtgccacgtcaacgggtaaatctttttgacccaggtgcacccctgctgctttcactgcctgtgctacatctaggcggtcatcaatcaacagtggaacgtggtatttatccgtaatctgtttaactgcatatgcccgttggaaatactgtaaactagtcaattctttttcacgtaattgaacgaggtctatcccaccctgacatgcagcgtcgattcggttcagaaacgcttcttcagaataatttaacgcatcggtaactaaatacagtggtcgcttactgatcttcataatggcctccagattaaccaaacttttaattctcgccaacagtctaccgaaaattttcgcggttgtcacgtgaatattcttgcttgacttccacaacgttctagattataaatataaccaatgagtcgtttgactgactcaaactaaaaattaaataacgttagttcgtctggggtgccaattggctgagattaaacccatcgaacctgatgtagtttgtactaccgaaggaagacaacttttactgaatttatcagtccaaagaccttcctgcatgaaaggtcttttttcgtgcaggtgcgccttgataaatcgacttgatgtaaccccttcctcgtagacaaacggaaaggggcttttttatggttactgtaaacggcgagccattagcagaagctgctggcaaaaacctactcacattcttacaacaacgtgaagcacccatcgacaacattgtcgtggaattaaacgggacgatcatccaccgccccgaatacgagcagacgttgatcaaaccaaatgacaaactggaactgatttcgtttgtcggcggcggacgctaaagggggattgcatatgccaaccattcaaggaatgaccattcaggatgtttatcaaggcatgaaagaccgtaacgtggccgattccaccgaccgtttaaccacggcacacgttaccattgctggtgctggcggtttaggctccaacattgctattgcgttagctcgaatcggtgtcggtcatttaacgttgattgatttcgaccaagttgagctgagtaatttaaaccggcagcagtttaaactcagccaagtaggcatggataaagtgaccgcgctcaaacaaaacttgcaggaattcaaccccttcgtcaccatcgatacgctggttcaaaaagtggaccatgacaacgtggctgaactctttgccgatgccgacattatctgtgaagcctttgataatccgagcgccaaagccatgctattagacgctgccagtgaatttttccccgacaagcccatggtcatggctaccgggatggccggtacgcacagttctaattccatcgtcaccaaacaagttcgccctaatctctacattgctggtgatggcacgactactggtgcggaaggcctcatggcaccacgggtgatgattgcagcgggtcacgaagcaaatatgattacccgtttaattttaggagaaaacaatatttaggaggaaattctttatggcagaagatgcagatttactcaccattggtggtcacacgttcacctcacgttttattctcggatctggtaaatgttcttacgacctgattgattcagccattaaccaagctaaggcgcaaattatcaccatggcgttacgccggacggattcagcggaagaaaatattctcaactacattcctgaaggaatcaccattttaccaaacacttcaggctcaaccaacgctgaagaagccattcgtaccgcctgtttagcccgcgaacttagtggcagtaactttattaaactggaagttgtcccggataaaaaatacttgatgccagacaacaacgaaaccgtcaaggccacagaagttttggccaatgaagggttcatcgtcatgccatacgtcctgcctgatttaaacgttgctcgccagttagtggatgccggagctgccaccgtgatgcctttagctgccccaatcggcaccaacaagggcttagcaaccaaagatctgattcaaatcttgattgatgaaatcgatgtgccggtgattattgatgccggaattggccgtccaagcgaagcagccgcagcgatggaaatgggtgccgacgccatcatggctaatacgtctatggccaccgcgcaaaacattccactcatggcagaagcctttcgcctcggtgttgaagctggccgaaaagcctatctggctggtcctggccggattattgaacgcggtgctgtggcgtcatcacccctcactggcttaagcaaatgattcgtgaaactaatgagtggctgacttttgaacgccgatttcagcaaatcattcagctttcgaaccacacggttggccaaaatcgtttggtttattcacccaactggatagcagcacagtcagccttgatccgcttcggtcagcaaattggtctcaccgtcatggtggataactacggtaacgtttatttagatttacctggtaaagatgatcaggtgattgcgaccggttcgcacatggataccgtcatcgatggcggtaaatacgacggcttatacggcgtgctcggcggccttcaagctattaatgcactgaaaaatcgactgggaacaccgcagcactcattgcgcctcatttcctttagtgaagaagaaggcagccgtttcaacaccactttcagcggttctaaatactacgctcttcaccaatcagtggcagccttaaccgatgctgacgggatcagttttgaacaagctcgcagccaagctgtcaaacaactgcagtcattgcccgacgttatcgctaaacgaccagcgatttcagctagctttaccgaattgcatattgagcagggccccagactgatcactagtcacgaccagattggcttagtttctggcatcgttggtcagcgtcgttggacggtcacggttcaaggcgagtcaaatcacgctggaactaccccgatgaacgagcggcacgatgcccttcaagccgcagtgactatgatctcatccttaaatcagcatgctcaccaattgagcgacaatttaacctttaccgtgggtcagctaaacgtttcccctaatacatcaaacgtgattccaggcaccgtaacgtttacaatcgatgctcgtcacgccgatgaccatgtcttagatgtatttgaacagtctatcaataccatcgaacatcagttagcagatccacaaatcaaagttcacttcaaacgttacgtcaaagattcaccagcaacgtttgatacaaccctgctttcacaaaatgagttgattgcacagcaattaggactcacgtcacgggtcatgacttccggtgctggtcatgatagttacgttatgaatcaagcgtcgcccacgacgatgattttcgttcccagtgaaggcgggatcagtcacgcacccaatgaatttactcagctagctgatttaaaggccggcattgcattactaatggctagtctgcaagcccaggcatactagcgattaaaacactttccgattaattaaaaaagggactgagtagccgtctacacagctactcagtccctttttggagtcaaattatttacttaacagtgattttacagtcttgttaacaagactaccatcagctttacccttaagtttaggcatgacagcgcccatcactttaccgaagtcagccattgaactggcaccaacttcactaaccgtatcagtgacgatttgcttaacttcgtcatcgctcagttgttttggtgcatatttctccaccagcttaatctcagcatccaaaccgtcaactaaatcctgacggcctgcatcagcaaattcttggcgagattccttccgttgcttaagttcacgggaaagtaccgttaactcctcgtcatcgcttaaatcatggcccagcttaacccgttcgttggttaaagctgctttgatcatccgaataacactcaaagcaaccttatcacgagccttcatagctgtttttaaatcttctgtaagcgtgtctgataatgacatgtcaaaacctcctaatattcattaattggttcaaatctcaaaaaaagactcctgttaaacaggagccccgctgcaacttagaaacgcttcttgttcttgcgttttcttgctgcttctgattttaatttctttttaacgcttggcttttcataaaactcacgtttacggtattcttgtaaagtaccgctttttgaaacggttcgtttgaagcgccgaagagcatcgtcaagagactcgtttttgcgaacgactgtctttgtcatgtaaatccctccctccgagctctaatagtaaccgattgaaaatgaacaacaaaagaagccctttccaatagttccttttaattatacctacctaatggccgaacgtcaatcatttcaattaagttttatcatagaaattcaaatatcatctgcaagttcgcacctgtgctaaaattagactaaatcgaaattaacgggggctttattatggctgaaaattcagatatcgatatcttcattatctcagattcatccggtgaaacggcgttaactgttgctcaaactgcagtagcacaatttcccgacatccaagttaagtatcagcgctttcctttcattcaaacggagtcgattctaactggcattttaaaaatggctgcgcgtaaaaaagccgttctttactatacactggttacccctaccttaagtgaacagatttcgcactttacggaggagaatcacctgcaagcctttgattgccttcaaccagccatcaaagctttaaccgacagaaccggtgttaagcctgcatccatcccaagcattaatcacagtttgacggacacctactttgatcgtatcggtgccatggaattcgctgtggcctatgatgacggtaaagatcctacaggtctgctgaaagccgatattgtcattctcggtgtttcgcggacttccaaaacaccgttatcacttttcttggcaaatcgtgggattaaagtggccaacttaccactatcaccaacctcacagctgcctgacgaattatggaaagtcgaccctgctaagattattggcttaactaacagtcccaaagttttacggcggattcgccagcaacgcatgatctcgtacggcttaccagctgaaagtgcctattcagacacggaaaaaattaaggcagagcttaaatatgctgacgaaatttataagaagattggttgcctagtgatcaatgtgtcaaataagtccatcgaggaaaccgcgacgcttattctggaaaatttgaatcttgaacctgcagaagttgataccatcaaagattaactattcttccataaagaagttgtgacatcagtctatattgataaaaatttcatttggtttcttaacttaaagacaatttaaagtttgcttttgttcaatactttaatctagtctaaacctgcgccacaactcagattccggccatttaacacaaaaaaacgtattccgacaaagttcgacggaatacgcctttttgcgttaaattctggaatctaccgagttgtgtcacactctcttaatcgtcaaaactaagactggtatcaaacggtttttgagccaacacatccgcctcaatacttggattgaagacctgtcgctttagcatctctacctcgtagccatatggcgcaaatttatgcttcttgtcaacggccacccatggtgtttccatcaccttggggacgttctctaagcttgggtgatgcgcaacagcgttcaaagcatcaaagccaatggtcccgttacccaataattcatgacggtctttgtgactgccttgaggattctttgaatcattcaaatgaatgacctgcaaacgattgaggccgataacatcgtcaaactgtttcagcacaccatcgaagtcatttttaatgtcatatccagcatcactggtgtgacaggtatcgaaacagacggaaagtttatcattgtcggtcacctgatcgataattgacgctaactgttcgaaggtaattcccacttcagtccccttgccagccatggtttccagcgcgattttgaccttttgatccggttcaataatttcgtttaagcccttggcaatttgtgcaatggccgcttccggacccgcgccaacgtgggcacccggatggaggacaatctgagttgcaccaatggcttctgcccgtttaacctcttctcgcagaaattgaacggcaaagggataattttcaggtttaaccgtgttccctaaattaacaacatatggcgcgtgaactacgatttgctgtagcccgtgatccttcataaaggcgtgaccagcctcaatgttcagttcatcgatgggcttgcgacgcgtattttgcggtgctccggtgtaaaccatgaacacattttcaccataacttgccgcttctttggctgaaccaagcaacatctctttgcccttcatactcacatgtgaaccaattaataacgtcattttttaattccccctaaaatcacttcggcaactttctgcgaagctgccccatcttcccactcacaatatttcgcgttaaagccagccaattgggaacggtagtcaggaaagtccccctgtttagcaaactgagccacgtacgcatcaaaatccgcttcagtagtggctaatggtccgggaatctcagcttggtaattaaagtaaaaccctctcagctgatcgcgataatgctctaaatcataggcataaaacaacattggccggttgaggttggcgaaatcaaacatgactgaggaataatcggtaatcatcaaatcggtaatcaaataaagattagcaatatcctcatccgcaatgatttttacccgatcctcaaaccctttaatatcaatgtgatccttcaccaaatagtgcggtctcaacaccagcacagcattgtcatcaacctgttcaaaaaagcgttgtaggctaaacggcagttcaaagtgatactggccggtttgaatggcatcatcatcccgccaagtcggtgcgtaagtcatgacggttgcgttggcatcacccactaatcgctgcttcaactgttgaatcgctgctggcgtattttgacgatacagcacatcgtttctgggataaccaatatccaaaaactgattgtgaaactgaaaggccgaccgaaaaatttgcttggaatagtcatttggcgcaatcagatagtcccaacgcgcagcttcacgagtaaactgacgataataatctgtggtttttgttccaggaatcgcaacgtgctcaatgtccacacctaaatgcttcaatggtgtcccatgccaggtttgaatgtagaccgtccctttattcttgtgccaccagtttggcagtctggaattcaagacccaaaaaccagcatgagccatgagccacacccatttaaacgaaaaccgtttcactaactgaatatctgggtacttcgcgtgcaacgcacgatagcgacgtggtttaaccccaaagtaggcggttttttttaactccggacgatcagcaaccaactgatgataaattgctgccggattatcgttaacatcgttaccattaaaactttcaaacatgatcagatctttttttgccgggatacaaataaacccatcgtttaaaacgatgagtccatagcgaatcacgatttttagacctttgatgacttggtttttaagtccagccattttcatcgtaattcctccttgtttatttactaaattaaatcgacgaaacgtgaacggaacttgtagtgcagatgtgagccgactaataagaagaacaaaacaattagccagaactcaatggtcaacgtcggccgttgccagaaccagccttgccctaacatggcttcccggaaaccagaaaccacgtagaagaacgggttcaactgtaaaagtcgggtgacaactggtggaaaactgccggtttcaaagttaaacagcacaccagaaatatagaacaacatccgcattactgactgcagcaacacatgatagtcacgaatcaagattgacactgctgagttaaaaatcccaaaggcaatcaagaacatgatcatgcagaagaagtagtagatccattcaatccagtaaatgcttggtcggataccataaatcaacccaaccacgattgacactactaacatcgtccaaaacgaacttaaattcgacacgatcttaatcgatggcaaggcagaaaccggaaacttcatcttagaaaccatgctgacacgttgatagatactcttagacgcatccaacgtcgcccggttcatgaagaaccaaggagtgattccgataaccatccatggtaagtaatcaacaccgctgctttgaccgtgcttaaggccaacaccgaacactagccagtaaatacagatctgaatcagtgggtataagtactcccaaactaagcccaaataatggctttgataactggcacgatcttcgtattttgaaatccggaaaatcatacctaaactctcaaattgttccttaaataaggttacgacctctttcaaaggttaacactcctttacgccacttattttgctaaatagtgacagtaatattccacaacccgttgggtcgcatgaccatcattataggtattccaatgatggttaaacctggtaaaatcagtttgactatcagctaaaatagctgcctttagttcagatggcgtccgcaaaggtgctgacggtaaccactttaaaaagtggggttgaatgccagggttttgctggtattcttctaaatcagacatatagaaaagcaggctatgagcgtgtggcagcaaactataatcgaaagcaatggacgaatagtcagtgatcaacgtctccgttaccatcagcagatctgtggttgacagctgcggataaaaacgaacttgatgcgtcgtcgattgactgaaacgctgttcgtacttttgcagcaacgggtgaagcttaatcactaccaccgcgttcgggtctgccaccagtgcgtctttcagttctggcgtcaattcaaacgtcatcgaatcccgatacgtcggtgcgtataaaatcacccgatgcttggtcagtcctggagctaaccggttgattcgattcagcgcgccctgttgccacttagctgaaaagaaccggtcagaccgcgggtaacccataagcttcatccgtgaccgtggtacgcgataactgtcctgaaaaacggtgcccatggcgtctgacgccactacgtagtcatcaaactgatcgtacactcgctggaaacgacgctgatcagctttcgatcgatgactggtttttgggtcaccccagccaaaacgcttgatggccccattagcatgccatagctgaacgatcttggcatgacgcggatgtaataacccgcctaaaaacgcataataattatcgcagaaaatcagccgtgaagacatgatcaccggaattcccgtaaaaacaaaatgcaagttatcacgaaacgggatcactttcacaccgtaagctgcgagttgtgttgcttctacctcaacgtcaggtcgataaaacacgaccaactgctgatcttcaggtaatttatcagccagagctagtataaacttcaaattattgccgaaactcatcaggtaaataactgaatgaaccctgcctcgcttaaagaagttcagcacagatatcaaccggaccagccaaatataaatgactttcacagcagaccaccaattctattttttcctgtgttacgccaccgaacaaccggcgtcgcaacgcacaacatggtattataccacattcatattttaagtaactggcttttatgagaatttaagaatttgtccaagaacgggcatgacatcaatctactttgacgtgatctgccactaatttcttaagttcaaaacggttaaaaacgtaaataatgcctattcccgcaacgttcaccggaataggcattatttacgttagatcctagaatccgccgagctgtgtcacactctctcacaacttcggttcataaaaatgacccaaaactttataaatttctgaaacactgacaaaagcactggaatcagcttcgtccatagcttcctctaaatcggacatttcataacgcgaaataacggtaaacaggatggttttcgtgtcgtgatgatacgcaccttccgcatcgtggacaatcgtgattccacgccgaatatgattttgaatagaatcaatcaccgttttcggccggtccgtaatgatcatgacctgcattaactgctgacgagtatacgtcatgtccatgactctggcgttgaccactaacccaatagcggaataaaacgcgtgaggccagccatacaggaacccggccgctaaaatgatcagtgaattaaaggcaatattaatggttccaatagaacgccctgtcttacggcggatcacaatgcctaaaatatccaacccaccggttgagatcccgtttttcagagctaaaccagtcccgaagccgttcacagcgccaccaaataacgcgcaaataatcggatcagtagtcaaatgaaccggatgcagcattttgatcattaaactggccagaaaaaccgtaatcaccgtgtacatagtgaaattatgactaatttgccgccaagctagcacgaacaatggcacgttcagtaaaaacagccccaccgccgttgaaattacaaacgtcaggtgccgttcggttaacgtggtcacaatttgagctaacccggtaatcccagaggaataaatatgtcccggtgtccaaaagaaattcatggctatcgaaaccaaaatgccgtatataaatgcagtagaaatttttccaattgattgatggcgtttgactaaacgctgtacatcatccataacaaaccctcttatccaatcataggttactatcagtatcttagcatagcataccttttcctaccgcacagcattcttttcattttctaagaactagttcatttagtttcggatttttgccaatgctgattaacgaatttttcccgtccaccagcttcttccatggcaaaacgttcaggattcttgcggtaaaattcttggtgttcttcttctgcttcatagaaaggtttcgcgtcctcaatttgagtgacgattgggtcatcaaactgattgctgtcaatcaaagcttggcgagacttctcagcaatctgccgttgatagtcatctttgacaaaaattactggccggtaattatccccgcgatcctggaactgccccatggcatccgttggatcagtctgctgccaataaatttggaccaacttctcgtatgatattacttcaggatcaaaggtgattttaacggcttccgtatgtcccgtggtgtggcttttgacctgttcatacgtgggattggccacgtgaccgccagtataaccagaaacgaccttttcaattcccggctgggtgtcaaatggcttcaccatgcaccagaaacagccaccagcaaaaattgctgtatcaaaatgtttcgtttgttcactcatttatttcacctctaaatttaatgaaataagtataaagcatttagtagtaggaaacaagtaaatcgcacactatcaagttagcaagtccaaatttaatttcaaattggtgctttacaaataataaaataacgggtaagatacccttaaattaaaaaatgattaaagcaatgacgagcaagagtaaactttttctcatttttagagagtctgcgtttggtgcaagcaggtaatgagacaagttgaaagtaggctctgagctgtagatgcgatgtttgagtgtctactgggtgcccccgttatcaaggccagcgaatacgatttgatcgtgctcgctaaggttacttatgtaacgacgacaaggtggtaccgcgcattgtaaagcgcccttcgaagatttaacttcgaagggcgcttttctcattttattttaatttactatctgatcaggaggaatgctatatgacagcatctttgattcacacacttacttccatggaccaaccgattatcccggcggctggcgatggccaaaccatgactttattaagccaatcaagctttcccgcaatctttttggatgggacgttaaccacccagacacttttggccgaaaacaatcaggggttattgaccctatcggaatacgccaagttttgccgtgacatgcagctcaaaaaaacgtcaccgctcatatacgatctgcaatccggctttggtagtccactgaacacctactacgcagctcaggagttggaacgttcgggtgcggataccatcatcttaaatgatcagacttatccctcgcattcacttaaccggccgaccactaccacccccgctgatttacttgggaaagccaaagctgcccaagatggtttagaaaacgacgccaccgagttatggatcaagttagaaggtatctgggattacggtaccaagggcattttacagcgtatccattatctagccaacattggtgctaatgccattatcatcgaccactacactgatgaccagttaaataccattatcgccgcaacgccagagttacctatcatcgcaacttggacaccgaataccccgcataactctggtatcaccgcttggctagatactggctgcctggcacgtcaagcgcagcaagctcgccagcaagcactcactgaactaaagaaaggatcgattgcctatgctgaaaaatgatcgcatgcgtcaccaatttaaaaccgatgttatgagcggccacattgtccgaatgatggttgcgccagatgccctagccgctaaaattgctcaatcttgtggcgccaaagccgtctttagcgctggttacgccactagcgcatcagcccttgccatgccagatcgtggcatcagcgactttggcttcgcccttgagcgttgccgggaaattatcaacgccgtcgacattcccgttttcgccgacgcagacaccggctacggtgatttagataacgtcaaacgaaccgtggaatgttacgaagccatcggtgctgccggcatcttcattgaagatcaagtttggccaaaacgttgcggtcacatggatggcaaaaaggtggaacctaccgaagtacttgaggctaaaataaaagctgccaaggctgcccgaaaacacgatgattttctaatcatgtcacggactgacgctcgcgccgtttacgggttagatgacgctattgaacgtagcaggcgctacaaagcagctggcgcggacctgatctttattgaagccccacaaagcagtgaggaattggaaaaaatccacgaagctttccccgatacgccaatgatggccaacatgattgaggatggcaagaccccgctgacaaaaacggaagatttggaacgactcggtttcaacattgtggttcaccccaacgctatgacgtacacgcaaacctacgccgaagagcaactagttaaaacattgcaacgggatggcaccactaaagcttacaaagatcacatgatcactttccccaaattcaacgagtttgttggcttagataaagtcaatgctagagacgcaatgtacgcaccagaaaagatggcgcaattcatgactgactaacagtattcataataataggaggaaccgccaatggaagcatctgcaatgaatctagaaacccaactcaacacagcaaaagaaaccccactattctataaagttttcggtttagcgggtgccggcatcatgttagatgccgccgacgtttacatagcaggcgcgattaacggcgccatcaccagctcaggatttgcgagtattcagcaaggctcaatgtttctctcaagtggctttctaggtctctttctaggatccctgctggctggttacatcggcgacttttatggccggaagaagtcctatcaatataacctcctcttatttggagttttcaccctactttcaacctttgcaccgaacatcattatcctgaccattttccgttttctagccgcaactggtctgggtgcagaaattgttaccagctacgccatcgtcaatgaattcgccccaatcaagcgccgtggtcactggtcaggtatgactgccattgttgctaacagtggtgcacccattaccttattgattgccaccttcatgattccaaagtttggctggcgctcaatgttcttattaatcggtatcctcgctttgatcctgtggttcgcccgtcgtcatttccccgaatcaccccgttggttactctctaagggtcgcaccgaagaagctaacgccattatcaagcaactcaccactcgcggtctgtacgaagaaggcgagcttcaagataaaaatgaaatcattagccacattagtttcgcaaaagggttgttcattgccatcatcgccgttagtgctaccctactttgccaatacacctttaccacttgggtaccaactttgctcctcaaacgaggcatcagtatcgttagttcaatcggtttctcagccatcatgatgattggtgcgccaatcggctcagccatcggtgcaggtctagttgaccgtgccggtcggaaaaaagttatcattcctggtttcattgccgtagctctgttaggtatcgcttacgcttacgaaaccaccactttaggcattatcatcaacggcttcttactcacggtgaccctctacatcttggttgcaaccgttgttagtatctataccaacgaattgtttgaaaccagccaccggttccgtggtgccggtatcgctaatggtatctcaaaattgttgaacgttttgatgccaacactggttgctttcatcatcaccagttcatcaccctcattcttgtactatggcattgcagcaatcgcgattgctgcagccatcatcatcgccttctttggtccagaaacggatcaaaaagcgattaaataatgagtgattacatttaaaaagctgcattctcgattgacgggaatgcagctttttaagattcagactaaaattacttatcttctttgccttcatcgtcatccttagtcacaaacagactcaaatcttgtaattgtctgtctgaaaccgtggttggtgctgaagtcaatggttcgatagccttcgagttcttagggaaggcaatcacgtctcgaatgttaccgcgcttagctaacaagcgggcaaagcgatccaagccgatagccagaccaccatgaggcggaaaaccgtaatccaaggcatttagcagataaccaaattggtcttctgcccgttctttagtaaagcctaacgccttgaacatcttcatttgcaggtcacgggtgtgaatacggattgaaccgccacctaattctagaccgtttaagataatgtcgtaactttgagcataggctttgtgaggatcttcgccttcgtccaagtaatgttcatcgccagcctttggcatggtgaatggatgatgggctggaacccaacgcttcaagtcaacatcgtagtcaaacagtggccagttaacgacccagaggaatgcaaacttcgattcgtcgatcaagcctaattcgttagcaatggtccgacgtaagtaatccaaagtttgggcaactacacgactggaatcacaagcaaataacagcaggtcgccaggtttggcaccagtgcgttcagtaattgctttgtataattcggcgttatccttgaagaacttggcgattgggccagtaaagttatcttcagtgaccttcaaccaaggtaatcccttggcgccaaaacggtcgatatgttcaacgaacttatcgatatccttccgagagtacttatcagcaccaccaggaacggcaatcgccttaacttggccgccatccttgagcacgttgttgaagacgttaaagcctaggtcatcaactaagtcgcccaagtcctttaattccataccaaaccggacatctggctggtcagtcccaaaccgggccattgattcgtcccaatctaagcgatcaaatggtaatttaacgtcaatacccaaggtttctttcataaccttagcaatcaagccttcagttagatcctgaatttcttcagcgtccaagaaagaagtctccatatcgatttgggtaaattctggttgacggtcaccacgtaaatcttcatcacggaagcaacgcgcgatttggtagtaacgatcaaagccagcacccatcagcaactgcttgaacaattgtggtgattgtggcaacgcgtagaagtgacctgggtaaacccgtgaaggtaccaggtaatcccgtgcgccttctggtgttgacttggtcaaatcaggggtttcaatgtcgatgaagccttgtgagtcaaagtaactgtggactgattgggtgatccggttacgaatcatcaacccacgctgcatttctggccgacgcaagtctaagtaacggtacttcaaccgcagatcatcagacacgttgatattatcttgaatgtaaaatggcgggtttttagccttgttcaacaggttgatttctgagacccgcacttcaatcttacccgtgcgcatcttgtcgttaacttcgtgttcagcacgaggaaccacgtgacccttaacttcaatcacgtattcgttccgtaactgatcagcaacagctaaggcatccttgtcgaattcctcgctgaatactaattgaacgattccttcacgatcccgtaaatcaataaaaatcaaaccgcctaaatcgcgccgtttttgaacccagccctttaagacgacatcttgatcaagatatttttcgtccaccagaccggcgtatgttgttcgcttcatcttattctcctcttaatcaatatttgaaattacttcagcaaaatgagtcatcacatcagccaatggcgctgtcacttcattaccagaagtcatgttcttcacgtgaatcgttttagcagctaattcagcttcaccaacggtcaacgtgtaggctgcgcttaagcggtcagccgtcttgaactgtgccttgggcttgcgagccaagtaatcgcgatcagccgagtaatcttgtgaacgcaatgcttgaaccacttgcaaggtggtggcgttagcttcatcaccaataccgaccacgtaagcatctaaatgatgttcttcagggaactgaacgccttcagcttccatcaaaagaatcagccgttccattcctaggccaaagccaacaccagaaacttctggaccacccaattcttcaaccaaaccgttgtaacggccaccggcacaaaccgtggtgtagccgtgacccagcgccttagagtcaaccataaattcaaaaatggtgtggttgtaataatccagaccacgaaccatggttgaatcaaccacgtagtcgatgcctaaagcagtcaaaagacttttcacttggtcaaaatgagcttgggcagcaggtgtcaggtaatccaaaattgatggcgcatccgccacaaacttcttgtccttttcatccttactatccaatacccgcagcgggttcttgtgcagccgaacttgagaatcctcgctaagttcatcatagtgcggttccaggtaatcaatcagggcctgacgataactgtcgcgggactccttatcacctagcgtattgatggctagccgtaaattatcaatgccaaagtgcttaaacaagtcgcgacccatggcaatgacttccacgtctaacgcgggttcatcggaaccaaatgcttccaccccaatttggtggaattcccgttgccggccggactgtggccgttcataacggtacatctgacccatgtagtatgtcttaaaaggcttttgaacttccggaccatagagcttgttttccacgaaggcccgaacaacaccggctgtaccttctggccgcaaactaatgtgccggtcacccttatccttaaagtcatacatttctttagtaacgatatctgaagtgtccccagaagttctggaaaatacttcaaaattttcaaataacggcgtccgaatttcttcgaaccgatacttcttgaatacttgacgcgcaactgcctcaacatactgccagtgctgactctcaccgggtaaaatgtccgcagtgccttttggtcgctgataacgcatagtatcttcctttccgattttcgttgaagttaaaggtgtagaaaaaaataaaaaacacccttgttttcacaagggtgcttcgcacggtaccaccttaaattaactcatccataacgttggacacgaataatcgcttattcacctcaaaagtgtcttcaacttcccgcctgctgtatcttttcatcaaccagatactttctgaaagtcacgggttatttactcatctttttcatcggtgtttcatttatttaactaccaataagactactcagttacccgctaaaagtcaaggacgatttgaccggagactgtatctttaatcgaaaatatcctataattataagaaaaactaatcgaggaactcaatttgaactaccttaaacaacactggcagcaaatcgttatttcgcttgcaattctactaacccttggcattgccgtctttcaaaccgttcgtcaagaccggttaacgacaccaatcgctaacattaacgtgcgtacgggtcctaacattaactatcaaacaaaggccattttgaaaaagggacaggccgtttacatcgttcagaaaaaggacaactggtacaaggtgcgctacaatgatcaccaatttggctgggtggccagctggttgatcaaccaatcaggcaaaattcaaacggcaactaacctttctgaagctacgatcgttttagaccctggtcatggcggtagtgactccggggcgctttcaatcgatcaaaaacacgatgagaagacttatacgctgcaattagccaaaaaggtgcgtaaccagctaactgctcgtggtgcccatgtcatcatgacacgaaccggtgaccaagacgtttcactgggtgcacgaccagaactggcaacggataatcacgccgatgccttcattagctttcattacgactccagtcccagcaacaacctagggtcaggatttacaacctactactatcatgcaaatacttctctcaaattagcccggacgatcaaccagcacctcgttggtttacccattgaaaataaaggtgtcgaagtgggtaactttgaagtgattcgcgacaatctccgtccagcgctactactagagatgggttacattaatactgacaaagatttcaaagcaattgaaagcccagcctatcaaaacaaggtcgctaaagatgtgacaaacggtttgagtgcttacttcgaaaccaaataattgacgaaaggatggattattatgaataatgagtggcttaaacagctaccgattaaaggaattaagaacgtcacaccagtctcaggtggtgacatcaatcaggcctaccgattagaaacagcgaccgacccctatttcttattggtacagccaaaccgtgagcagtcattttatcagcacgaaatcgaggggctcaagttactgggtcaagccgccctggttccagaggtcatcgcttctggtcaaatcaatggcgatgcctacctcatcctatcatggctggaaactggcaccggtgatcaatatgacttgggtcaactggttgctcacgtccatcaaattcataatgaccagtttggcttcgaccacgacgttgacggtaaattacctaagatcaatacttggcaatctagctggggtgacttttacgttcatcaacggttagaagtgctggctaaacgggccgctgaacacggcctttggaaccaaaaaaggcaggaccaccttcagcggctctgccagattattctagattattatcaaactcacgaaacagtgcccagtttattgcacggcgatctttggtttggcaacgtcatgtttactgctgatggcaaaccggctttaatcgatcccgatgtgctttacggtgaccgcgaatttgatttagccatgactacggttttcggtggctttgatgaccggttctaccaaggctacaacgatacctatccgttgcaacctggtttccagcagcgattaccgtggtatcagctttactaccttatggcacacctaaatttatttggcgaaagctacggtagctcagttgaccggattctcagcaattactgaagcagcgcattcgtcaatccaatcacattagtcacgttgatttcaggatgactaggctcaccgtcaatgagacgacctgggtcaaacagggcaccagcaataccggcattgtgtcccgcatcaacgtccaaagttcgatcaccaatcattatggccgacgctttctgaacttcattacgtttaattaaagcattcaacgaagccggattcggtttccgtggaaaaggctgttcgctggtcacttcatcagcgaacagtttttttatccctgcagattgcagcaactgcatggcactttggttgcgatgggtcaataaataatgtgtaccaccctcatcaacaagtcgctgaagcaaagccaccatcccatcaaaaggtttggcttgcgcaatccgtccacgttcattttgccggtagtcatgttctaactgatcagccttaatactgaattcagcactaaatttttgcaaagccgtccctaacgaatgctgccgcatggtttcgtagatttcctgctcgtctaattcaatttcagaaacctgctgctgggtcaaggccgtcatgaaagcttgcaccatgatggggtacgtatcaaaaatggtgccgtcaaagtcccagaaaaaagcttggtatttcatgcatactctccttatagatccgcgctatcaaaaataatcgtcactggcccatcgttgactagactaacctgcatatccgcgccaaattcacccgtttccacgtgaatgccagcgttacgcaacttttgattgaaccgttcgtaaatttgcttagcatgatccggagcacccgctttggtaaaactcggccggttaccctttttggtgtcagcatacagcgtaaactgagaaacggacaaaatggcaccaccaacgtcttgaatcgacaggttcattttgccagcatcatcggaaaatacccgcagtttagcaatcttatggacatagtaatcgatttcgtcttcaccgtctgtgtccgctgccccaaataacaacaagtatccctgtttaatttgaccaacaacttgttcttcaatggcaacctgcgctgaggtcacccgttgcaatacaattcgcaaaataaatcctccttatggataacaggattccacaaattaagacaaaccattctcgttctgatgatcttgacatcagaacaggatgacttgccttaattaaaatccttaatggctatcgatttttgccacagttttttcattaattatctaaatggccgtttaacaacgtaaacatcctgaacgtttttgaggttatccatcaatcgttccaactgttcagcgttgcggatcccaagtgaaattgaaatggtcaccatcttattatgatcgacccggccgttcacaacgttaagctgcttagtggtgccgttaacgatacgcaatacatcgttgagtaacccatcacggttataaccctgaatctcaagatccgcgttatacatggtcgtggtctcgctaggattatcccagtacacttccacgatccgctcgccattagcctcagcgtgagccacgtttggacagtccaaacggtgaactgaaacaccgcgtcccttggtaatgtagccgacgattttatctccgggaactggcgcgcaacagtgacttaaccgcacaagcaggttatcgacaccttcaataatgaccccttcagagggctttaacttccgttttcgctgtgaatcagtctctgattcagtgttatcaatggtctggtgctcttccagcaattcacgttcttcttgacgctgacgctgttcctcacgttgatgacgaacatcttccgtcaaccggttagcaacacccaccggctgaaggtcaccgaaaccaacggccgcaaatagatcatcaatgtgctgataatgcattttatcaacgactttttgcagtttatccttcgtcatcagttccttaggatcaaacttaaagtcccgcagctgctgctcgatcgtttgacgacccgtttcaatgtttttctcccggtctttttgacggaagaactgtttgatcttattacgagcacgccgggtcgaaaccagttttagccagtcacggttaggccctgccgagttagaggaggttttaatatcgacaatatcgccgtttttaacttcataatccagtggaacaatcttgccgttgaccgtagcccccgttgtgtgattgccgacttcagtatgaatttgataagccatatccagcggacccgcaccctttggcagttccagcacatcaccctttggtgtaaaggcgtagacgtggtcaccaaataattcacccttaacactatccatgaaatcagacgcatcatcggtgtcttcttgcaactcgataatctgtttaaaccagttgagtttgttgccagtattggtggtctgaaccttatccgttttaccttctttataagcccagtgagcagccacaccaaattcagccacccggtgcatctcttcagtccgaatttggacttcaagtggccggccttctggaccaatgaccgtggtatgtaaagattgatacatgttggccttaggcattgcaatgtagtccttaaagcgaccaggcattggcttccacttagtatgaatggcgcctaaaacagcgtagcaatcacgaatgttgtctacgatcacccgaatggctaacagatcataaatctggctgaactgtttgtgctgatcacgcattttccggtaaatggagtaaatgtgttttggccggccgtaaatctcgggatcgatatgcaggtcatcaatggcatgcttgatatcttgaatcgcttcagcaatgtagctttcccgttggtcacgacgggaattcatcaaatgaacgatgcggtaatactgctggggattcaaataacgtaacgaaatatcttccagttcccacttaatagcactaatcccaagtcggtcagccaatggggcgtaaatttccaaggtttcattggcaatccgacgctgcttatctggccgcaaatgctgaagtgtccgcatgttatgcagacgatcagctaacttgacgatcatgacccgaatgtccttagacatggctaacagtagtttccggtggttttcagccagccgttgtttattagacttatacttgattttaccaagctttgttacgccatcaacgatcatggcaacatcgtcaccaaataactcccgaacgtcatctaaggtgacgccggtatcctcaacgatatcgtgcagaaaacccgaagcaatagttgttggatccatcttcagattagctaaaatacccgcaacttgtatggggtgcataatgtatggttcacccgattgacgaatttgatccttatgcgcaatcgctgcgaacttataagcacgttcgacgattgctacatgatccttattcatataagctgatacggcatcgataacgccttgagctgtccaagtttgctctctcgacatccgatcacatcccctccgtggcacttaggccataagctaaataactgatacaaaggtaaaccggcacgaaatataacgcgtatttcggtcctgacaattgaatccccaaggcgaacaaaacgggcaacacaaaaattagccaccagcgatcgccgcgatgtttcacaaaatggccgatcaagcctgctactacggaataaatcaaaccgtatatgacgcctgaacgccagaagccaccgattgaaacgttgtttaaaagaaccggaacagccagtcccaagataatgctgagtacccaataaggccagccaatgcgttttataactgtcatgttaactcactctcttatttaatgaatggtttatattttagcattattttacaccattggatagcattcgatcattgtaattctaacatggtcgataccgcggctaaaaagtacagcggtgcggtttcagttcgcaaaatacgcggacccaatcctgccactgtggcctgcttttcttgaagaaactgcatttcctttggtgaaatgccgccttccggaccaaaaacagcaatcagtcgctgtcccggtttaatccggttcaataatttaaccagctgcgcctgctcaccctgcttagcagcttcttcataggctaccagcaaatgatcgtattccagctcggcgatagcctgtttcaacgtctcaaagtagcgcaccgttgggacgtgggtccggtgtgcctgttcggcggccccttgcgcaattttttgcaaacgggtcaactttttactcaatttgttcgactgccacttagcgactgaccaatcagcaccaaagaagcagatcgtgttggcacccatttccgtggccttttgaacgatccattcagctttatcctgcttgggtaagcccgacagaatcgtcacgtcgactggtagttccacgttcgtttccaatgctttgaccacggttaccgaatgatcttcgttgagctggcctaaatagagattttcctgaccatcgacaaattctgcctgatcacctggaacaccgcgcatcacctgcagccaatgttttgacaccacagtatctaattcaaagtgagcatctgtttttaaaattggtttgataaaataccgttgcatttattcatcgtcccctggcttttgagcgatcacgccgtaccaatcacccatttttagtgtttgccgaattttgaagccctgcttacgctgcgcatcaagaatttggtcaaccttttctgaaataatacccgatgtcacaaagtaaccatgcactggcagtaactgccacgcctgtggaatcaacggaatgatcacttcggctaaaatattagccacgataatgtccgcttcaccagtaacgccctgaagtaagttattcgctgcaacagacacatccgccgcaacgggattcagtgccagattctttttagcggaatccaccgcgacttcatcgagatcataagcccgaatctcaccggcacctaactgtttagccgtgatactcaaaacaccagaacccgtccccacatcaatcagccgttcgccaccgtggatcaccatttccaatgcctgcatggacagtttggtggttggatgggttcccgtaccaaacgccattcctggatcaagcttaatgatccgttcgtcttggttttgaggttgataatcttcccaactaggcaccaccgtcaaaaagcgggtcacctgtacgggatgatagtatttctgccactcagttgcccagttagactcgtcaactttatcagtggtgactttggctggtgcaatagctaagccaaacgtcttgagttcatccacccgtcgcttgatttccggcacaatttccggtacataaatcgtggcgggaaaataggctgttacctgagcaccactttgaacgtgaggaatttcatccacgtttaaaatttcacccttttgcgcccaatccgttttttcaagctgctcatagtccttttcatcatcaatttgcacgccagaagcgccctgttccattaaaaggttactaactgcttctactgcttcattagttgttgttacggtcactgcagtccaatccattgttgttccctctcttttctagtctagtaaattctccaaaaaaagaacgccaaagttacttagcgttctcctcatcagtctgatgttcctgttcttctttttgttcccgttgcggtaagcgagattcaagatagtctaataattctttttcggttcggaagatccgtggatgcttttgtttatgcagtctcagatcgatttcattgatctttcgacgaccagtccacgtatgactgtaccggatgattacccgattattcagcgcctcccgaccaaacttaaagacataaacactttcaggagtcatcagtggccgaatataagacttttcatactgatagtttcggctctttaagtactgtttggtttgatttagcacggtaaccacctcccaacgatttttttataacccgctaagttactattaagtacatcatatcatatttcacttgtaagcaacagataacagggttattccgctctttaaaaagaacatactactggattttggcataaaagtcaaccaagttattaaataattctcatagaatattcgggatattttcatcataccgacccatccgctgttcgtgcttgcttttatgggtggaaatagtattcttgaaccatgaacgcttaaaagtcagaattaaaggggaagtttattcatgattaaaccaaccaaacatttgaatggctttgattgggttgaaacaacggccttaacagaagccgaacagcaaacgctaatggccgagtatggcatcaccgacgatatcatcacctatgtcactgataaagacgaaacagcaaattacgtctatgatccagcaaataatcagcagctcatgattgttttggtcccctaccaactcaaaaatacgcaaatgccacgctacatcacgcggccagttggcttcttaattcatcaaggcgttttgttcacctttaatgaaagccgcttaaactttgttgaacaagcttttcaaaaatccgctgatgatacggacattaacaccacttccgcctttattttggaatcaatgttcgacttagtggatagttacattcccatcgtcaagtttgtcacgaaacagcgtaaccagttagataaaatgctcaataaagatgccaaaaactccaacttaatggcactgtcatacttaggtcaaacgctaaccttcttcaacagcggcgttgaatctaacaacgatttgttcgcccgaataccacgcacctactttggtgtgaacaacgatagcattgaaaacgatctgcttgaggatgtctccattgaatccgaccaagtccagcacatgattgaaaacgaagaacaggtggtcaaccggattacggatacgtttgacagtatcattaataataacttgaatgataccatgaagttcttaacgatctggtcgctaaccatggctgtcccgaccattgttaccggctttttcgggatgaacgttaagttaccattagcacactttaacggtgcctggctgatcgtgatcggcttgtcagtaggttttatcgcttggctattattgatcttcaaaatgcaccatcggttatagtttttttaaatcatccctaatacaattgataacttgacaagtctttgatatgctcgtaactaattaattgtctaaaactttgaaggagtcaactttatgaaaattgccgttgtgactgactcagccagttatttaacaccggaacaggttaaaaacaacgatattcacgtggtaccgatcaccgttattttcggccatcagacgtatctggataacgttgaaataacgaccagtgaattttatcaccgcttgaaaactgacccgcagatgccaacaaccactcaagtcacactgggacaaatgcagactatgtacgatcagttagctgacgaaggttatgatgcggtcattagtatccatctatcatcaggcatcacgactttttacagcaacttggttaattacctgccaaacgtgaccaatatcaaggtctacccctttgattcttgtattgcatccgctggtgaggccgacctcgtgatgttggcggccaaattaattcgagctggtcgttccccggaagagattatccaggcactcactcgtttacgcgacaccattgacgcttatttcgtggtagatgacctttctcacttggtacgaaccgggcgcttatccaatgcctcaagttttgttgggggcttgctgcggatcaaaccgattttgacctttaacgatcaggctcaaatcgttgccattgaaaaagaacgcaccatgcgacacgcctatcagcgaatcaagcaaaaatttcaaagcgtatacgaacaggctgattatccactacgtcttactgtaatcgatgcgaataatgacgaattacagcaggaatggtcagctgatttgagtcaacagtttcctaacttaaaaatcgcccacagtgaaattggtcccgttctcggcgtccacgttggtgctggcaccatggccctattatgggattatgactgggaacagtggccagattcagtcactaagtaaagaaggttttaaaatgaattttttctctattggcagtaagggtgatacggactacgtttcccgacacgattttattgatcatttaaaccaggatctgaatcacccagacttcgacttttcacagctgccaacacccaaaaatcaggcagagtaccagcaattattaggatttattcaaaaacagattttaccgcgtttaaaacattagcgtgtgaaaaaataagggttcaaaacggaaattacctgaactttggtaattttgttttgaacccttatttgcaactctttgtttatttaagcaggttttagctataaaaaaataaattttcttcaatcaaggaaccagctagaattttgatcaatatcggctgacgtcacaactggtccatcttgttttatcctattttacagatgtttcttaatcagtgcttcaaactccgtgaccgaccgcggtccaatcaccgcatccacgatttgaccgttctttttcaaaataatggtcggcgtactttgaacccccaaggcccgcgcaatcaatggttgacgattaactgtcagcgagatgaatttgacttgctgagcaagctcagtctgactcgccagataagttaacgcgcgatccgctgccgtacatggcggacaccaatccgagcgaaaatcaacgagaactaaaccatcgtgcgtctcttccgcatacgcggtatcttgaattggtttgattgctgtcatccgtactcgtccccttttaaactttattatataacaattcaatttgatcgtcgtcattgccgttttctgttttaatcaatcaactgaataagccttaattttaaaacacttagcttccaaccacctttttccgcgcgatacataaaatgatatgagtttatattggcaaaggcctcacttacttgctatattggaatagtaatcattcactacttattctaatatatctaatttgggaggataccgaatatgtcttcacttggaaccatcatggtgcttatcagcatcattttatttatgtattggggcgtccggctttttaaacatcagtccagaaaacggctgggctggagcgccttgatcttattaatcttgggcgtagtcattgcaagtcctactgacgatcattcggccagtaaatcgactaacgaacaatcaagcagtcgggctgaattaaagtcttccagctcatcatccagccacgctactaaaaccgttcatcagggtgctaaacctcaggcgcgccaatcagaaactcacaatagcgtaagtgtcctaaataaactggtgagttacactagcaatcaatcagctggaccaactggtaactactattggcacgttggcaaagcacatctaacgggcttcggtagcctagcaaatgggcaagctcgctttacagctgattcacagcaacgacctgccacggctcgtgctaaactcacctatcaggaatacgcctcgtcaaaaggcggccgacaaggtgatccactagaaccttacgcttggcctagtcaaaatccaatcgtggcgatctcctatgctgccaccggacgaacttatcatggttatttatggaatcgcagtcactccattggtgatagcttattaggtgctaaatcatatacttccgtcaataacttcactacgggtacccgtccgcaaaacgtgggcgcggacaaagatggcggtatgcgttacggtgaagaaacggttgaaaattactggtcaagccatcctggtactcaccaaatcgttgaataccagaccacacccatttatcagggcaacgaaagtcttcctcgtggttcactggtcgatatcaaatcttcggatggtactattaacactgaaattgccgtgatcaacgacgctgaaggcatcaagatcaactataatactggtgctaataacgctaaaccgtatcatcgcgccaattcaacgacgtataagcaaccggctaccgcaagtaaatcaacgcaatcgtcgtcacctgctggctcacacgccactacttctggtaaatggcacgtggctaaatctggttacgtttttgtctcacagagtaataaatactatacccgggtaactaacccaggaaattatacctgtgagcctaaagcaaaagcccaaagtgatggtgcaactgaagctattcgtgggaatgaatatgcacaaccttaacattagtgtgtgacacaacttggtagattccagaatttaagccaaataatccccgttctgataaacatcatcagaacggggattatttggcttaaatggccagaatctgagttgtggcgcagtattaggtcatatcaatagcatgagcaagagaaaattgctttgacgattccagttgaaaaaatttgaaactcttctatttggttgggatcagtaaaaaaagcacccggacatcatgcccagctgctcatttactgattcaaaatcacttcgtattattctcttcctcgtccgtttgcaataccgccataaaggcttcctgagggatatccactgttcccacagacttcatgcgctctttaccacgcttttgcttttccagtaacttcgcacgccggtcaggatcaccggtatgaattcttgcggtaacatccttacgataagccttgatcgtcgttcgagcgataatcttagcaccgatagctgcttgaatcggaatttcgaagttttgccgaggaataatgttcttcagtttaaccgcaatatcacggccacgcttttcagcaaactgacggtgagaaatgaaactcagcgcatccactttatcaccgttcagtaagatatcgatcttaaccaaatcactttcacggtaaccgtccagttcgtaatccaatgaagcatagcccttagtggaagatttcaatttatcaaagaaatcgaagataatttccgaaagtggcatcttatagatcacattaacccgataatcgtccaaatattccatcgtaacgaactggccacgcttccgttggcagagttccatgactgccccaacatagtcgttaggcgtcataatggttgctttaacatagggttcctcaatggttttaatggcagcaacatctggcatttccgaaggattttccacttccttgaccgtgccatccgtcaaattagcgtggtatgttacggaaggtgccgtggtgattaaatcaaggttgaattcacgttctagccgttcctgaaccacatccatgtgcagcatccctaaaaagccgcaacggaaaccaaagcccaacgcctgggaggtttctggttcgaattcaagtgccgcatcatttaatttcaatttttccagtgcttcacgcaaatcttggtacttcgcattgtcagttgggtacaatccagcgtataccattggcgccatttcccggtatcctggcagtgccttctctgctggattggcagcgttggtcaccgtatcacccactcgagtatcctcaatgtctttgatgctggccgtaatatagccaacttcaccggcaatcaattgatcccgcttaagcggctttggtgagttaacccccacttcggtcacttcatattcggcaccagagttcattagtcgaatcttatcaccaggcttaacggtaccttcaaataagcgaacactaagcacgaccccacggtaatcatcgtaaatggaatcaaaaattaatgcccgcagtggcgcctcaaggtcaccatctggagcaggcactttatgcacgatctgttccagcaaatcttcgattccaatgcccttcttggcacttgccatcacagcatcagaagcatcgattccgataacatcctcaatttctttgcggactttttccggttctgctgaaggtaaatcaattttgttaattactggcaaaatttccaaattatcatcgattgccaaataaacgttggccagcgtttgggcttccacaccctgagcagcatccaccactaacacagccccttcacaggcagccaaactacgtgacacttcataagaaaagtccacgtgccctggggtgtcaattaaatgaaactcgtacgtatgaccgtctttggcgtcatacgtgagctcaacagcattcaacttaatcgtaatcccgcgttctcgttccaggtccatattatcgaggatttggtcttgcatatcacgcttggcaacggtatccgtcatttccaaaatgcggtcagctagcgtcgacttaccgtgatcgatatgagcgacaattgaaaaattccggatatctcgttggtgcgccttcatttgttcaagatccatctgcattctcctaccttttagtttcaaacatactagttattataccagatacaggacaatatcacctgtaccggttgaaattcacaccgaaacagcaaaaagtcgcctggtcaatgatcaaccatgcggctttttaatgtccgttagagtaaatgatcatcactccgctgaactaattatcgaatgcatctttcatcttgtcaaaaaaattacctttgccgttgccaactttctcgccactggcttcagcataagccttcaaagccactttttgcttcttgttaagattcttaggcgtcacaattttgaccgttactcgttgatcgccactgccgttaccacgcagacgtggtgcacctttaccctttaaacggaagactgaaccagtctgtgtaccagcaggaatcttcagtttaacatcaccatgaacggtttgaaccttaatttcatcaccaagagctgcttgcgtgaagctgatatccttatctaagtaaatatcggcaccatcacgtttaaagaccttacttggcgtcacacggaacagaatgaacagatcgccgtaaggaccaccgttctcacctgcttcaccctgaccttgaagccgcatttgttgaccgtcatccaccccagcagggacgttaacttcaacttcatgccgttcttcttcgtgacctgaaccgccacaagttgggcacttttccttaatttctttaccagtaccatgacatactgggcaaacttgctgactgcgcatccggcctaatggtgtgttggtttccgttgttacatagccagaaccgccacagttggaacaagtttctgggctagtaccaggtttggccccgctaccgtgacaagtatgacattgggcttgacgattatacttgatcttcgtcttcttaccgaaaatggcttcttcaaacttcagcgtcatctcgtactgcagatcacgacctggttgtggtgcgttaggattacgacgaccgccaccagcgccaccgccaaagaatgaattgaaaatatcttcgaaaccgccaccgccaaaaccaccagcgtcgccgaaaccaccgaagccaccagctccgccagaaccgccgccgaagccttgaggaccatcagctgaaccgtactgatcatagttggcacgtttttgttcgtcacttaaaacttcataagcttcagtaacttccttgaatttctcttcagcaccaggcgctttgttaatatccggatggtacttctttgataattggcggtaggcctttttaatttcagcttgagatgcatcttttgagaccccaagcacttcataataatctttaccagccatgttaacctcctaaaagtaagcattgtgtccaccgcaatcatctaattgctagtttatgacaacacatttggcctattgaaatgaccattttcaaatcacatgatcatttaaaccaataatcgttcactcaagtagaatagcatatttcctacaaaacaaaaagccaaagcccgcgtttgagccttgacttcctgtctgctatctcgttaatcattactttttatcgtcatcattaacttctgagaagtcaccgtcaaaggtcttaccgtcgcccttgccatcatcagttttacctgattggtcgccacttgcttgtgcaccgtcagcattggcagcgccatcagcagcacccttttggtcttgagcttgttgataaagtttaactgaaaggtcttgaacgatcttgttcaagtcgtccttcttagtcttcatttcttcgacgttgttatcatcttgagccttcttaagtgcatcacgtgcatccttggctttttgaatttcgtcgtctgaaactttgcccttaacctcgtccaaagtcttgtcaaccgtgaagagtaattggtcaacttcgttcttcaagtcagcctcttccttacgcttcttgtcggcttcttcgttttcttgagcttccttcatcatcttgtcgacttcttcgtctgaaagaccaccggaactcttgatggtaatcttttgttccttaccagtacccttatccttggctgaaacgttaacgataccgttccggtcaatatcaaaggtaacttcgatctgaggaacaccacgaggtgcagctggaatgtcagttaattggaaattacccaaggtcttgttatctgcagccattggccgttcaccttgcagcacgtgaatatcaacggctggttggttgtcagcagcggtactgaagacttgtgacttgctggttggaatcgtcgtgttacggtcgatcaacttagtgaagacaccacccatggtttcaataccaagtgaaagtggggtaacatcaagcaaaacaacatctttaacgtcaccagttaagacaccaccttgaacagcggcacccaaagcaacggcttcgtcagggttgatggagtggttaggttccttacccgtccacttcttaacggcttcttgaacggctggaatccgagtagaaccaccgtttaagataacaacgtcaaggtcatcagctgataacttagcatccttcaaggcgttttcaacggggattcgagtcttttcaactaagtctgaagttaattcgttgaacttagcacgggtcaaagtggtttccaagtgaagtgggccgttatcgccagcagagatgaatggcaggctgatttgagtttcagtcacacctgacaagtccatcttagccttttctgaagcttccttcagacgttgcattgccatcttatccttagaaagatcgataccgttatcagccttgaattgttcgatcaaccagttcatgatgcgcttatcgaagtcgtcaccaccaaggtgagtatcaccgttagtagaaagaacatcgaacacaccgtcacctaaatcaaggatggaaacatcaaaggtaccaccaccaaggtcataaaccaggatcttttcgtcagcatcctgcttgtcaagaccataggctaatgaagaagcggttggttcattgatgatccgcttaacatccaagccagcaatcttaccggcatccttagttgcttgacgctgagaatcattaaagtaagctggcacagtgataaccgcttgggttaccttgtcgccaatgtaatcttcagcaaagtctttgatgtactgcaaaatgtaagcagagatttgttctggtgtgtagtccttaccttcgatgttaactttgtagccggcttcacccatgtggctcttgattgaagaaaccgtgttggggttagtgattgcctgacgcttagcaacggcaccaacggatggtttgccatctttgaacgctacaactgaaggggttgtacgaccaccttctggattaggaataattttaggttctttaccttcaagaacagcgactgctgagtttgtagtccctaagtcaataccaataattttattacttgccatgaataatttaccctctttattttaagtttgattcaagtgattgcattattgcgcaaccatgaccattgctggacgaaggacccgatccttcaaacggtagcccctttgcagaaccttggtgacgtgatctttttgatcatctgactccgctggaaccgtttgaacagcttggtgaatattcggatcgaacttctcaccttcagccttgatttcagtgacaccattgctggtcaacgcatccatcaagtgcttttgaaccatttcaattcccctttttaaggattcagcctgctcaccttcaaccggcgtactcaatgcacgctccagattatccagtgccggcaaaatatcatgtgccaactgctgaccatcatacttgatcaaagctgcttgatcttttttattacgattctgaatattttgaatctcagcttcagcacgtaaatattgatcagaagtcttgtcgagctgcttttgtaagctgtcgacttgtgccagcgcctttgctaaagcatcgtcagttgcaggcttcttatcctttgcagaagcagctttatccgctgacttagctgcgtcagtctttggctgctgcttgttaccttttgcattacttttagcagactgctgtgtgtctttttgctcgtccgctttgttatttgctgcttggttttccttatcttcagccactataacacccctttactactgatcaaaatagcgataataatcaatgagccgctgcgctagctcttgccggaaagcaccgactaaaccaatcatccgtgaatacggcatccgtgttggtcccaataaggcaatcacacctttaccatgatccccggcctcataggttgcagtaattaaactgtagtcctttaagatatcgttggtcatttcactgccgatcttcacctgaatacgatcagatggcttacctaaaacgtctgccatatcatcactgtgatccattaaggtatacaacgacttcaattcatccacgtcattactgtcagaaaaactcaacaggttgagacgaccaccgacataaaaccgctcttgagcggcctgcgtcaagacatcgccaaacacctttaagaatccctcaggctgctgcaaatagttagcaacctgcattggaatgtcagacttcaacgcttccagtacttcgtctaacggcttgccaatcaactggtcattgatcagtcgcaccacggcttcaagctggtcacccgtgattttcggtgtgatgttgaacgtttgtgactcaacatcgccgttatcagtgactaaaaccgccatgacctgccgcttgcccaatggtaccagcctaaacccactcaaccggctttgtttgtgctccggcttaagtgaaaaagcagtataggacgttaaattagataaaattttcgccgatgtttcaataatttcgtcaattttaagaaattgaccttcaagtgaagacttaatgatgtcaatgtcattggctttgatcggatccggctgaaccaaatgatccacgtagtaacgataccccttcactgaagggattcgaccggatgaagaatgggtcttggcaatcaagcccagttcttccaaagcggccatttcgttacgcaccgttgctgagctgacgtgcatcggcaactgtgctgctagcgccttggaacccacaggaacaccactgctcgtataatcacgaacaatcgcttttaaaatcatattctgtctgtccgttaacgtgatcatcacctctttttagcactcaaacagttcaagtgctaagacacatatataatgtatcaaacgctgttttttaagtcaagcattcagctaacatttttagcaattaattcattcgagtgctaatttagtgactggatgtgccttaaaatagttttttgtgtcctcggcatcctgatttaattgatgcactaatccctcaacggaatcaaatttaatttcaccacgcaaacggtaatcccattccacggtcacaacttcaccgtaaatggcttcgtgaaaatctaatagataggcttcaaccgtcactggacgtccttcaccaaacgtgacgtttcgaccgatggacgtcatcgccggatgccatttaccgttaactttgacacgggtcacgtaaacgccgatgcctggcagccagtacttagcatcatggctgacattagcggttgggaaacccagagttcgtccccgcgcttcaccgtgcatcactgtaccaacggtctgatagcgatagcctaatagactatttactgttttaatatccccttgatctaaattatgacggattcgcgaagaaccaatcttttgagcctgtagttccttttcgcccaccgtgacgatttcaaaacgtcccttagcatactccggcagttttgccatggttgcaatctcttttggcccgtatgtatggtcataacccgcaaccacaacctgcgcgtgaaaggcaatcaaatagtggtccacgaattcctgcggtgtttgagcagcaaattgactggcaaagttgatctgataaacgatatcgacaccaagctgttcaaacaacgccattttgcgggcgttaaccgtcaaatagcggttgcgttccggacttaatttttgataaaccaatgccgggtgatgatcataagtcaaaacggctaatgccacgccccgttcatctgcaatgctgcgagcacggttgatcaccgcctgatggccaagatgaacaccatcaaagaagcccatagccaaaacaaccggcttgtcaatgacgtcagccgttgttaatggatgatgaattttaattactcgcatattattgtcccaactttctacttagtactaaacatttttaacggtttataacggttttcaacccgctgatataagcacttgatttgtccttgatatttgagtgaaatgatgggtgcgtcagtatcaacctcatctggtaaaagccagacgccgtttttgacaacggcccaagtttcatcggaaatttcaaccgtaggatactgggtcagtacccggtcaattgggtagagaaattcaactgcatcgcttgccacttgttctctaaggtcagctaatgataccgtttcgtcaatggtaaagccgccactttcaacccgtgttagcgaagacatcacggctggtaatcccagttcagtgccaatttgaacggctaacgtccgcacgtaagtccccttagagcaggtcacttcaaaatcaaagcgctgagtacccgctgctgcatcaaactgactgtcgctagtccgcttgaatgacttgatcgtcacggttcgtacgggacgttcaacactttgaccagaacgggcatattcatacagctttcgcccgttcacttttacggctgaatacatgggtggcacctgagagagctcaccaaccataccggccataatgccatcgatttgttcatctgagactggttcagtcatagtcacccgcttgacctcagcaccatccagatcttctgtttcggtagcaaaacccaacgttacgctaccacggtaaacttttttatgcgtcatcaaataatcgacgaccttcgtcgcgctacccacacaaatcggtagaacaccatccacgttgggatccagtgtgcccgaatgaccaacctttttcatgtggagaatttgacgcacgtgattcacgcagtcatgacttgtcatgccgcgctctttgtatagtggaataatgccatccattacgaccgctccgtttcctataaactgtctaactttgttattatatcacgtgaagagatgatatctatacgaaaaaagtcgcccgcagaactttctacgggcgactttttacttacagattggaatcttctcgatgtaacttgttgagtaattgatcgatatgactcccatattggacggattcatctcgttcgaatgtgagttccggtaccttgaaaatattcaagcgggaacttaattcactacgaatcaagccggtcgctttggttaatccctgagccgctttttcaccatcagaggccttatcagacaagatactgtaataaatcgttgcttgctgataatcaccggtgacaacaacacccgttacggtgatgtcttgtactcgtggatcacgaacccgtttcagtaagatatcattaacttctcgctgaatttcttgttcaagccgtcctacacgataatgtgccatttatctaacacctcgttagctctctattctattggaacttccttcataacgtaagcttcgataacatctccgactttaatgtcgttgtagttttcgatggtcaatcctaattcatgaccctgcttaacatcgttaacgtcatccttaaagcgcttcaagctgcctaacttaccttcgtagacaaccactgaatcacgaatcaagcgaacatcgctgtcacttgaaatatgaccatcagtaaccatcccaccggcaattgtcccaactttagatgctttgaagatatctctgacttcaacttcgccgatgacttcttctttataagttggttcaagcttacccttcatggcgtgttcgatttcatcgatagcgttatagataacccggtgcaaccgaatatccacgttgtcttggtcagcttgtgacttggcttgtggcgttggccgaacgttgaacccgatgatgatcgcgttacttgcttcagccaaggtaacatcactttcgttgattgcaccaacggcggtatggatgatgttaacacggacaccttcaacttcaatcttcttgagactgttagccagtgcttcaacggaaccttggacgtcggctttaataataacatcgacttccttcatttccccttctttcatggtatcaaagaggttatcaagggtcactgtgttcttagtacgacgttcttccatcaaggcgttcttagcccgttcttcaccagctgcacgagcagtcttttcgtcatcgaagacaacgaagcgatccccagcttctggcacgtcacttaaaccagtaatttcaactggtgttgatggtaatgccttcttgatttccttaccgcgttcgttttccattgtccgaacccggccaaaggtattaccaaccacgattgggtcaccagtgtgcatggtcccttgttgaatcagcaatgttgcaacggaacccttaccttgatccaacttagcttcgataactgaaccagcagcgttttgctgtgggttagctttcaattccatgacttcagattgtaacaggatcatgtccagcaattcatcaatgttcttaccgaacttagctgaaatctgaacaaagatcgtgtcgccaccccagtcttcaggaatcaaaccgtattcagtcagctgttccataacgtgattcgggttagcacccggcttatcgatcttgttaactgcaacaataattggtgtctttgcggcttgggcatggtgaatcgcttcaatggtttgaggcattacaccatcgtcggcagcaaccaccaaaacagtgatatcggtaatatcagcaccacgagcccgcatttcagtgaaggccgcgtgtccaggggtatccaagaaggtaatggtcttacctttatgcttcaattggtaagcaccaatggcttgggtgatcccaccagcttcaccagccgtgatatgagaatgacgtaaatggtccagcaaggtggtcttaccatgatcaacgtgacccatgatagtgacaactggtggccgagtttcaaggtgatccgtattgttggattcttcttcaaaggttttatcgatatcagcaacatcgacttcaaccttttcttgagcttcaatcccataatcagcagctaaaatctcaatggtatccttatccaatgactggttttggttagccatgacgccaagcatgaataacttcttgacgatttcagatggttcacggtgaagaattttacccagatcttgagcgttcatgccaacttggtaaaccaaagtttctggtaatgccttgttcttacgttcaggtgcacccttttggtgattggtttccttgatccgctgattcttcttgctgtacttcttagtaaagttgttacggcgacgattgttattccggttgttacgactattccggctattactgttacggccgttaccgctgtttaaactgccaccaaagcgacctgacccaccgcggttggcattgttgctgttaccgttgctttgtgagtggttgctgctttgactgcggttattattgttcgactgggaacggttattgttattagactgtgaacggttgtttgactgtccacggttagctgattgactgcgattagtcgattggctacggttgtttgactgactgtggttagtcgattgattatggttcgtcgactgactgcggttactggtcgaatgattttgaccatttgaatggttgccgttgttcgactggctacgagtatgcgaactttgattgtttgattgcccgttactatgactattctgggtactgctcgtactttgatgatggtcacggttttgagcgggttttgcagactgagcaggcttggcctgacttgattgactcttattggtggtcttacctttgtttgagaaggtttctcgcaattgtcgttcctcgttgcttcctaatgttgacatatgatttttaacgtcgtagcccttttcttgagccttatcaagaatggctttacttgatacgttgagttctttagctaattcgtaaattcgctttttgcccatatcttcactctcctttggtattaactagttcattaagcttcctagcaaatccaggatctttaacgccgtatgctgaacggttcatgcccgtcgcttggcttagttgttcctttgtaaacgcggtaattaagtcaacgtggtaaaacgcggctttatcacttaactttttcatgctgctgggaccagcatcactggctaaaatcaccactgaaatgctctggttcctaatcgctttcaaaacaaatccttcgccagtcactaattgattagcccgacgaacgagtcctaaaagctgtaaaaatgagttaggcttttccattttcaaataattcacgacgagcttgttgatggtccacgtaagccaccaagtcgtcgtaaaattgagaatcgacctttgtttcaaagaccttatcaaaagtgcgttctttttgagctcgcttagcaatctcaacgttcaatgaaatataagccccacggcctgatttctttcctgttggatcaacggacacgttgttatccttatcgcgaacgatacggaccaagtcttttttcggcgccatttcaccggtcacaatgtcttttctcattggtaccttgcgtttcttcatgtacgcttacctcctagtcttcagtaccgtcatcctcagaagtttctggggtctcttcaggttctgaatcagtggctgaatcaaccacatcatccgtggtttgatcaaccgtttcttcagctgcttcatcacttggcgcttccacctgtgactcttcactgtcagtactatcggcatcagaactatcagtcttgccaaaaattgactcagcttcggtttcggacttgatatcgatcttataacccgttaacttagctgccaaccgagcgttttgaccccgtttaccaattgccaatgataattgataatcaggcacgataacggtacatgcccgttcgttgttttcgtcaaaaatgacgtcgattacttcggctggattcaaagcgttagcaatgaacttagcttcgtcatccgtccattcaacgatatccatgttttcgccatcaagttctgacacgatggcttgaacccgctgaccacgaggaccaacagaagtcccaaccgggtcaacatccggattatttgaacgaacagccactttagcgcggtcacccgcttcacgggcaatcgacatgatctcaacggtaccatcgtagatttccggaatttcttcttcaaataaccgtttcagcaagcccgaatcagtccggctaacgaacacttggggacccttagcggcgttttcaactctggtgacgtaaaccttgatgcgatcgtgcatccggtaagtttcgttaggcatctgatcctgacgactcataacggcttccacgttccctaggttaacataaacaaatcggttatcttggcgttcaacctcaccagtgataatctcgttttcgtattggctgtattgatcaaaaattaatgaccgttcagcttcacgaactcgttgcatgataacctgcttagccgtttgcgctgcaatacggccgaagtttttaggggtgacttcaaatttaatatcgtcgcctaattcataccctcgactgacctgcaaagcatcgtctaggctaacttccaaacgggaatcataaacttgatcaacgactttcttaactgcataaacgtgaacgtcgccctttttttggtcaaaatccacttcaacgttttgtgcttggccgtagttccgcttataagcagaagttaatgcagcttcaagcgcatcgatcacaatttcttttttgatacccttctctttttccagtgtatcaagggcacctactaattctttactcattacgtatagtctcctttagctgttaaaacttaattgctaatcgtgctttggcaacgttttttcttggaatgaccaaatctttcatacgaccctttagattaacctttaagcctaattcatcatcattaacagaagtcaatgttccttcgtatgctttttccccgttcactttttgatagaacgaaaggtgaacgtagtgaccaaccgcccgttcatagtcagcttcttttttcagcggccgttcagcacccggtgaggatacctccaagaaatacgcttggggaattggatcgggatcgatattatccagtttttcgcttaactcatcacttactaatgcgcattcatcaatcgtaatgccaccaggtttgtcgatgtaaagccgtaaataccaacttttaccctcgcgaacaaactcaacgtccaccagttcaaaatgatgggcatccacaatcggtttcgctagagctgaaacaatgtctacgacgttatccaatcttttacctccaataccatttttccaataaaaagagcgagcatcgctgctcactcctttccgaaatatctacaactcatataatatcacaaagccacagcaatagcaaactgaaagcgcgctgctatgctaactctgccttgtttggcttacatcatatcaaagagacttaactggttctcatctggcaagccatcaagaacaccgttatccgtcatgaattcaatcagcgttttagaaactttaccacgtttagccaaatcttcctttgaaagaaacggcttatcttcgcgggcggcaacaatttgcttagccacgttcaggccaagtcctggggcagcatcaaatggtgcaatcaaggtatcaccatcaatcaaccactcactagcagccgacttgtcgatatcaatcatcttaaatttaaacccacgttccagcatttcattggcaagttccaaaactgttaacaagtttttatccttggctgaagcatccataccctcatcgttaatttccttcattttggctttaaccgaatccttaccacgggacatcgcaacaacatcaaagtcgtcagcccgtactgagaaatatgaggaatagtaaaccaatgggaagtataccttgaagtaagccacccgtaaggccatcaaatcgtaagcagccgcgtgggcacgggggaacatgtacttaattttcagacacgaatcaatgtaccagtccggtacctcggcttccttcatcttgtcttgccattcgtcaggaatcccacgacctttacgaacgtgttccatgatttgaaaggcaatttcagaatccatcccccagttgatcaagtcggtcatgatgttatcacgacaaccgataacgttagaaatggttgcagtaccatttttaattaactcttcagcgttgcccaaccacacgtctgtcccatgagacagtccagaaatttgcagcaattccgagtaattcttaggatgggtttcctcaagcataccgcgaacaaatcgggtaccaaattccggcacgcccagtgtccccgttttggattgaatttgttccggcgtcacatgcaaagactcagtcccagaaaacagcgccataacgccaggatcatccattggaatggtctttggatcaataccgcttaaatcttgcaacattcgaatcatggttggatcatcatgacccagaatatcgatctttaaaatgttgtcatggatcgaatggaaatcaaagtgggtggtttgccaagcggcgttttgatcgtcagctgggtattgaatcggcgtgaaatcgtaaatgtccatgtaatcgggcacaacgatgattccggccggatgttggccagtggttcgtttaacaccagtagcgcccttagctagccgatcgatttcagcgtttcggaaatgttcctctttatcacgctcataagctttgacataaccataagccgttttatcagccacggtgccaatcgtcccagcacggtaaacgttcttttcaccaaacaagaccttggtgtagttatgggcaatcggttgatagtcacccgagaagttcaaatcaatatcagggactttattcccagtaaaccctaagaaagtttcgaagggaatgttgtggccgtcgccaatcatcaaagtcccacattttggacagttcttttccggtaaatcaaagccggaactgtattcacccttcgtatagaattttgaatactggcagttggggcaacgataatgcggtggcagcggattaacttcagtgattcccgtcatggtagccactaaactagaaccaacggacccacgggaaccaactaagtaaccatccttgttactcttagctaccagtcgctgggcaatcaggtaaatcactgagaacccgttaccaataatacttttcagctcacgatcaagtcggtgctgaactaattctggtagcggatcaccataccactcatgggcggtattcatggtccgctcgcggatttcatcttcggcgccttccatccgtggtgtgtacagcttatccttcaggggatgaacatcatcaatttcatcagcgatagcactggtgttcgtcaccacgatttccttagccttgtcttcacctaagaagctgtaatcgtctaataattcatcggttgtacgaaaatgaacatctggtaattcttgccggtttaaaggattagctcccccctgcgaattaatcaaaattttccggtaaatggcatcttctgggttcaaatagtgcgcatcaccggtaaccgcaacgggtttatctaattcttcacctaatttaaccatgttagtcaaaatttcttctaggttcttccggttttgaatcaaacctgaatcgatcagcggtttatacgctgctaacggctgaacttccaaataatcgtaaaacttagctttatttcgcgcttcggcatatcctttttgcatcatcgcggtaaacacttcgccggaatcacatgcggaaccaatcagtaaaccgtctcgtaaagcctcaatttgacttcttggcatccgcggtacccggtagaaatagtccacgttagacttcgaaaccaatttgaataaattcttcaatccatcttgggttttagccaaaatgatggcgtgtgacggccgggcatgcttatacgcatcgttttcactcatatggtcgttcaattggtcatgatactgaatattgtagcggtcttcagcatccttcaaaaagaggtagttcaggtgcccagttgattccgcatcgtaaatcgcccggtgatgatgttccaaagaaacgtggaattttttagccagagtatttaaacggtaacccttcaaagtcgggtacaggaatctcgccaaagtcaacgtatcaatgattggattggtcacttcaggcatgtcgtaacgctgataaccggcgttcataaacccgatatcgaaagtcacgttatgaccgacaataatcgcatcaccgtaaaattctctaaataacgtaaaaacttctttttccgacttggaaccgtgaaccatgtcatccgtgatactagtcaaattagtggtttggtctgacaaatgaaagcccggatcaataaactcttcaaactgatcgatgacttcttttccctgcatcttaacggctgacagttcaatcacccggtcatagattgcagaaagtccggtcgtttcaacgtcaaaaatgacgtaagtcgcgccttcaagggctcggtgttcactgttataaccaattggcacgccatcatcaacgaggttcgcttccacgccataaatcatcttaatgtcgtttgcagaagctgtacggtaagcctcagggaagccctggacccccgcatgatcggtaatggcaatggccttgtgtccccattttttggcttgtttgatatagtcagaaattgagttagtggcgtccatggtactcatgttggtgtgcaggtgcaattccacccgcttctcaccttcaggcgccttatcttgccgactggggaccgttacctgattgatgtcatacgcatttaacactaaatcgcgcataaagttatcttcttggacactgccacggactctgatccagtcgccttcgttcaaaccttcaaactgggcttcatcgctttcgtcacgagaaaatttcttgactgcgatggaagaactgtaatccgtgatttcaagaatcattaacttacggcctgaacgcaaatcacgaatttccttattaaagacgtaaccttgaacgatcactgacttttcttcgtcttcaatcgacgccaactgaacgggttcttcatccatcttgatttttcgaccaatcacggtaggcccactggcagcgacaacgccctgtttttcacgcttctggttggccactttaatagcggcaaccgccttttgagccagctcagcatctgactgagcctttttttgcttaaactcttgaattttagcttgcgaagccgattcatcaatcatcgtgtgaatggcgaactttggaaagcccactgcttggtaaccgtcctcaattgggcctaaagcttgccccactaagaaattcttcacgacttcgttttccgccataaaaataacacggtcgtcttcaacctttggcacttgatcgcgacaaagctcttggattaatggtgaggtcacaccactatgctgaacgacccaattccaataatcaccgatcaatcgattatcaagcccagtttgatcagtgtgaatctcaaaatcaactttggcaatggactgaaaagctttctccagctgtccctgaaacgtagtaaacgtctcaaagggtaaaatcgctggtaacttaaaattaaagtgccaccgttttgacttttcgtgtaccgtcaatttctccagtgctgctcctttaaagaatggctggcccgccaaatctgataattgcagttgctgtaatagtttttgaaataacgcctgatgatctaaggccacaccaaactgcccccttcatttttttgcttagtgccactattttaacgtaaaacgggctcgagacaaaacaaaagttgttttgttttctcgagcccgtcccacactaatgattaattgttattagattctgtattttctgtttccgtttcttttaataaaattgcgactgtgttgccgacttcatcagccttaacttcaactgtttcgccggttttacgaatcttaatctccacaattccttcactggctttcttaccaacggtgattcggattggtaatccaatcaaatcagagtcagcaaatttaacgccagcacgttctttacggtcatcgataagcacacgataacccgcttccgttaaactatccgttaactggttagccagttcaacttgagtgtcattcttaacgttaaccggaatcacgtgcagatcatatggtgcgatggcgcgtggccataccagtccatgttcgtcagactgctgctcgctgattgcggataacaggcgactaacaccaataccataagaacccataataacgggtaccgaacggccattttcatccagcactttggcatcaagtgcttctgaataacgcgtgcctaacttgaagatatgaccgatttcaatcccacgggtaaacttcagcttaccagcgccatctggcgacatgtcgccttccttaacggttcggatatcggtgaattcatccacgcggaaatcacgttcaacgttagcattaacgtaatggtaaccatcttcatcggcacctaccacagcgttgaccatgtcctgaacgtaacggtcagccacaatcttcacgtcgtcgccaacacccactggacccaaggcaccaaacgaagcgccaaggtacttttcagcatcatcattagttgctggagctaagaagtcagcgtgcaagaagtttttcaacttagtttcgttcagctcatcatcaccgcgaagtagtgctagtactggcttctcatcagcaatgtatagcatgctcttaatcagattatcagcattaacatctagtttagctgccacgtcgtcaatggtcttagcatcgccagtagcaaccttctccaaatccttttgagcagcatgtgactttttaggtgtgtataagttggtggccatttcaaggttagcagcgtagtcggactcgtcaacatagacgatggtatcttcaccaattggcgcaatggcagagaattccttagaatctttaccacccatggcaccagcatccccgataattgttcggtacttcaaaccgatccgatcaaagacgcgcttgtaagcaccttccatttggcgataaaccttatctaaatcgtcatagttggtggaaaatgaataagcatccttcataatgaactcccgaccacgtaacaaaccgtagcgaggacgttcttcatcacggtacttggcctgaatttgatacaaagtcaatggtaatcgcttgtatgatttaatactgtcacgaattaaagtcgtgaacgtctcttcatgagttggtccgagaatgaagtctgtatcgtgacggttcttgaacttaaacaacgttggaccgtatgtatcataccgaccagaatccttccaaagctgtgctggtaagacggttggtacgaccatttcaacggcatcgatcttagccatttcttctcggataattttttcaatattgctgagaacttgaaatgcgagaggcagataagcgtacatccctgctgtcacttggcgaatgtagccggctctaagcatcatctgatgacttagtgcttcagcatcactcggcacctctttcaacgttggaatcagtaactttgactgtttcatactcaattgaactcctttttaaccgattttatttgatttatctaatgaaatagcgttcgatgtcattccacgtgaccaataacattaaaacaactaagaaaaccacacctactagggtaatagccgtttcaacgttctctgacaacggtttacgtcgaataccttcaatcacattaagtaatattttaccaccatcaagtgctggaattggcaataaattcacaattcccaagttcagtgacaagaaggccagaaaactgaggacaccaagaatcccctcagaagctgctgtggatgtcgtcgcaaagattgccactggcccacctaaatcattcagactaaaatgaccggaaaccattgaccaaattgctgctaacaggcgcaccgtcatttgccatgtctgagtaaagccagacaccagcatggcacccatatcatgattatgatactgagtaatacctatgacaccaatggttttgttattagccttactagcggctggcaccatcttgactgtcttagtctgattaccgctcttaaccttaaacgtggtttgtttatgcgcgcggtcttgaatctgagctgcaatctgattccaatcattgacctttttgccgttcacttctgtaatgtaatcgccattcttgataccagccgaacgggcaaccgtaacatccgaagttgtgggactaacacgattactgttattggtgacaccaccagccacaaacgtcagaatcgtataaacgataatggctaaaataaagttattcattgggccggcaaagttcgtcatcaaacgatgacctagactagcggactgaaattgaacatctctcggtgcaatcctcacttcggtaccatcgttttcgataatggtggcatcatgagcaacataatagcgcttaacttcactctcatcaccgttttcgtagccttcgatccaaagttcatcctccagatcagtggcagtcacagccatgggaataccgttaaacagcgttgattttttactggtattgatccgggtcacccgatcattatcacccacatacaggctcacaggtgtcccaggttttaattcgtcctcatcgtcttcagcccctgccatccgaacgtaaccaccaactggcaatagccgaatcgtgtaggtcgtatcggtggtacgataattaaacagtttgggacccattccgattgaaaattcacgcaccaggattcccgcccgcttggcgaagaagaagtgaccaaattcgtgaataaaaacaatcagaccaaacacgatgatgaaggtaataatggtcgtaatcacagacgtcgatcctttcgtaattgactaatgcagtcagtttagataaagcctaatagatgtaaggctggtaataccaataagagactgtcaaaacggtccaagataccaccgtgtccaggtagaatacggccggaatctttcacaccgtaataacgtttaagtgctgattcaactaaatcaccaatttgtccgataaccgataatacaatggtcaacagtacggtcactagccaactataatcgccttgcggatagaaataaacgtaaatagcaaccacaatcgtagcaactagggttccaccgattgagccttcccaagttttgtttggactgatgtgcggtgcaagcttgtgacggcctaattttcgaccaatcatgtacgcaccactatccgtgatccaaactgtaaacagcgcaaagaaaattgtcgttaagcttgctgcatccgccacaataaagtagtgaaagccaaccccaatgtaaatggcaccggtagtcagtaccgcggcatcatcgaaagaaaatcggtttttcgaaaaaacagtgtacattaaaagtaacacgacaacgcagtaaacgacaaattttaaatctaattttcccggcagaatgttatgccagaaatccggcaaaatgatcagtagcacagtaataccagataagacggcttcccaggaaaccaccaattttttccgcattaccaatatttcagaaagtgcaatcaagccaaggacggaagccgcaacatcgacccagacacccccagcaataataattggaatgaagataattaaagcaattaccgctgtaataaccctttgtctcatttataaactccttttcaactcacctatttcgttaatccgccaaagcgacgtttacggtgctgatactcataaactgcttgagtcaataattcggctgtaaattcaggccagtgcggtgccataaagacaaattccgagtaggcaatctgccacagtaaaaagttcgaaatccgttcttcacccgaggttctgataaccacgtcagggtcttgatactgacctaatgaggctgtcatcaaatgttcactgatcatttccggtgaaatatcttccggcttcagttcaccctgttgaaccgattgtgcaatttcttgcacagcggtagtgatttcagcacgactaccatagttcaaagcaaagtttaacaccatgccatcacaatccttagtgtcctcgatggcatcggcaacagccttttgcgtcttctgtggtaattgatccgtgtatcccatgacgttgacccgcacattgttactaatcaattctggcacaaacgtgtcaaaaaagtccacaggcaatttcatcagataattcacttcgtcagtgggccgtttccaattttcagttgaaaaggcgtaaagcgttagcactttaatccccagatcactagcagctttagtgatagtcttcaccgtgttcataccctgtttatggccggcaatccgtggtaaatgacgtttctgcgcccatctgccattaccatccatgatgatggcaacatgtgccggaatattattaggatccagttctattttttcaggcatctctgactgattattattattgagccaagaaaacaaagtggcacctccaaattagctttcaaaccataatcataccaaaaaacagagttgtcgactatcccaactctgcttaaagcgattatttaacagaatctaaataagctactgaagtaaacgccattcaccgcgattagcgtcagataacgtattaaaatactgaagtaaattgttagcatcatctgggcttacttcaccaagcatgtttaatccttcacccgttggaatgggttcactcaaatcagtgatctcagactcattttcaatggttgcctttgagaacgcaacgatccaatcttcttcaatcaactgagtgattacaaagaataaattaaaatcatcatttacaaaggctggttgcgcataaacgccctcatcaatttgagttaactcgttaccgttataattgagaaccgctaagttttcatcggtaactgcatcattcagtttgaaaaccattttggcaaattgtggtgtgccaggcgtgatttcaactgtttcgtcgtcatttgccatgtttaatttcctttcgttcaagcaagtctagccagaaataatttcttgttctttatcttccgtcaacttatcgatttgtttaacggcttcgtcagtcactttttgaacttgtttttcaagatcatgaacatcgtcatcagtgaaatcaccgttcttatgtcccttcttcaaagcgtccattgcttcgcgacgaacgttacgaacagcaactttcccttgttcagcaactgccttaacctgtttagccagttccttacgacgttcttcagttaattgagggacaactaaccgtagtgccgaaccatcattagctggtgtaatgcctaaatctgattccaaaatacccttttcaacgtcttctagtgaagacttatcaaaaggtgttactaaaatcacccgtggttctggaacggtgattgcagccacttgattaataggtgtttcaacaccgtaatactgaacggttacccggcttaacaaacttgcgttagcccgaccagcacggattgtaccaaattctcggcttaagacatcttcagcctttttcatcttatctcttgcttcatcaataattgggtttgccaatattatttcccccttaccgttgttccgatgttttcaccaagaacaaccttcttaatgtttcctggatgattcaagttgaacactaccaacggaatatcgttatccattgacaatgtgctagcagttgaatccatcacatgaagacccttattaataatgtccatgtgggtcaaatgatcaaatttaacggcgttctgatcgatattaggatcagcggagtaaacgccatccacaccatttttggccattaaaatggcatcagcgttaatttcagctgcccgtaaagcagcagtggtatcagttgagaaatatgggctgccagtcccaccggcaaaaataacaacgcggtctttctctaaatgacgaattgcttttcgccgaatataaggctctgcaatagcgcgcatttcaatagaagtttgaacccgtgtaggcacgccgatatcttcaaggttatcttgaagtgcaagaccgttcataatggttgcgagcattccaatataatcggcttgcgcccgttccatgcccatctgagcacctgattcgcctcgccacatgttaccgccaccaacgacgatcccaatctgaagacccaaatcaaatacttccttaacttcctttgccactgtcttgataactggtgggtggataccaaatccttgatcgccagctaaggcttcaccgctcagcttcaaaacgatacgcttatactttaaatccgtcatcatgagcctcctattagtttcctgttgtaattctatcataatccggtatcgaccaacagtcgtatcgcggtttaattctataaaaaaagggggtacgctacacgtacacccccttttttaaagtcagtttagccgttaatttgactatttacttcatcttcaaagttcttggtttcaacttcgataccttcaccaacttcataacgaacaaagctcttcagcttgccgccctttgaagcaacgtattggctaacagtttggtcagaatccataacaaattcttgatcagcaagactgatttcagacaagaatttacgtaaacgaccttcaaccatcttttcaacgatcttttcaggtttgccttcgttcaaagcttccttcttcaatacttcacgttcgtgatccaaacgatctgcagggatctcttcacgagaagtaaactctgggttaacggctgcaacgtgcattgcaacgttcttagcaacactagcatcagcgccttcaaggacaactaaggcaccaatttggccaccgttatgcaggtaagcaccaaagacttcattgtcgctcttttcaacaacttggaagcgacgaagcgtcgtatgttctgaagtgacctgagtttgttcaataatcatttctttaatggtttgaccatcatcgttcttcaaagctaaagcagcatccatatcagctggcttgttagcagcaatcaaatcggtgattgtcttaaccaagttcttgaaccggtcattagaagcaacgaaatcagtttcagagttaacttcaacgattgcagcgacattgccgttttcagaaatgtgagctaaaccgttagcagcaacattgctactcttcttttcagccttagcaattcccttttcacgcaagaaatcaatcgccttgtccatgtcgccttcagtagcaacaagggccttctttgcgtccatcataccaacgcttgtcttatcacgaagttctttaaccatttttgcagtaacgtttgccattttatggcctccttaatattagttacaaataagtcgcataacaccaacacaaaaggctggcccgaaaataatcaggcctcgcgggtccacattttcaagccagcctaagcactgatggtcttttaacaaatgttaaatgttgtaaactattcagcagcgttttctgaagcgtccttgctgtcagcatctttagcttctgctttagcagcttcggcttcgtcttcaccttgacggccttcgataacagcatcggccatcttgcttgtgatcaagcgaacggcacgaatagcatcatcgttagaaggaatgattacgtcaatgtcatcagggtcggtgttagtatcaaccatagcgacgattggaatgttcagcttttgagcttccttaacggcaatttgttccttacgaggatcaacaacaaacatcacgtcaggcaacttaggcatatcttcgataccgcctaagaaacgttccaacttgtcagtttgcttcttcagtaaagaaacttccttctttggcagacgatcaaaagtaccatcttcagccatcttcttaagatccttcaaacgcttgatacgagtttgaatggtgttccagttggttaaagttccacccaaccaacggtggttaacgtagaattgaccagcgcgggtagcttcttcttcaatagaatcttgggcttgtttcttagtaccaacgaaaagcactacagcacccttagatgcttcatccttaacaaagttgtaggcggtgtcgattaacttaaccgtcttttgtaagtcaataatgtagatcccgttacgttcagtgaagatataatccttcatcttagggttccaacgacgagtttggtgaccgaagtggacacctgcttcaagtaattgtttcattgtaataacagccatgaaatagcctccatcaaagtttttttcctcccctgaggtcatctatactaagaactctcgcgagcactacttaatatattactcagagtgtgaattgtggcaatcagccgaaaattagtatacccgttttgggtgttcatagcaacccttagccgtccaaaagtaaaaaaaatttgaaataaatgttacattcatgttacactacacttcgcagaacttcgaggaggaaccgattatgctcaaagctatcgtttttgatcttgacgatacactttatgatcaacaacgaccgtttcagcaggcgttagcttcagtctggaacgacccagcggtttccggtcacgtgttaaccgaccttttcaaggcctttaagcacatgaatgatcgagtcgcaaaattagaaacattaactatgaaccatgtttttaaccgccttaatgacgtgctaacgcaacatgatttaccaacgttgacgaattcggtatggctggctttttgcgaccgttaccgaacagaagcaaaaaaaatcaccctgttttcagatattcaagcacaactgccgctcctaaataagcattacgaattaggtgtaatcaccaatggcgaaagtaatacgcagtctgaaaagttttcccatcttgaacttgaacaatgggtaaagaaagaaaacgtcgtcatttctgatgaagtgggtctgcgaaaaccggaccccagaattttcacccacttcaaccgacagatgaatttacaagctaatgaagtggtttacatcggtgataattttgaaaaggatatggttggggccaagcaagccggctggcacgctttctggtttaaccatcggcatttagagatgccaaaatcagactttatccctgatcaaacggttgaatcacccaccgaactggcagaactgttacaggcgatgtccgttactaattactagtccactaacttgtctagtcaagcagctcctcaaatctaactgatttggtgagctgctttttcatttacgataaaccgcaatgagcgaactaattgaatcaagtaacataatcaacgccatcatccacatggcggccatattgttcatgctaagcaacagaccaatcaaaataatattcaacaccaataatagccacaggaaacctttcgacatatttttcatcaaactctccctctttcatcgttcattattataatacaaattatttaggtactccttaaaatatgacattttttataatattcgcgccttttcgcgatataatagagaagaatatgagaggagaatatatgatgagtgaagaaatctatcacgactatttttttgatgaacctgctttcaatactcatgacggtggttacgttccgttggaaatagccgacgcacccgaaaaaccgttggcaattcctgcacgtttaaaacccgataaagaaaccgatactgatatctggtatacagtaacggctcaagctggcgaaactccgattttgccaggtaaaaagacgaaaacttggggctataatgccagtatcctcgggcaaaccattgtttacccagttggcaagcacatccacgttgctttggaaaatcatttgccagaactcacgacttttcattggcacggcctgattgtttccggtccttacgttgacggtggctgtcacgcacccgtttatcctggggaaacgaaacatattgatttcaccttggatcagcccgccgcaaccacttggcttcatgctcatccatgcccatcaactgctgaacaagtttggcacggcctagcaaccatggtgctggtgactgatgatcacatcaattccctacccttaccacagcactatggcgtagacgatattccattagttttgcaagaccgccgtttccacgaagataatcaattagactatcatgctgactacgatccagatggcgtacaggggccgactgctctcattaacggaaccgttaaccccgtctttgatgtcaccactcaaaaattacggttgcgaatcttagacggtgctaaccgcagagaatggcggctacacttctcagatgacctgaagttcgctcaaattgctggagattccagtcttttacccgaacccgtttacatggatcatttgatgctgacctgtgcagaacgagctgaaatcgtggttgattttgctggctatcacgaaggtcagactgtcaccctgttcagcgatgatgtgccaattctaaagtttagaattcatcaatttgcggctgataacacgacgctgccggatcacctgctgactatcaataagccagaagttgaccctaaaacacccgttcgtaaaatcgaaatgagtggtatggacgaagccgtcatgctggatggtaaaaagtttagtatgcaacgcatcgatgccacgcaaccagttggtcaaagccaatattgggatatcaccaataccaacgaaaaagactccggaatggtgcatcccttccacgttcatggcactgaattcttggttatttctcgtaatggtcacgcaccatacccaaacgaacacggcttcaaagataccgttggggtcaacccaggcgaaaccgttcgtctcctggttcgctttgatctgcccggtgtatacatgtaccattgccacattattgaacacgaagacggtggtatgatggctcaaattcaaacctatgagccaggaaaaccaatgccaaagtacaagttaatggatatggatactttaatgaatgcattcgccaaagaacgcggtattgaaccaaaagatttgtggatggcaggcatggattcatatagtaaatatggtatgaagatgtagcgattcttcactgacgaaatacaaatactaaaattaaaagcgctcgaattttattttcgaacgctttttactatccaattatttaattttagaccaatcaatctctcgctgctgatgataatattgacgatcatgttcgttaatttctcgcatcacatgacaaggtgttcctatcgcgacaacattggctggaatatccttggtcacaacactgccagcaccgataactgaattatcaccgatggtaactcctggcaagacgatgacgccagcacctaaccagcaattacgccctattttaataggtagattatactggtattctttttctctcaactcaggcaaaaccggatgagttgctgacgccaaagtcacattaggaccaaacatggtgtgatcaccaacgtaaatgtgagtatcatcaactgcggttaaattataattagcataaatgtgactgccaaagtgcaggtgcttaccaccaaagttcgaatgcagtggcggttcaatataagtatcctcaccgatttcagcaaacatctttttaagcaaccgctgacgcccctcgtgctcaccgggccgcgtctgattaaaatcataaagcagttcttgagcagcttcctgttcctttaaaatcgctttatccattggtaaataaaggttaccattgtgcatatcctctgtcatataacttttcctcctaatatctaacaagtccattatagcaaacatgtaaacgtttaccagcctgtattttaatggttgtaatgaccgacaaataacccgtagaatagcaagccaattatacgtcaaagtcaagtaaatgtgctattatgtctttgctttaagagagtgtttgatttatgagagaaaggactgattagcgtgataaactatcatttgaaccgttcattcaaaaggtttcccagccattatttttacgtgattgcattagtctcaaccggtctcttttgggggcataccacaaccgttgtgaaagcctcaacttcagaagattcgacgccttcaaccgacaccaccagttcagttgatcaaactgcttccagcaccgttctgcgaacatccgtcacaactgaagcgagcagtacagaacagaatactgatggaatcaataacaatcaagtcatagctgattcctcatcttctaatgaaagcaatccagcaagtgatgttactgatgccgacccagtcaccacaaccactaacgctgatgatcctggttcaacggacacctcaagtggcacttcaaccggcacttcaaccgccagtgtcacgctaacaccgccgggagggacactgccgagtaacgatggatcacaggcagtaccggatactgatcagactgatgatgatccggctggctctcaagccactgcatctccaactgacattacagccatcactccggatccggaaaataccacgcaggttgcacccgatgctttaggcgttaaaccggtcggcggcatcaagctgaacgtgccgattcccacgactggtaaggatgcgatcacagctacggatgaatattactatacgattgatggtgatattaatattactgctcagctagctaattatcaccgtagtttgtctgatgtttctatcacaccaggtacctggcaaggtagtgcttatgctgccgctataccagccaatgcggtgggaattgaccctaaaactggcaaaaactatgtcgacgaatggatgcccgacgtttggttccagtatctgctttggttaacggaatacaacactcagtttccaacttggactcgttttagaaattcattctcaaaatcaagtctaagcaccctgaccaatttcaccgtaaccatggcccagcagcaaactagtgcaacaaaccttgcccccacacaggtttacacagcattagtgcaaactaatagcttagaagggctacaatatgcacaaaatttgaacaccattaatttcaccgtaaattctaacgtttctgaacaggtttatggtggcgacattcaaagtaagttatgggatatcagcgcactgtcaaaaataaacagtctaactagtgttcgttttttatctacttctattcaagacgtatccgcattaaggtcgaatgaccatttagcaaatattgaattaagctttaatcaaatcagtgacattagtggtttccaaagcgactggataaaatcgcagcccgcacctaatcctaacgacaataggattggcagctcacgctacaatggcattagtatgccattgctggtgcttaaacctggaactaccagcgtggaagttagttacaacgtcaaagaatacgatgggtcattagttcacatgtatccttctgatggctccgattttagtactgactatccagaaacctatgagatgtataaggcaagtacagctgatgcagtcagcgaaaacgatcaaaccatcgtgttctataacttcaagactcctccggccggtgatgttggctggctttcagcggggtacgtcttttgggaggacggctatcctaaagatccgtccgcttttgatgtgtgggtgtccattccgtacattatttctgatgattatggcacgacaaaggtcaattatgagaatttactgactaatggtcagcaggaagaagttgcaacttcgacgccattgagtgggtcagttggtgacacttatgatatttcgtccgactctaacacgacatatccgctggagtggttgatcgataaatatggcagcaactatttagttttgaatggcactggtaattattctgattatcttgccaacaatggtcttgctcaggcggttcctggtgccggcacttacactgccgacccgcagaatctaaccgtcttatttgcaccaacaagcagtacggtaacggtacaacacggttactatgatgctgatcatcaatttgtcccgctatcatcagatacgactgttgatcaatcctcgggcactagtttaaacgttgcggatcaagcaactccaatcaccaatttccactacacatccgctgaaattgttgcagctgacggcaccacaaccccattgtccaacacgaccaccgtcccctacctcacaaatggctatcagcttcgactcttgtacgcgccagatccggccacgattaatttcacctataaggacgacctcggtaatatactgccgcaaagcggatccgatactggtacagctgtcagcatgttctcacctgacagcaaactggggcaaattgacattcccgactacacgtttgaccactatgaaaccagcgatggcacgccaatcaccacatcaatgacctaccctgaactacaagccggtttaacgctggtctacaaaggcaacaccttgccattcaccgtgagttacgttgataaccacggtaatgtcattcatataacagcacaggcttctggtgccgtgaacgcaaagttaactagcgattggctgagtgataatcaactaagcataccggattataccttcgaccgcgttgagacgaccgccgaccaccagactatttcagccgacgcaacaattaatacagttcgcgaaggcatcacgtacgtttatgcgccaaattcgattactatcccgattcattatctgaattcaaacgtcgatccagtatcgattgccgccgacgattccctcgatagcccaatcaatgaaaatgtgactaccgaacagattacggctaaagaagtcgccatcaaatattacacgttcaaagaagcccgagataacgccggtaacctgattacttttccaagttcagccgccaccattcgagaaggcatcaatctcatttatgatgaaaatcgagtttcagtaccaatcagctacgtggatccagatggtaacccacttcttacgtctggttcaatcgatggttttgctgctcatcaattgacaccggatcaaatcgccacaattaccggatacacgtggaaacaactcattgatcaggataagaatccggtgacgctaccaatcaactttggcgatttagttggcaaacaattaacggcagtatacgagccaattcaagtctcggttccagtcgatattgttaattctgctgggattcatttggccgattttccagcgatcactggcaactatctggatgaactcaccgcagacatgctcaggggaatggcaccttcaatcaacggctactcgtattcaacagttcaggatgccgccggtaacgcgctgactctgccaacacaacttggggcgatcgacccccaaggcatcaagctggtttacagtgaaaacaatgtgctcctggccgtgcactatgtagatcctgatggtaatccgctgggagaagattcatccattaatggcagttttaatcagtcgctttctcgtaacaacctgctgattcctgaatttacgggttataccgcgggcaccattacagatagcgccggtaacgcgattacgtttccaacgacctttggtgctgtcaacggcgacattcaggtcacttaccagccagttcgagtcaccatcccggttcaaatcgtggacgctaccgataaaccgattggcaagttagacccgattcaaatcacgggaaactatcttgatcagctcactgacgcgcaaatcagagtaacggctccttccattaaaggctacacctattcggcagtcgaagattcaaccggtagcccattaactctgccaacgacacttggagcaatcaatccagctggaatcaagctcgtctacaatgaaaacgacgtgctgttgaccgttcactatgtggatcctgcgggtaacgcgttgagtgaagctttaccgcttaacggaaagtttagtgcggaattgaaccttgaatcactgcaagctccagagataactgggtatacagccggctcaatcaccgatgaaacgggtcatccaatcacgctccccactacgtttggtactgttaacggcgatattcttgtccactaccagcccgttcaagtgaccattccggttcagtatgtcgacaccaataacaacaccattgccgaaccacagcaagccgccggtaattacttggatacactgagcaatttgaatttaaccaatgatattataggatatactttcaaagaaatccaagatactcaaagcaatgtgctgccggcttcaaccccattaggtgccatcgatccggctggcatcaaattcatttacaccgaaaacgaagcaaaatcttctattaaatatatcgatgcagctggcaatgaattacattcagctggtaccatctccaatcagccaagtcagcaactcactgctgatgagattatcctgccagcaatcactggctacaccttcgaccacttcgtcgatggcaacctccaacccatcaccctaccgctgaagttcgccgagatcatcagtaacggcattcaagcggtatacgcaccggttcaagtcgccgtcaccgtgaactatgtcgatgaaaacggcaaaaagcttgccgacccgcagcaagcccgcggtaactatttagatcaactcaccgctgatcagattgctggtctggcaacgccaatctccggctacacgtttgttgaagctcagtattcatccggtcaggcactgaatttacctgttcagtttggcacaattacggccaccgagatcaacctcgtgtaccgtgaaaacacggttaccgtaccgattcaatacgttgatttgaatggtgaagaactgctgccatcaacaatgatcaaccaccagccaagtgagcagctgtctgacaatgatattgctgtgccagcgattaccggctacacgtttgaccacttcgctgacaaaaacaatgccacggtttcgttgccaattgccatgagtgacatcatcgccaatggcttcaaagttgtttacaagccggttcaagtctcaatcccggttcaactcgtcgatacaaccggtaaagtggttggcaattcacagctgctgactggcgactatctcgactcgctcaccaacgagatcatcagtcagtacacgccaacaatcgatggttataccttcactgaagtccaagattcaaccggtgatccactgacactgccagcccaatttggcactatcgaccctactggtatcaagctggtttacttcgaaaatcaggcggaagttactattaaatacgtggatccacagggtacggaattacaccaggctggcaccatttcccatcagccaagtcagcaactgactgctgacgaccttacgctgccaacgatttccggctacaccttcgaccatttcgttgataatacgcaacagccaatcacgttgccagtcgactttagtgagattatcgccaacggcatccaagccgtctatgaaccgattcaagtcaccatcccggttcaatacgtggatgacgaaaataatccaattgccgagtcaagccaaatcagcgccaactatctggatgaactcaccccagaaagcatcactcagctggcaacaccaatcgacggttacacctttgacaccgttcgcgacgcccatggtaacgtgctgaccttaccaattcagtttggcgccattgatcccgcgggcattaagctcctgtacaccgaagagatcgaaggaaccgtcaccacgcccgttcccgtcacttacgttgattcagcaggaaaccaacttctgccagcaatcaacattgagatggaatctgaccagcaaattaccgccaatcgtgtgccaattccagacgtacccggctaccagttcgctaagttgactgatcacgcgggcaacacggtcaccttaccaaccacgcttgatgccgtggaaaccggtctccgagtggtttaccagccaattcaagtgtctctgccagtgagttacgtggacacagaaggtcgcgtcattgccaaccaacagcgaactagcggtaactacctagatcagctcaccactggcgccgtcgctgagctcgcaacgccaatcgacggttacaccttcgtggaagcacaggacgcaacaggcaagcccctgagtctgccactaactctggggaccctcaccgagggtatcaagctggtctaccgtgcaaacgaagtgccaacagatatcaccgtcaccatcaactacgtggatccagctggcaaccacatccagccgccaactaacattcaaggtggcccagacgaccttctcaccgcggaacaggtcaacgttcctgaactgccgggttacgtcttcgaccatttcgaggataacaacggcaatccattctcgttgccaattaatttcagcgaccttgaaaatggtggcctgcacgtggtctatcagccaattaaagtgaccgtgccggtttactatctggatgacagtggtcagaccattgccacggctcagcaggttccaggtaattatcaagatccgttcactgcggccgacctgactgggttgcagcaaaccattcctggttaccagttctcaaacgtacgtctggcaagcggtgaagcgttaaccctccccaccgtcctcggtgaattacaaactggtctttatctgatttacaccgtggacaacaccaacgtggtaccgccagaaacgcctgatactaccccaccagctggcaaccccggtgacatcattccggagaaagttccggtaaaagtcatttatgctatgaaagaaatcagcctgcataccacccctaactttactaacgataacatcgtcatgacctacgtgaagaagccacggatttaccggccccgtttcatggtgatcgacacggttcgtgacagccaaaaccgactgcgctatctggtgcgcgacatcaattctaagagtgatacctacagcttgatgggctacatcactgccaatcccgaagacgtccgcagcgcctactaccacatcgtgccaaccaccatcacggtgatcaatccaaagggcatcaacggctataagaacaccgacctgacgggtaaagtcacccactaccgtcaagggacggttctgaaaatcgcgcgaatcctcaaagataaaacggcgacccgcttcgtcctcaccaacggccaaatcgtgaccgcaagcaagcttctcgtcaaaatgggtaccattccgcagccgaagcgtgcaaccaagcttaaagcgctcaatcgttacggtgatctggatttaacaaccaagcttgaacacttcaagaaagtgacgccaaagtcattcggtattctcaactgggactacagcgatggctataactaccacgtcaaatcattaaagcgctataaaatcgataatggttatattaccgcatatagtaaactggtaaagagcgattactagaaaccaaaaaccgttgctactttgttaaaagtaacagcggtttttattgtgaacgactatttaaaacacaaattaaactaaatggtaaataaaggcattcctcgacctaacaaaaaaatcaggcaatcaaaagtatcgcctgagtccctattacttcaaattattctgccaacacaccatgaaccaccatcacttgaccagcttcatcaggtgcttctaaccaatgaaattcacctggctgcatcacaacagcttttcctggtaccaacgtagtcacgtcatcatcagtatggaactggactgatcccttgattgccacgacagttacagtcattgatgagcggtgacgtttaatggtaaaacctttgggtaaaactaacctaacaatcgacaaatggtgctcaaccatcatcctgtcaggtccctctgatactgttgtatctggtgttaatactttcatgattgcctccattatcattatgcatgtatgtaaatagtggcaggaaatctgctactattattttttaattgagcgtttttactttgtcgtcttacttctatctagcctaatcgggctactacaggcagagacttgcacctaagccaataccaatataaatccaagcccaggatttctatcggtatcagcttaggctccagtctctaaccgcctgtcttcgcacctttatctaatcgggctacaagaaggcaacgacctgcacacaaggggctctgccacaaaccgccttcttttcgcaccttactctaatcgggctactacaagcagagagctgcatataagtcagtaccggcataaatccaagcccaggatttttaccggtaccgtcttatactccgctctctaaccgcttgtcttcgcacctaacctattgacccttccatctcaaaactaatcaaccggttcaactcaaccgcatactccatcggcagttgtttcgtaaatggttccacgaaacccatgataatcatttcagtcgcctttgattccgagattcctcgcgacatcaaataatacagctgttcctctgaaatcttggagacctttgcttcatgttccatcgccacattgccgttataaatttcgttatacggaatcgtgtttgacgatgactggtcatccatgatgatcgtgtcacattcaacgtgggcctttgaaccatccgacttctttgtgaagcgaaccgtcccacgataatcggtggcaccaccagttttagcaattgactttgagacaattgaactagacgtattcggtgcattgtgaatcatccgcgcaccagaatcttgatgaataccattagaagcaacggcaatcgaaagcatcgtcccacgggcattttcaccatctaagtaaacgcttgggtacttcatggtcaccttagagcctaagttaccatcgacccattccatggtggcgttctcttgagctgcggcccgcttcgtttccaaactatagacgttgtccgaccagttttgaatcgtcgtgtaacggcaataagcgtccttttcaacgttcacttcaactaccgcagcgtgcaaactatcagacgaatagttcggtgcagtacagccttccacgtagtccactctggcaccttcgtccacaatgatcagtgtccgttcaaattgaccagaattctccgcgttcaaacggaagtacgcttgaattggcgtcttagtttggacaccctttggcacgtaaataaacgaaccaccggaccaaacagccccgttcagtgcagcaaacttattgtcagtcggtttaactaacttgccaaaccactttttgaacaactctgggtattcacgcaacgccgtatcggtatcggtgaagataatccccagtttttcaaaatcgtttcgcatgttgtggtaaaccacttcagattcgtattgtgccgacgaacctgcaaggtaactacgttcagcttctggcacgcccaaacggtcaaaggtcttcttcagatcatcagggacgtcattccagtcccggtattttttgtcagtcatcttttgatagtaaagcatattctttaaatcaagctcgctcaaatctggaccataatccggcatgggcagctttttgtatgcttcatacgatttcagacgatagtccagcatccatttaggttcctttttttcagctgaaatcttccgaaccgtttcttctgttagcccacgacccgttgaatatgctggcttgatatcgtcgtgaaaaccgtattcataatctttatcgttagcaacaatgtctgggacattttgtgcgcctgttccttctgccatttgctagtcctgctactgataacttataaaaagttatagattattcttgcttctccctatcctgcctcgtataaaactcactaatacagttgatatgatagtccacaagcgttaattcccggctagccaccggtacatcctttgaaacctgttttagtaggctaattcaaagttttcagtatccctgatattcagggccgcattaatatcgcgatcttcggtataactacatttaggacattcataggtgcgctcacttagctttaaatcaacttttttatagccacattgatggcataacttagaagttgattcaaaccggccagttaggtgtaccggaatgcctatttgctggcatttagagactaatttgattctaaaactatagaatccttggtaactaacggctttagctaaatgccgatttttcatcatacccttaacattcaagtcttctaaggctacccactgcggtttggttctcaccacattggcaataatcttattttgataatctacctgaatgttggttaatcgttgatacaagcgttgcaccttccgctgagttttagctagattcaaatcagtagcagatttcccttctttctgtcttctagctttcagtgcaagatactgacgggacaacttcctttgcaggcgtctaaggcgttttctgattcgccttatccgactacttttattctgattgtgatacaaagtgccatcatttaagatggcaaattcttttagaccaagatcaatgccgataggttcaccggccaatcctaatttgggtagttcagcctgttccactaaacaagtcaagtaataacggccagctttgaatttaatccggccttgtttgataacaaagtgttctgagtctgtaggaatgtagccaaactctttcaaccgtacccagccaagcttcggtaacttgatctggtgacgctgacagggaatgatttgcgttttaccgttcttaacaaagtagtaactgccctgaccccgtttaaacgagcgccaatgtgggaaaccactttgttttttgaaaaaacgtttcatggcagtatccgcatcaataaaagcctgtttaactgatttggcatataaatccttgatccacatattatcaggattagcgtccaggtactcatggttaaaccacttactaaaggcgtaagcgtttaagtagcaataacccatttcgtagcgttgctgattgatatccaaaaacaggttgtaggcccaacgactgccaccaatatgacaatcaatctgccaggcttgtttttcagtcggcttaatttcgactttataggtgagtaacatcagtggttccgccttattgaatttaatcaccaaagtgaggtgtccctcatattatacgagatagatttatccccaaaaagccttttaatgaaattcatataaatcactacatataagctatcagctaatacagaaaattaaacacctaactttaacctggttatatcttctactaggcacagaatagtatagaaacaccactttccaaagattgatatccttttacagcaaaacagttactgttcattcctccttctcagaatcatccacattgccatctggctgttttaacaatgcacgctgcaatgcccaccatgaaagtgtcgcgcacttaatacgcgctggaaacgtcatgatgttgcttaagattgcggcgtcttgaagttcatccaaatctttttgaggatgttttttacctatgaccatgtcggaaaaagtctttgccatgtttaaggcttcatccttggacttgcccataacagcatccgtcatcatgctggcactggattgactgatcgtgcaaccatcaccggtaaaaccgatatcgctaattcgatcctgatcgtccagctggatatccaagttaatgacatcaccgcaagtcggattcttcagcgtaatcttatgagtcgcgtccggcagcgcatgtttgtgatgcggatgatccgagtgatccaaaatcacttctcgatataaactatttagtttctctagacccatgattgaagaactcctttgtttcttgaagtgccacaagcaaacgatcagcgtccgcttgcgtattatacaaatacagactagcacgtgctgtggcggttagtccaagatattccatcaacggctgtgcgcagtgatgtccggcacgaactgccacaccttccatgtctaaggcagtggcaacatcatgtgggtgcaagttctctagattaaacgctataacacccgtatgcttagcaggatcttgtggcccataaacttgaacaccatcgatagcttccatcttaggcaacaggtaattcactagttcttgttcgtgcgcacgcactgctgacatgccaataccagttaaataatcaacagcggctcctaagccaactgcaccagcaatattttgcgtcccagcttcaaatttataaggcaattctgcccaagtcgattcctgctggtgaacaaagccaatcatttcaccgccgtattggtaaggtggcattgcttctagtaattcacgtttaccatataaaataccgataccagtaggacccatcattttatgcccagaaaaagcgtagaaatcaacgtctaagtcctgcacgtcaaccgccatatgcggtacggcttgcgcaccatcaccaacaaaaactgcgccatgttgatgagctagtttagctaactgtttgattgggttaacggtgcccataacgttagaggcatgagcaaccgcgacaatcttagttttgtcagtaattaactgcttagcttcttctaagtcaagttccccgtcatccgtcaaatgaatgtactttaacgtagcacccttacgaatggctagttgttgccacggaatcaggttactgtggtgttccatgattgaaatcacaatctcgtctccggcagaaacgttggcttcgccataggtactggccactaagttcaagccatccgtgcaacctttagtgaaaataacttcctctggttccggtgcatgaataaacttttgcattttacgacgagcagcttcgtaatcagcagttgctctttctgccaaggtgtggacaccccggtgaacattagcgttatccgtttgataaaaatgtgttagcgcttcaattacttggtttgggcgttgagcagtggcggcgttatctaaatatactagacgttcatcgttcactttttgatctaaaattggaaaatcctgtaacaatttactcaaagtgttgtccatcttcaagcttcctttcaatcatgtcaatcatttcttgacggacttccggtagtggaatttcatccaaaacagcacccaagaacccacgaatgaccaaccgttgagctaatttcttatcgattcctcgactcatcaggtagtacagctgattttgatccacttggccaacactagccgcatgcccggcaatcacatcatcttcatcaattaacagaattgggttagcatcaccatgggcttgattagacatcatgagtacccggttttcctgttcggcatttgcgccagacgcaccgtgaataatgtcaccgatgccgttaaagaccagctcggatttttccagcagcacaccacgttgagagatattagccgtcgtatgctttccccggttaaccactcggttattgatcccgttactctgtttacctgtggttaccgcaataacctttgattcagaatgagaaccctcaccaattaattcactggtgatatcgcctagcgtattctggtcgttaacgatgccaattgcccagtcaaaacgcgcgttacgactaaggttggctcgtcgatggagaaacgaataggtctgttcgcctaattcatccacactagagaagtggacgtgactattagcaccactcatcacttcaaccatgcaatgtgcggcattggcaacgtcgccttcagtagttaaatgttgaatgaaggataactgactatcctcttcagcaataatcaacacgtgtgacaccatggcttgttttaccgtactatcctgaattagaaacgcctcaattggctgtttgattaccacaccttttggcacgtataaaaagataccggaatttaaaaaggcttgttggtacgccgttaatttgttttcgttatacttggtcactttttccataaagtactttttagtcaaatctgaatgttcacgaaaagcactaaaaatatcggttaaaatgaccccttgagctgccagttcatccggtaagttcacagcaacggtggtctgaccaacttgaacaaatcgaatctggttatcagccttaggtaaatgatcagcgagatgcttgtcactgtctctaaaagtgagtgtcatgttatccatcaaaggccagcgatgaaaatcatagcgtttcatttctggcaatggcagatcctgcatggcatcgatggctgcaaggcgacgatccacgaaccactgaggctcgccgtgcgcgctggcagcagttttcactgcagtctttactgcttcataatcttgaacggcacttatcaaaacgacccctccttaatgattatcgtcaactaaatcaacatccagtcctagctcatcgcgtagaccagcatagccttcgctttccagcttcttggcaaggtccgcgtcaccgctcttaacgatgcgaccatccatcatgacgtgcacaacatcaggcacgatgtagtttaataaccgttgatagtgggtgatgatcaatgaaccgaagttatcgccacgcatcgagttaacacccttggaaacaacttgaagcgcatcaatatcaagtccagagtcaatttcatccaataaggcaaaggttggcttgatcatcaataactgcaagatttcattacgtttcttttcaccaccggagaagccttcattaagatagcgctccgtcatttcttcactcatatccagtaacgataaattcttatccagttcctttaaaaagtccataactgaaatttgattgtcttctggtcgacgagaattgatcgccgcgcgcaggaattcagcatttgtcacaccttgaatttcagctggatactgcattgctaaaaacaggcccttacgcgcacgttcgtcaactggcatacctaaaatactttcaccattgagcaaaatatcgcccttggtgacgtggtaggcactattacccataatggtttgtgacagtgttgatttaccggttccgtttggtcccatgatggcgtgaatttcacccgtgttcatcgtgagatttacaccctttaagatttcgcgggtctgatctttttcttctttgatctcaacatgcagatccttcacttcaagtgtcgccatataaatcatcctccattgattagttatcgctggaatattaccttgactgaattcaccaattattcctacgcgagtattgttcattacatctctagattatagttgttttctcatattattcaaagtaggcatttcccttatacctaaaaaattcataaaatgtgatactatagagtgaaagttattctttagcgaatatgaatatttaactgatattcgaatattattgatgtcacttgaaaggtaggatgatcatcatgaatcactttatgattaagcagtttaatggccttgatgatgcaaccgcacaacgtctgcatagtctggggctacaagtgggcagcagtgtgcaggccgtacgcttttacccgtttcatggaccggtcatcattcaagtggaccaccaaaaaatcggtattcgctaccgggtgtttaaactgctcacgggaggcaagccactatgacaactgtcgctttacttggcaaccctaacaccggtaaaaccacccttttcaacgaactgacggacaaatacgcgtacgtcggtaattggactggcgtgaccgttgagaaaaaagttgggcaaattcgccattcacacactaaagtcattgatctgccgggggtttattccctaaatcccattactaaagacgaatccgtggttaccaactacttattaggtcattcgcctgacttgatcttaaacgtcaccaacgccagccaattaaaacgaaacttgttattgtcagttgaggtgttggagttaggcgtgcctgtaatcatcacattgaacatgatcgatgatttaaaacgaacaggccactactacaatttgaagacactctcaaccgaattaggctgtccggtacgaacgacgaatgcacgtaataaggaaggcctaaccgaattaaaagctgatctagttcgtgaccaaagtgaaataaaacccaatttaccattaaaattaaactatccgttgatggttaaccaagccattcggcaagcagccacttcattaacaaaagattataaagttgaacctaagtttgctcattggcttgcaatccagtacatcaataacaataaagtggtgcgaaaatacgccacaatgcatcaactgaaaccgctattatctcagaaagcctattacgacgctcaaaagtttgatgatcaaatttttgagacgcggctgtccttcatcgaaaaaacgttggcgtccgcaaccgaacaactgaagtcaacgcaacacgtggccattacctctaaaatcgataaggtggtcactcacccgatttttggtctccccatcttcgtgggaatcttttacctcatgtttaaactatcatttgactggattggcacacctctgtcaggttaccttgatggcttcttgtcgggaccaatttctagttgggccaaccaatttttgactcaagcaggtgctttgccaatgctacgttcattgattgtgaacggcctcatcgctggtgtcggtggtgtcctcgtgttcatcccacagatttttgtactatttgcttgtattaccattctcgaagattcgggttatatgtcacgagccgcactggttactgacagaatcatggagatgattggcctcaatggtaaagcctttattccgttgatcattggttttggctgcaacgttactggcatcatggcggcccgaacaatcgaacaacctaaggaacgactgattacgaccttgatttcgccgtttatgagctgttccgctcggttacccatttatagtttattcgtagctgccctgttccctcgtcatcaagctttaattgtgctgtcactatattttctgggaatcgttgttgcattgttcatggctaagttttatcacgttattttcaaagctaaagaacactcggtcttcatcgtggaattaccccagtatcatattccacgtttggacattgtctggcacggtacctgggataagggtaaaggcttcattaaaaaagcgggtacgattatttttgccggtaccgttctaatttggctgctttctaactttggtgttcatggctacgttacccagatcgatcagagcttcgctgctaatctcggccagattctcttacccgtttttaaacccattggcatttcaacttggcagcccatcagtgccttgctcactggcgttctggctaaagaggtcattagttccagcatgatggtgctatttcatactagtaatcaaactgcgctaattgcaatgattggtggcagtttcacagcgatttcagcctatgctttactggtttttatcttgctatatataccctgtttcgctacaattgggacaattaagtccgaaacgggttccgcaaagtgggcagcctattcggttatttccagtttggctattagttatacgcttgcattcttgattttccagattggttcactattgatgtgaaaagaggtcatgattcatgggattattcgttaatattttgattttggctgttatttttgggtttgcaggctaccaaatttaccgagctgtgaagcgctccaagcaaggtaaatgtgctgcttgtgactatgactgtgaagctaaaaaaatgttaaatcaatcaaagaaacgtgccatgtaatataaaaaagtgctatttcgatttttgtcggaatagcactttttcgtagcaattagcatcaaggccttattaattgtactaatcaagagtcccctcaaaacgactcttgctatatacaattagcccacattatactgttttaaatagctacttagtggcaccagtttttgagcatagtaccgctgtttgaaagcattgatgatatcatcatcaaatttatcaggatccaacgttaatttttcaactggaattggtcgctcatttgtcattcgaacatcgatcaaaaccggcttgcccgactgagaaatgcttaaggcctcatcgaaggcatcctttacttcactaattttgcttaccgtaatacctgttagtccttgtgcttcagctacctgggcaaaatcagtttttggcagactaatcccaaaccattcctggccgtcgtcttcctgttcgtcttcaatgtaacccagtgcgaggttggtaaagaccacgttgattaccgggagaccataagtcacctctgtagctaggtcctgcattaccatggcagcggcaccatcgcccacgagattaaagacttgccgttgcggatagtccagctgagccgcaattgcaccaggtaacccgacgcccatagtggcaaatagtccggatgtgatccaaggctggcgcccgttcacttttaatagtcgaaccgcgttttgagtaacgtcaccaacgtcaatggaatagatagcatcatccgttgaaattcggttaatttctttgaaggcaggttcaaacctcaaatctccgctatctcgattcatcatatcgtcgttgtattggtgccagttagcgacattcgccacattggcagcataccatggtgaagcaggtgcatcttcgcccagagcgattaatctttgcagtgtctgtttaacgtcagctaaaatggccacatctgtatggtggcgtttcccaagcacttgcggattggtgtccacttgcacgaacttaatatttggcttgaacattgcttcagcaaacggatagttcgatcccatgaataaaatcaaatccgtctctggcagtgcttcgttagcaggcttcgaagcaacacgggcggctgaccctaatagcgcttcaaaatcatacggaataatttctttccctaaagcagttgtaataatgggtacctgaaatttttgagcaaacgtcatcacttctgaagcagcattgattgccccctgacccacatagatcagtggcttttgagcttgtttgagtaactctaatacctgattgatctggtcatcagccggtgccgccagctgcggtcgagcaaaattagccgctgaactatagtaaccgtctgcaggaattggtttgttagctaaatcattgggaatcgtaacaaaggctggtccatgctgagcgaatgcccgtcgaatcgcttcgtcgatcacgtgcggcaaactggcagcggtggtgacggttcgcgcgtacacgcctggatcgttgaaccatggatcctcatcaaattcctgaaagaaatcttcattcattagtccctgcggattttggccaatcaaaaataagactgggaccttatccgccattgcatcatacgcaccctgatataagtgggttgcaccgggtcctgctgaaccaaaagccaccccaatatgccccgttaacttcgtatcagccaccgccgctaaagcccccacttcttcatggcgaacgtggatgtacttgattcgttcctgctccttgtctaacgcatacatcaaattattgattgtcccaccaggaatgccatagatgtgatcaacgtgccaactttccaacgtctttagggctgcgacacccgaattaatggtctctgccatcgctgtttcctcctccaaagaaaaaatagtaacatcattttttgcttaaccttttaagcgccattatcatagaacgtctgtaaatcaatatcaattaacttgacttggtaaagcaaacgggtcactattcattcaaatatttatcgtcactagacgttttaatcctttaagtgtttatggtcacaagtatgtatcgtacttttgccataaaacccgatgattttatcgagaacatttaagcgctataatgattccacgaaatccaataaactgaggtgactcacatggcaaaaatcgataaacgagcactacaaaccagaaataaaattgaaacgaccatggtgaaactctgtcatgacaaagttgagtttgccaacttaactgggcctaaagtggctaaggcagctggcatctcgcgccaaactttttaccgccactatttaacaccgaaacaggtaatcaccacgttaattgaacgtcatttagccgaatttttgaattcttttcgcctacaaaatttaactgcccgtactatggtactacagctaatgtcggcttggcagggtcgatcaaccgttttagagctcgttgaatggtcagactcacgttacgagttcatccgcgctctggcgcaatttaaccagcgtatcgctagtcaaaatcaggtgtatttaattaatgaacaaactgtttgcaacgtttatgcggcatcaacctacatgctgttacgtgattatgttcttaaccaccaatggtctcaggaacaggcaactgatttactccttcatctaactaacaatatggataaaatcttttaacttttgtgacgaaaccccttaaatggtccataacttagcgtgtttatcagttaaactaagttcatccaatccaataaggagtgttaattatgaaattaattacagcagaagaacatatcagcactgactatgcacacaaggccattaatgattacttaaagtccgttcccagtgatccaaaggcaatgcagaagtttggtcaatcattcgcggaaggtctggttgcttatgctgtggatccagcagtcatgagcgatattgatgaaaaacgactgaactacatggacgaaaatgggattgacatgcagatcttatcatacggcgatgccagcacaaatcctgacatgctgccggcagaccaggccattgcgctgagctctaagatcaacgatacgattgcagctgccgtaaaacgacatcccgaccgttacttaggctttgcaactctgcccgtctctgaacctgaaaccgccgccaaagaacttaagcgtgctgttgaagaattaggcctaaagggtgccttaatattgggtactgatagaaataaccaattcctagatgctcctaagtttatgccaatttttgaaatggccgcaaaactggatgtaccgctgtatatccatccgtcaatgccatcaaaaaccatccgcgataactattacagtgacatgaatccgattggtttcaatgccatcatgtcaacgccaggttggggctggcacatggaagcaggtttgcacgttacccgtttgatcctgtccggcctctttgacaaactgccaaatcttaaattgatttctggacactggggtgaatttgttccctactttcttgaacgtctagatgaagccacgacaccagtaatcggcaatccgttgaaacaccccgtttcttactactacaaaaataacgtttacgtcaccccaagcggtatgttcacgtggccacaaatgcaattagttctgactgaaatgggtgccgatcacgtgatttgggcacaagattatccttacgtgactgggaacgcttctgattttctcagtgggacaccaatcagcgatgaagataaagaaaagattgcccatggtaacatcgaaaaactgcttaaattaaaataaggctctgaaatttttgcaaaaaaaaacgacccgttaaggtcgtttttttaatgttctgtttgatttagaatttaacttcgctatcgtcagaacccttttcgattaagttaacgttgctgttcaaggcaaattgaaccatgttcttagcagcggtcttagtgtagaaggcaatatgtggtgtaaccaaaacgttttcacgcttgatcaagttcttcaaacgttcgtctggaatagcatcgaagctaccaaagtctgtgttgaagataccaacttcgtcttcgtaaacatcaagtgcagcaccggcaaccttgcctgagtctaaggcacggatcaatgcgtcagtgtcgattaatgcaccacgagcagggttcaagatgtaaacgccatctttcatcttgttgaaggcatcgtcatccagcatgtgttcgttttccttagtagctggtgaatgcaatgaaataacgtcagcttgggcgtataattcatccaaggtatcaacgtagataccttccttttccaattctggattgtggtaaatatcataggcaacgatcttagcaccgaaaccacggtaaatgttgattgctttacggccgatacgaccagtagcaataacaccaacagtcatttgatctaattcatcggcgatatctggagcccaccgaagatcaccatgagcgattttacgatcaaaagtgttagtccgacgaagcaaacgcattaattgcgttgcagttaattcagcgattgcgtttggtgaatatgcaggtacgttagtaaccttgataccgttacgcttgatagcgtctgcatcaatgttatcaacaccaacgttacgtagtgaaagtgacttgataccgaagctagctaatttgtccaaaacttcagcggtgtatggcttttgttgataaacaacggcaccatcatagcccttagcttggtcaacagttgattcatctaataaatcagcaactgccttaacctcgatacccttatcctttgaccattgtttaagataaggcatttcatcgtcacgaataccatatgcaataattttcacaattgtttcctccattcactgatatgaatctattttatcatgttttcatcagcttgataagcccttcagagaattgtgaagaaaaagataaacttaattgtttcattattgtttaatttagtggaagcagacggtttcgcacgtcaattttacttaacgtggacaccatgggacagtaaataagcgactttgtcttcccttggttggtgtttaaatgcatattccgcttttagagcggctgatttagagtcaaaagtttcaaaatagatcaactttaaaggatgcctgctttttacgcgtgtatatttagcaccctttcctgcttgatgaacggcaaaacgtttatacacatcggtggaatagccgccgtatagactgttatccgcacagagtaggacgtaaaaataatactgattcgttgtgttactcaccgtataacatcttctttaccggcgcagaatattcaccagactcatcatacgtcatcagagatggcaacacctttaagccactagatcggccatctttaatggcttcaaccagcataatattggcatcccgccccactttcgggtagacaaactgaagacgcttaaccgctaaccgatgcttactcatcatagcagtcatctcaagtagccgatcaggtcggtaaacaaagaaggctttgccattcattttcaatagaccactcgtcacctcaatcaccgtttctagagacgttgcaatctcatgccgtgcaatagctaaatactgattcggattttttttgctgtctggtagatctgcgaagtatggcggattgcaaaccactgtatccacagaatctttgcgaatttgattaaaaatcgtcgctaagtcttgctgatacacggtaatctgttcttctagctgatttaaggctaccgaccgtctggccatatcagccagccggggctgaatttccaccatagcaattttcccttttacccttggtgccatgaacagccccactgctccattaccagcacacaagtccactaattttccagtctgtttgagtggcggtttagcaaagttagccagtaaaaccgcgtctaatgagaaagaaaaaacttgtggactctgaataattttaatatcttgactataaagctggtcgattcgctcgccagggagtaactctggagttgtcaaataatcacccatttcgttgatgtttcggttatttatccttataatagccactgttattcacgtgaatcaatgcttaactatcttactatttttaatcaacatatcaagtcttcgccattataatttaaaaacattctttaaattgaccaatcaccataacccaagacttttattggtgactggtctataataatggttacgattattattttacttaagagaggtcacacaatgttttattcttttatccgtgttgttgttcgcgtgctggtttacatcatcaacggcaaaccaagctttgagcatactgaaagactccctaagggcaattatatcttagttggcccccacagaacttggttcgacccgatttactatgcactagcgggcagccctaaaaaattcagctttatggctaaaattgagttatttaagaatccaattttgcggtggatactaaagcacgctaacgccttcccagttgatcggcaaaatccgggaccctccgctatcaaaacaccggttcgtctccttaaaaatagcgatttatccttaatcatgtttccatcaggcactcgtcattcccaagatttaaagggtggcgtggccgtgattgctaagctgtcaaaggtcccaatcgtaccgacagtctatcaaggaccgttaacgtttaaacaactttttagtcgtcaaaaaattaccgtttccttcggcgatgctttcacagtcgatccaaagatgaagttaaatgaagcaggctttaaagaaatcgaaactaagatgcaggccggctttgaccagttggataaagagatcgaccctaatttccactatgtggatcccaaaacacatccacaagcctaattttttacgttaactcagtttccaactatttaaaacaataatccccgtcctgataaacactatcagaatggggattatttgtattaagcgttttgtcacacaccctagtcaagatgtgctgtattttgcaactgaatcatatcgtaataagcccctttttgagccatcaactcatcattcgtaccgcgttcgataatcttgccttgacgcaagactaagatcaaatcagcattttgaattgttgataatcggtgggcaattgcaatagtggttctaccagactgcaattttgctaaactcttttggatttcctgctcggtttccgtatcaatgttagcggtggcttcatccaaaattaaaatcttaggatcagtcaccacggtccgtgcaaacgaaatcaactgtttttggccactggaatagccgttaccacgttcaatcactttggaatcataaccttttggtagcgattcgatcatttcaccagcattaacaaactcggcagctgcccgaacctgctgatcagaaatagactgatcaaacattcggatgttggaagccaccgttccataaaacagaaatggctcttggagcaccagccccattttatgacgcaatgtggcgtaatcatattcacgaatatcatggtcatcgattaacacttgacctgactgaaactcgtaaaaacgcatcaacacgttgatgatcgatgatttaccactacccgtttcgcccactagtgcaaccgtttgaccgggttcagcaacaaaggaaatatcgtctaaaattggcgtttcaccatcgtatgaaaaactaacgtgtttaaattcaattctgccattgctaatatctctgcctgacacgggtttttgctgcggtacagcagtgtcactggccatcaatttcatgacccgagaaccagacacgatcccctcttgaaagtcactcaagttatccatcatgctggtcattggattgaacaggttattcaaataagtgacgaaggcataaatcataccagccggcacaaacccgtttaacccacgaacgccaaacagcgtcagcacaaaaataacgcctaaagagtaaaaaagatcaattagcgggcttaatagaagcgaattaacccgaatcattgcctgccgagatttaaaataagcgctattagtatcatcaaactcgtggttcatccgcttttcctgccgaaattgctggataatactgatacccgtaattgcttcggataatcgtgcattcagttcactgagtcgctcacgcatccgtcgataaacctttgaactgtaacgttggtaataccaaatggtgaccactaataagggcagtaaaatcaaaagccaaatcgccactttcgcatttaagaaaaacatggcgatcactgatgaaatcactgaaaacagtgccacaatcaggctactaaataattgccaaaaagtgctaaacgacatggtatcgttagtaagccgtgacagaatcgaaccactgggcacctgatcataaaagcgcatgccaaaatggtgtaatttttcaaatagctgacggcgaacactttccagcatatattctgcccccatgctgtagaggtatgcctgaaagaactgcattaccgcacgcgtgatcattgcaaaaaagtaaagcgcggcaaagaaccacatgattttcagatcagcccggccgactttgaggtagttatccatataatcacttaaaatcatcggtaacataatgttaacgacactaacaagggcagccagcacaatggcgacaataaagtggcgccaataaggtttcgcataaccgatcaagcgagaaacaatgtgcatctgttccttgatgggaatactcttcgcccaagcggattcgtgttcattattcttcaccatcagccccccttacgcgcatttccaattcctgccgttcaaacatttgacggtaccagccatcctgtgccattagctgatcgtgattaccgcgttccgcaactgtcccatgatccatgacaatgatctcatcagcttgcatcaccgaacttagcctgtgagcagcgatgatcgtggtcttaccagcccgttcacggtgcaagttagctagaatctgactttcagtttctgcatccacggcagataacgcatcatccagaatcaatagctctggcttgataagcaggactcgagcaattgctacccgctgacgctgaccaccagaaagtgagaccccttcctcgccgactaaagtgtcatagccattttcaaaatgttgaatttgatcagataaatctgcatctgccacagcagcctcaacttcctcatcggaggcatcaggtctagcaaacgcaatgttgtccctcactgattctgaaaacagaaaactgtcctgtggtacatagccgattgcgggcaaataactgtctaattgataatcgagaatattcgtaccaccataactaatttggccttgataacgctcaaattggcgaagtaataaacgcataatggtggttttcccagcacccacgcgaccaacaatgcccaaagttttacccgctggaatcgtgaagttcacgttcttcagcgccacctgtgggtcttccggataatggaaatcagccacgttaaaggttaaatcaccggctggtcgctcactgcgaccctgagtttggtcaatgacctgagatttttcgttaatcaggtgcattacccgatcataactggcattcccacgttccatggtgttaaacagcatccccaccgcgaatatcggccagatcatcatggaaaggtacgtaataaatgaaactaaattaccaatcgtgatcacatgactaacaactaacgaaccacccatgacaatggtgaccacataagctagtgcaataatcaccgtggtaatgggatcaaataaggcatccaaccgattgactcggcggttgacctcgatggtttgatcgacctgctgattaaaatccacaatatcttcgcgttcttgtccaagactcttaatgaccttgacgccgctaatgctttcttgcgccttattatttaatcgtgaaaacgcggcttgagaatcacggaaggcaacgttgattttttgaccaagatagtaagccattatagctagcaacggaaatggcagcacggcaatcagcgttaatcgccagttaaccaatgccatcatggcgatcagtgtggtaccacccgtaataattgaatcagcaaactgaaggattccaccaccagccacacgttgaatagcttgaagatcattggtggcacgagccattaaatcacctgttcgatacttctggtaaaaggtttgatccatacccatatagtgattaaatagtcgctgtcgcagtgttttttccaatttggcagctgcaccccaaatcgccgtacgccacatataacgtgcaccgtactgacctagagcggcagccagcaaaatcagcagatcagtgactaatagtttcaccgttaattgatgactatgaatcaaatcaacaatgacaccgatcatccttggtggaatgacagctagcaaagccgttatcaatagtcccaataagccaaacagatacgttctccattcggttttgaaataccagcctagttttttaaaaatactcatgcggtcacctccttgatttcctgacaaaattaaaaagactcgggattacccaagccttcgttttaagaatgcgaattaacgcttttctgattgctgttgtttcatgctgttcatcatttgacgcaattttttctctgaaggacgttgtcccatttgcatcatcatcatgcgcaattggtcttcgttgattggtggattttcacgaatgtacttttccatatacttacgtgcagcgaagaacccaattgctaaaccggctaataaagcaacgattacaattagaatccaaattccagtgctcaagtggatgtgcctccttttcagtagcttccagttaacaatattacacaagttcagcccattttaaaagggtttctgacggaaagggtaaaacgtttaccgtaaacccttctttttttgaatttcttgaacttttttaggtgtaatttccttacctgatttatcaaagacacgtagcatttcaatatcactcttaaagcttgcacggaactgcttgagatacttctgtcgaagatcttttcgttctaccttctcaagttcagttaaaccctctgcttttgcttttcttgctaattcattaatgcgggcgattaaatctttcatttcggtctctgccattaaattcactcccttgtacaaacatgctttaatataataacgcgaaacccaagttggttcaaggaagaaagcctattatagggtaagaaaacgaaccaaattaatttcgataataagaacaatgccaattttagtcgaaaaagcgaacacttgtttgaaatagtgtgccaactatgctatgataacggtaaatcaaaccgaatgttagaggtgaaaccatgacaaaatcttcagattcgaaacagctcgcaattttgcgattcatttatgaccagactcaatcacacggttatccgccaacagttcgtgaaattggtgaaaaagtgggtcttagttcaacctccactgtgcatggtcacattgccaggcttgctaaaaaaggccttttaatcaaggacccgactaaaccacgtgcactggaagtcactgatcttggcatcgacgctttgggcattgttaaaacgccaaccaagattcccgtattaggtactgtcgcagctggtgaacccattctagcagttcaagaagcagttgactatttcccagtgcccgaccaactagtcgatgaagccagtgatttattcatgcttaagattcgtggcgaaagtatgatcaacgctggtattttgaacggcgataaggtcattgtcaaaaagcagcattcagccgaaaacggcgaaattgtgattgctatgactgaagagaacgaagcgacatgcaagcgattctataaggaagaccattactaccgcttacagccagaaaacgataccatggcaccgattattttgaatcaagtaaccattttgggcaaagttatcggcttgtatcgtgacgaaattttctaactttaacgcgttaaccaaaaagaagtaggcaaattgcctacttctttttattactcagttatcattcaccgcgatctaaatattgtcgctgatcgtgtttgatgccggtcagcacaaaacgggcatcatcatgactcagatcaagcaacacatcatgttctggtaattgttgcgaaaagagtcgttcatattgcgtcatggttaaccgctgacggctgcggaaaaagtcagtaaaccagcgttttgaagtttgaacatcaaaggcatcactaattgtaccgctaaagaattcaccctctgccccagatccataactgaaaagaccaattctttgtccgggcttcaaatcagcattgtcaaacaatgatcgtaggcttagatacagtgagcccgtgtaaaggtttcccacctgccgattatattgacggctagcctcaaagttagtcattaactgtttttgctgatcctcgctggcctcaggcaaaattgcccgtaaaccctttaaccccattttcgtaaacggcaaatgaaacgcaaatgcagtaaagtcgccaatggtaagcttggtctgctgttgataatcctgccaaacagctttaaagaagtccacgtagacgttctctgaaaaacggccatccaccaatgcttctgttcgataaagcggtcgccaaaaatccatgatatcttctgaacgaaatgccgtagcatcatccaaatttaaaagttttggttcagcactgatagttaacgctaccgcaccaccaccctgtgtcacttcaccgggtgtcttcaaaccataacgggcaatatcggcaccaatgactaggacctgtttatcaggatgaagccggacataatcatgcgcaaactgaaccccggctgtagcaccgtaacaggcctgtttaatttccactgcccgaatattatccggtaactttaataatcgtttcaaatagatggctgctgatttcgagttatcaataccagattccgtcccgaatagcaccatagctattttattccgattggtatcgtcaaccactcttaccgcggcattggctgctagtgtgacggcatcctgtgtcaccgggataattgcctgttccgactggccaataccaatccgatatttatctggctcttcgccccttgcgtgtgccaaatcaacaaggtccaaataggtttttggcgtgtaaaacgctaactgatcaattccaatttgcataatgttctccttattactcattacttgcctaaatagtgataattatagtccataccctctttatagagttggtatgacgcctccgattcatccgcaaaaatcactgaaattgctggtgtaccccaagatgaatagccccaaaagaccgtatcatcataatcataactgtcattggggtgccggtaaaatccccgtgttcggtcccagatcgtaccgtgagttctgacccagtcttcggcaatcccagcttttacttcatccaaccgttcactattatctaaaatcaactgccgtaaacgttcccagtcgatttgccaattatgctgcttgggccgtggctgaccgtcttgataaacggttgaagactcaatgacgtttaactgaatcggtactaaatcttgaaagcgcattgaaatttccttcttccccttcaattaaataccactatttgtaacgtctgcttttgatttatcctcataccatgctatcatagtattaaccgcttaccaagcagtgtattcctaacaattagtgttttaccatgaaccaaaaagaaatttgaaccaaaaatatttatacctaagatgaggtgttgagattggtaagtactactgtaaaagtaattgcatcagaagggttaactggggataaggtaaaccaactaaccaatgatttagctaaatacgattttacgattacgttagcgtataacggtaccaagacaaatgcaaacagttcactaggtgtgatgagtttgggtgttcctagcggcgcagaaattgaaattggcgttgaggggacaactgaacagttagaatcagccgttcaaaccctaattgatcaccaagtggttgctaaactttagtttcactccttaaccggttgccttccaagcagccggttaatttaacaaaaaacgagaatgctttgaggggattttatattatgcaattatcaaaacaactattgaccggactggcaactgccggagcggttttattagtgggcgctcgtaatgccagcgcgacacttagtcctagcagttcccaaccaagaactgacatggttgatttatccagctggcaatccaatctgggtgccagtgactatcaaaagcttcatgatgctggtgttaaagcggttgccatcaaagcaactgaaggcacttcatataccagccctgttctccagcaacaatcacaagatgcggaagatgccaatttagcagttaactactatcactttgctcactttacttccgtggccagtgccaaagctgaagcgcaaaacttcatcaacgccgtccagtcagtgaccagctcaaagaacatggtcatggtggttgactttgaatccagcgaactatcaggtctatctaagagtcaaaatgatgctgatttagccgcctttgacagtgttttaaacgctgccggttataacaagactgacttatacaccatgtccagttgggtgggcaatcacatcgacaccaacaccagcaacaaaggttggatcgcacaatggccatcgaatccaaccggcacggaatatccatccgcaaatgcctggcagtgggcctctgattaccggtttagcggtgaatcgcaaaaccttgatgtcagtcaattaaacaacgaattttacgtgaatggcagtgctagcacagcagttcacaccagcccaagtagctccacaccgaagacaacgttggttaaggtgcctgcacctgcgccaacctcttcttcaaactactcaactgctcgttcgaattcagtaacgctggtttggcgtggttcaatgcatcgtcatgcttactggacactatctggtgctcgttattcgaagcatttaggtatcaaatacgctgatatgaagaatttaccacacacgacttggtacacggatgggcacgaaaagctttatcgcaaagcttctcacagctcagccatctattaccacgttcgtagcggcaacggcaaacattcaggttggatctggcgtggttaccttcatgctggtgtcaatccaaatgcttaaatactagattaaaatggcggacaagtcctagatggatttatccgccatttttaggtctaactctacagcatcattaaagttattttactttgataatgctatactaaacaggtaaagggagtgacaccaatgaccgataaacctgaaaaaaaaacgactaccttcaaaaaaattcgccgtggcatgcctggtaattgcccgcaatgtcatcgcgaaatgaccatttattacgggatgaatcattgtccttcttgtggctacctatttaaatctaattttatcgttaaataatccttaaggagcacatcatgatacaagactaccttgactactggtcaaaactcactgttttcaatgccaccgcaacgcgtaaacaatactggacggcatacattattaatgctgttgttgtctggctttacgcggttctgacccatcaatcccaatacctagtcagtggtcactatgaaatagctgctaatttgaattcaatcgtttttggtctgattctcatattggtctggatcgctaacttcaccattcgagcccgtcgtttacatgacggaaatcacagtaattggtggttattgatttcaatcattccagtactaggcgtcatttggttgttcatcttgttattgatgccaaccgttgaaaaccagcgttggccgttaaaccagtcacaggtacagtgaaaaatatcagcgttttctctaaaccaaggagaaagtgctgatatttttaataaattattttgtttgctcatcttctgcgttaacaactaacacttgaacgttcgctcgccgaacaacatacgccgttgtcgagccgattaacaaccggttaatggcatctacacctgatttgccaatcaccaccaagtcaaaatcctcttggttggcagtttccacaatcaccgtcttcggtgaaccgttcttaacaatcgttttgacatttatgcctgcctcttcggcgatctttttaccttcatccataaccgctgtagcgtgccgtctcaactcgctttgaatatccattggaatgttcccagccgctagtgtcattcgcgtctgatcaataacagccagcaaagtgattgaagaaccaaaataacggctgatcctaatggcaaccttcaatgccgtcttcgaattatcactaccatcgaggggtactagaatgtgtgaaaacatcgtcatcactccttctgcggactcatttaagcccacgtggcaacccgactttcaactatatttagtatgaatgataattctaacgaaatcaatttatatgcccctaggtggctaacactaaacaaagtgcggctgatctgaagttgagaggcccccagaaaagttaacgcgctgttgcccatcataaacccgtaaagaatagtaaccaggtttagctttaacagcccttgtcgtatgcccgctagaaaatgaaacggtgtcgacacttttaccatttcgataaagccggtacgtataagtatggtggctaatagtttgattttgatcataggcggtaatcacaaggtgtaattgatgggccggtgttaaaatgacccttctggttgaaattgatgcttgactggtttgctgtaatgctgaggttttccggcttgatgctgccgttggctgactttgtgtaaacattagtcctgcggcaccacaaattaaaaataccgctgcaatcaatagtttaaatggtttcttcatgttggcctccttcatttctaatctcattggtataaggataacgaatcctgattaatacacaataacgagaacgtcacatttctgtgacgaatcatttcaaaaattggattaattgaaatcttttgctggtaattagctgtaacttagcgtaatcttgtaaaagtgattttaagtaaggagttgatattgatgaaattaaaaaaagcaacgttagcagatcttgatacgatcatcgctattttaaaagatggcagtaaccaattagcagaaagtggtgttgatcaatggcaaggtgattatccttctcgtgatcagatcacctatgatattaacaacggttttgcttacctggcacagtcagatgacagcgaaacagttggtgcaattgccatcgttaccgcaccagacccttcgtatgacaccatgaagggaacttggctgaacaactcgaacgattacatcgttcttcaccgggtagcgattcattcgcagcacgccggtcatggctatgccacccgcttattcgaagccgttatcagtcacgtgatttcagatcatcctgagattacgagtatccgcatcgacacccacgctgacaacaagccaatgcaacacttgatcgataagatgggcttcacaaaagttggcgagatctacggtgtttatcacccaaccgatctcagctttgtttacgagatgctgcctcacgaagacaacgcggcaaaacatcaagcaagctaattcatctaaaacaatctaagctgtgacaaaactcggtagattccagaatttaacgtgaataatgcctattccgcgtcttttgcggaataggcattattttcgttaaatggccggaatctgagttttgttgcgtaattaggctatatttccgtatagctccaaagtacagtaaacactaattctggctaaaaattaattgagatacttaccaatatagacttataacacaacctcttttatttactcagccgctgttctgaatccttgtaaggatgcggctcaccctttatttcgtgtgaaacgtgacctaacatggcatctaccatttccagaatatgcggatcatcgagacagtagtatacgtgcgtcccctttttatcacgagtgactaactgatagcgatacaaaatcgccagttggtgagaaaccatcggctgcgggagatcgacgttctccacgatcgttgagacatccgcctcattgttctcaagaaaatacagaattttgatccggttcgtgttactcaataccttgtagatcttcacggcttcttccaagagcgcattactgaccttcatgcatgatccccccttataccaaattcgatatctacattatggagcatttagtgaaagaaagctatcacgtgactaattaagccgctatcccaaaacacccaaagcccgattaaaacgtagcaggtcttcattaacttttcgccgtacttctccatcacaccagtaacggccggaacgttcgcaatcgccttaatcacgagcacgactagcagcgtcaacgtcccaataaaaacgagggtcatcaggaaatgcaacaaatcctcacccactaataccggcagaaaaatggacaaattgcaccccgcacacacggataaatacgtcagcatgacactgacaatctgcgagtgatggtgcttgtcatcagctgaatcatcgtcatcatgaaaagcaaggtaaatcggcaggatacccaaaatacctaacagccattcaggcagaaaaaccagtaacgcttttccgaccgcatagcttaaaatcagtagggtcagattacccagtaaataccctatcatgacctttgacatctgatacttgtttaataggaaaatcagcatgaagaagaaatccaggttcacactcaaaaaggttaacgttaatagccagtagttcaaaactcaaatcctcttttctgttcgtgaatatattatatgtcacatatagcatatataaaagacctctagcaaacaaaacgcttttagcctatgttttgaaactaagaacgccttgaacaactgaaattacttggttttgacaatactggattgctgcttgatcaaccggtttaatccaataatcagagataatgaaattacggaataaacggccgagccaaagctaatatcccttaacccaatcacatcaaacatcaccgatgcggttgccgaccctagggtaataccgaaattaaaaaaaatcgagctcagcgacgatgccaacactagggcttggggataatcttgttccgcgatatctaaaaaataaacctgcagtggcgcgcttaataaggtcacaatcatggtcaggatcaaaagtgcaccgaaacctactgcttcattattcagtgcttctggcagcagcatcaagatgattaaatcagccacataatatttgggcaaccggtttagccctccgtgcttcgctaggtgtcctgaccagcgattagaagcaatactcatcaagccaatcataaataacagcacgtttagattactccggctgaaaccgagtccactggtcagtaaaggccgaatatacgtataatatccgtacattgtggctgctgtaaataatgccaacaaaatgccaatttgaatccggtgatctcgcaatagtttcatttgatctccaaacgtaccagcgatttgctcaacgtgcttaggcaacaaccaaaccaggaaaccataagccattaccgtcagtaatgacaccagtagaaaagcatcacgccaattgtattgaacgctgagcatcgtcccaattggaacaccgaaaactgaagcaatactataaccggcaaaaacccaggcaaccaaactggctcgtttacttttaggtgcaatgacggctgtaaacgtcattagcagcgagataatcgctccagctacactggcggcaattatccgtgaaaacaacatccaaccataatttggagccatagcactcatggtattgccaaccaagaatacccccatcagtaccagtagcatttgatatcgattgtatttactggtaaaaatggtgattatcggtgtacagattgcatacacaacagcaaacaccgtcacaagatacccaacttgtgtcaaggaaacgttcaaatgacgggcaatttcggaaagaatccccaccaccataaattcgttacatcccagaagaaaggttactaaaacaaaaactagtgctatcagtcgatttttgttcatcttcaatcctcctcatagctgcctcccctaaccccgttaacacccgcatttaatcaatggcagtatagctcaattacctgtcaatgacatgaatgacaaccccaaatcagtcttcaatgatttaaccagacaaatcatttgtatttactcactggtttaatcataattaggattggattaaaattttgtttaaaagaggggttattatgttcgatgcaaaagttgcaattggaacctggtcttggggatcaggtataaacggcggtgatcaagtctttggcaatcacttaactcaaactgatttacaagccgtagttgattcagccatggcaaatggtttaaatctttgggatacagccgcagcatacggtcagggctcttcagaaacgatattaggtaacagtttgaaagcttataatcgtgatgactactttctctccacaaagttcacaccaaggtttgcaggctcaggggagaatccagtggccgacatgctggccgaaagtttaaaacggctgcacacggattacgttgacctctactggatccataacgcagaaggtgttgaaaaatggacgccaatgatcattccgttggttaaacaaggcctcatcaaacacgttggggtttccaaccataacctcaaacaaatcaaacgggctagagaaatcttaaatgctggtggtgttgagcttgaagccgttcaaaaccattacagcctactccaccgtcaatctgaagatgacggtatcttggactactgccaccaaaacggcatcaccttcttctcttacatggtattggaacaaggtgtcctcaccggtaagcatgacgctgcacatccatttgaaggtgacagtaaccgggcacggacctacaacccgatgttgccaaaactaaacgcgttattagcaaaaatgattgaactcgctggtaaatatcacgttgcagttgctgatattgcaacggcttgggtcattcaaaaaggaacgaccccaatcattggtgtcactaaacaacactatattgcggatactaaacgtgcaatttcgctcaacttgacctctgatgaaatgaaaacattggaaacgttagctgatcaagcacacgttaacactcagggcagttgggaacacagtatgaacgagtaacatagtaatcattaaaataagggtcggcaaacacctctgctgagatgtttgccgaccctttaacatatgactttaacttactttgagttaaacgattaccaatgacttgatagcctcacgttttgccattgcttgatatgcattatcaatgtcatccagtttgaacgatttcgtaaagactttacctgggtgaatgtcgccatccaaaacggcctttaataagatttgcttatcataagtggttactgaagctggaccaccggcaatgatcgtgttcttatagaaagaactagacatatccatttttggctcatgtggtaagcccacacgaccaacgatggcacccggacgacctgctttcatggccgtgtcgtttgactgttccgtaccgacacattccaaaacggcatctgcaccagcgttatttgtcaatgccatcaccttttcaacagcttcatcgccacgttcagcaataatatccgttgcaccaaattcgatagctaatttttgacgatcctcgtgtcggctcatggcaataattcgcttagcgccacgcaatttagccgcaatcacaccgcataaaccaacggcaccatcaccaacaacgacgaccgtatcacccgttttgacgttagccactcgtgccgcgtgataaccagttgccataacatcagcaagactcaacagtgagttcaacatttcatcactgtaatcagctggttgacccggaactttgatcaaggcccaatcagcatgttggaaccggacgtattctgattgaacaccgttactaaaattatcatcatgactctgacaatcacctgggcctagaataaaaagtgtacaagttaaatagagactttgatttagtataattaaggaagtaaattggaggatcaaataatgacgaagcacagttatgacaaggaatttaaggaacaggccgttcagtcattacttagataacaaggatcacatgaccatgaatgaaataagtaagaatctaggtattggggctagtacattacataaatggaaagctgtttactgagactggggatttggccgtggctctggtaattttgccacgataaggacaaggagatgcacgactaaagcgtcaacttcgtgacggctgagagcgatcgaagtgttaaaaaatcaatcgggattctgagcaagtaactaccgaaaaggtataccaagaaatggacgttcagcacgctggaatcccacccttccacaatggatgtgtgatttgttggatctcaagaagtggttatcatacaacgagaaaagcgtcataatcaccaatcaccgcgaaagcttcggaagaattttttcaaggtgaaattaaagcaatttggctcaaaagcctttgttttacggtgccgcaaatacacccaagaacttcgctcaaaaggatataagatcgctgaacgaacttttggtaagtatatgcgtgaacttggcattcacgccgtttacctaaccccttggacgactaccactcgcaattctaagtttgataacagaataaatattttagacagcagttcaatccattgcgaccaaacgccgtttggtgcattgacaccacttatatttcagttcatgacggatctgtttatttaaccagtattatggactgtctccgcgatcccgacgaatcattggttgggacttatctgaaccttggatgtatcgaatgtcatcccacttattgaaagactttaataactagcgaacagtgccatttgtacgcaacctattagcatacgctgcatgattaatcatgcacagtgatcgggtagtcagtttacgtctgaagcttacaatcaagttacagctaacatgacattaagctattcaaagaaagcttatccttgggataatgcctgcattgagtcgtttcatgccttgattaagcgtgaaggataatcggtttaaaatccattcatcactccgaagctaaacgactagtttttcagtacattgaaacgttgtacaacccagttcgaacttaccacactgtggattcaaatcaccaaagcaacttgaagatgagtatcaaactcaaattcaaaatttagtcgtggcataggacaaaaaagtctctatttaaattgtctattttattgacaggggaccaaccatcaaagccagccagacaagctgcacagtgtccgcatccgtgagtaaacggtgcaatgacaaagtcccctggcttaaccgtagtaatttcactaccaactgaatctacaataccaatggcttcatggcctgaattctcagaatgctccgctttttcctctaatcctcggtatgcccacaaatcagaaccgcagacacaagttctaaccactttgataatcgcgtcatcatttgcttgaatagttggtttgtctacgttttcgatgccaaccttacccgctttttcaaaaacagctgttttcatgataaatatcccctttcaaaatacagattgaactaaatatatcagttcatcagcaattcagttttattatatcagttagagtccagtcgaaggcaatagttcacaaacaccacttctataaaaacttttacatcaaataatgctaaaataaactcatcaaatgataaggagttggtattttgacaattaaagataaagtcgttgtcatcaccggtgcttccagtggcattggccgtgccacagcagaaaaattagctcagtctggggctaaagtcgtcattggtgctcgacgtgcggaccgattgaaagccgtcgcagatgaattccccgcaaacactgtactgtatcagcaaaccgatgtcactgaccgtgatagtgtcgctagtttagtaaaattagccactgaccattttcaacgcgtcgatgtgctctataataatgcaggactaatgccaatttctaaaatggctgaactaaaagttgacgagtgggaccgaatgatcgatgtcaatatcaagggtgtcttatacggcatcgccgctgtactgcctattatgatccgtcaacaaggtggtcaaattatcaccaccgactccgttgcaggtcacgttgtccaccccggaacagccgtatacgctggtactaaatacgcaatccaggcaatcatggatggtctgcgccaagaacaggtcgcaaaccatattaagacaaccatgatttcacctggtgccgtaaacacggagctattcagtacgatcagtgatcctaagcaacgtgctcaaactgaaaaacaggaaaaagaaaacggcttaaatgccacagatgttgctaatgccgtggcctatgccattgaccaaccagcagatgtcgcgattaacgaagtgttaatgcgaccatcctcacaaaccatctaataataaacaccgatgaacagataaagagcgataagccctccgtcatggtagagttgcttatcgctctttttgtgatgccgggtgtagtggaccgacatctgtagttgtagttgagaattgtatttcgaaagaaagtacaatgctgagtgtactaaaaaaaaccaataaatacaatacttttttgtaaatttgtttaaaaattggaaagattattctaaaactaattgtggtaactgtctttattgtgatttttgtacaatttttctctgagttgaaacggctatttcttataaaaattggctgagtttgtgataataatgttctagtttaaagtgctcttttcgtttatatataaaataaaatatattataaatttgtaaaaaatgaagctcccaatctcttgatgggtgttctgttaaactaataccccctttgtaactgaaacgctacgtgttgaaaattatcgtaattagttatacgatagaagttaatttaacagcaatgaagacgcttactttgcggttataaattgctttgttgttatattggtaatatggtgaaattaaagctgatgttcgctatacagacataaataatcagctaaataaaggagaggtctaaatggcagaaaacaattctaataaggttagcaaagaatttaaagaactactcaatcaagtatatgaggagaacaaggacgcaatggacttgatgaaaagcctatgacagtaagatatttaactgaagatgaagtcattgccattaaccaatatattattaaacaggctgatgaaggctctgcagaagttgtcgatcctgatggtctaaagtcgatcattgaacaaccgcaaatggtggcatacggccatgaaacctatccaacgatttggctcaaagcggcatgccttttacaaaagctgactaaaaatctcgtctttaacgaaggaaataaaagaaccgcctacctcagtaccgtgatttttttgagactgaatcacattaaatttgagctttcaggtagcgatgctaaagatttcatgtgggatgaaatgtttgcaccagataagaaagaccgaatgattaatgtggccccgattttcaagttgtacagtaagcgcatcgaatcatagaatttaataagtactattttaataaatagctgacattggtgaataactaatgtcagctttttgatattagctgataagggcatgtaaggtacccgattatttagctgtaagagaatactttgagaatcttacatccatctatttgacttagtcgaaacttcaatttaattaaattcgtagtttaacatatcgtccaatcactaacgacgtaagaagctaacatacccttttggaggaaaatatcatgaaaaaagttatcactatcggcaccacttttctagtggcacttacactgactgcttgtggaaattcaagttcatccgattcatcttcatcgtcaaaagataccaaaaattcagttaagaaatcagagccaaagaatgccattacaatgatcaagtacaactcaatcaaagtgggtgatccgttgactggatctggtggctctactgaaactaccgttaaaaaaatgtatggtaagccattgagtgaaacgaaaacaacggtacctggtgctaacgcgaaggccacgagctacacctggtccaatgttggttcctcactatctggtgctaccattaccgccgaatttctaaacggtaagacagtgggtaaagggtatgcagccctcagtaagtccactaagattactgataatgattataagaccattcaaacaggcgccagttttgcaacggttaaaaagcaatttggcacaccacagtctgaatcaattgttggtggcactggtaccactagtgcccaaacattaacttacctggataccagcggaagtaagtcgctttcgttcactttcacaaacaacaaactgatgagtaaaactacaaattcgctaaattaagaggtgtgttgcgataaattgtagtatgtgacaaaattcggtagattccagaatttaacgtaaattatgcccatctcggcgaattttgtcgggatgggcatgatttacgttaaatggtcggaatctgatctttggagtgttattagactatattgacgtgtcggacccaagtacacttaccaatatcgatatcgacttatgtctcatccttcttttttagacttaaacatgaacttagcgattgatgctactcagacgtcaaatggtaaggtgatagaagaactcaactagtgcgcatgcgcagtaccaaagtatcattttcagacccgttcataatcatttttagaaaaagaaaaaccccgtcaattcggcgattggcggggttcgtaaatgaatcaaactattaattgaaggagagtacaggatttgaacctgcgcgccggtataagccggttcgccggatttcgagtccggtgcattaccactctgccaactctccataacacactaaacaattataacaaacctgtggaaactttcaaccacaggatgtcattatttagcgtgataacgcgatttttaatattccatcaagctaaagatatcatagcctttaatcttatcacggccatgaaggtcctttaattcaataatgaaagcagttcctactacaataccacctaaatcttcaacaagatcgatggtggcaccaatagtaccgccagttgctaacagatcatccgtaaccaaaactcgctgccctggcttgatagcatctttgtgcaaatagagggcagacttgccatattcaaggtcatatgttgccttaactgtttctcgaggcaacttgccttccttacgggctggtgcaaacccaatgcctaattcataggcaactggacacccgacaataaagccacgtgcttcaggtccaacaaccatgtcaacgttcttactgcgggcatagtcaaccaactggtcagtggcatagcggtaagctttaccatctgacatcagtggtgaaatgtcacgaaacatgacgccgggctcgggatagttcggcaccgtagcaacgtacttctttaaatcaatcgtcattttaaatagcaactcctttaatcttgtgcaattagcgaggtcaacaaagtcttgacgtcagccgtttcgctatacaatagttgtttttcggtttcaatctgctgctgtcgtttttggtaacttggtgcgtcagtaatctgacgatgagctggctgtttaacttcattcaattgaccattggtaatcgtcacgaagtccagttcacgaaaaatctgcaacatcaagactaactgagttggaacgatttgtaaatacttcgccagctcatttaatcgatgtgcgacatccacatcatgatgcgtttgaacgaacctaaacagtttagcatattgtgcgcgatctggcatccccaaaaggtaatgactttcctttaaataaaaataaatgacaatttgatcagccttaattgccttcaacgccgcctgtaaatcgctaatttgtaccggacagtccactaaatacatcgttggggtatgtatctcacctaaccgtttagcgtctgctaataaccaagaattagcggtagctggtatctgtgactgcagtttctcataaagtcgttgattaaagaaaacataggtggcattggcatcctgaaacatttctgaccgcaatttttgcgtccgcaaatcactgataaccaaaccttcaactgcgatatccttcaccattacttgcatggaggtacgtccctgccaaacattgatatcaatctgacccactacttgaacctgatccggtgcgctttggagcacgggtgctaattcaccagcgccaaaatcaatagcgcttaattggtgattttgatcatttaactgaaattttaaatgtttaccctccgcgccaatggccttcacattttgaatagcactgggtttaaagacaaacaatggaacgggattatcagtcccaaatggtgccaattggcgtagctgcttgtataagtcttcagatacgtcgctaacctgcatttcagatgccactgttaacggtgttttaggctgatcagctaaatgctgatcgacagcagcctggtcgaaacccgcctgcaattgacttaactgatcagcttttgccgtcattcccactgcagcggcgtgaccaccgaagttgatcaaaagatctcgctgaccatcaaaagcatcgaataaattaaacccagcaacactacgtcctgagcctttagccgtcccattttcagaattgacatcaagaaccaccgttggctttccagtcgcttcgaccactttactagccacgattcccaatacaccttcgtgccatcccttacccgtaatgagcatggttggatgatcacgatgagctacgtcttgagcttgagccaaggcaacttcgctgatatcagcgactaatttttgtcgatacttattttgtttttccgttaaatcggctaatttttcagcccgttcttcatccaaagtcgtcaataattcaacggcaggcgctgcatcatctaaacgtccaagcgcgtttagccgtggcgcaataccgaaaccaatggactgttcgtcaatctgatcgggtgtaataccagcttgcttaatcagtgcaactagtcctaatcgatcagtttgtgaaagtaactgcagaccagcagtcactagcactcgattttcatcaactagcggcaccagatcggctactgtcccaatcgcagctaaatcaagcatctcttggggaacttcatctaacaaagcggtagcaaccttaaaggccactccagcaccagataaaccaccaaagggatactggccttctgggtgacgaggatgaatgatggcgtacgcgtcaggcaatttactggggagttcatgatgatccgttactaccacatcacaacccaattcattagcgcgtgcaatagcatcgttacccgataccccgttatccacagtgacaatcaactgcgtaccgccttcaatgagtcgctcaaaagccgccacattaggaccatagccatcgacaaaacgattgggaataaaataatcaacgttagctccaacttgatccaaagtttcgtacagaattgaagtgctcgttacaccatctgcatcataatcaccgtagatcgtaatatgttcaccattcgctactgcatcttgaatgcggtcgattcccttttgcatatcatgcatcgtcatgggatcgtgcaattgagacaaatcaggctgaagaaactgctctgctttttccttggtatcatagccacggttcagcagaatctgggcaaccattggcttaatagataacgaatcggctaaatgagcggcctcatcacttggctgatcaacgttttttatttgccaatcataatgtggttcaatcatgatcatcatcctttacttccggttgatttgactgaagactgtcagtattaccagtatgtgcatgctgatttgtactcgtatttggtgtttcgtttaaacgggttttcaaagcttgaatacgactctcttgctgcctgatggtctttttgttctgataatttgaaattgttgcaaaaaggaacattaaaatggcacctagaaaaatagctaccaacaaaaccagcaccagtggccacgaaacagtcgtaaagccgaaatgaattgggattgattcagtattcatgactgaaaaaatggcaatcagaatcacaattaaaatcgcaatgattacttttccttgccgcttcattgaaataccccccctactcccgttccttatcaaacggaatatcaattaaatcaaagtccttaacaacctttgtattcttaaatactgcttgagcctgtttttccaagtcgtgagctaatttaccgttatagcgagcagaaatatgattcaataacagcttaccaacgtgtgaggttttagcaatattagccgcctgtacgttggtggaatgataataactatgtgccattgcggcttcatccttagcaaaggtactttcgtggaccaagacatccgcattttcggctagtttataactattatcagttttgcgtgtatctcctaaaattgcaactatccgacctttttgagcatgaccaatgtaatcttgaccattaatcactctaccatcaggtaaggtgacggtcttccctgcttttaactgaccgtaaattgggccagatggtactttatctgcctgaagttgttcaaccatgagttcaccaggatggtcacgttcgaccacccggtaaccaaacgtctcgattttatgatccaaatgctcagcatacacggtgaatttatcatcatgaaaaatttcaccaccatgcgataattccacgaactcaatgaaataggatagcttagtttcagaaaccttcaaactggttaaaacaaagttgcgaatacctttaggtccatatatggtcaacttatcattgccaccttgaaatgatcggctactgagtaaacctggtaacccaaagatgtggtcaccatgtaaatgggtaataaatattttatcgatctttcgtggtttaatcgtggttctcaaaatctgttgctgagtgccttcaccggcatcaaacagccagatggaattgcgttcttctagtaaccgtaatgctagactgctaacgtttcgaaactttcctggagacccagcaccggtacctaaaaattcaatttgcatatctgtcgtccttttctatctatctcgcaccgaacatcttagctggtgtcacgtagtcctaattaaggtgaatcctaaccctacaattgtatcagattcaacgtccgattgtgtgattatttagtctaaattatttacttacccgatacttgatcgcacaggaactaaagaaacactacccagatattatgaccccagataatgtataattagtaatgaaggaagtgtttaatttgcgtcttggagaacttatcacattagtgcatcaattagaccctaatctaaaaatggcctttgatacgaccccaatggcgcctatttcgggaatgtcagtttcggaaggtcgtcttctgctgcacgccgccactcagacgcctttaacggtcgaacgttttcgccaacatgcgaaccgttttaatcaacaattaattgtctttgaatctagtggcaaacgtctttatggctttcgccaatcgaaacaatggcttttattcaaataatgggggatcttcaatatgccaagtaaacgtctaatattaactattatcttaaccactggcctaatactaactggctgtggcaaccaagcaaaatctaaccagccatcacgttcgaattcagatagctcatccagtcagcaagttaaaaagccggaaaaggccgcctctgatcaggccaccatgaaaccctatgaggtgccgaattcagaaaagaataaccgacattatcaaaagtccggtctgctttcttttccaggtcagtttgcttatgacaaagtcggcacaaaattaatcttgtcccaaaacaaacacctagatcaacgagctacacggcaaggacttagctaccagattaccgatgctaaacgatttaataataacgccaaaacaaagcaagctctacaaatggctcagcaagccttcaacatcggtaatattcctaatccttatcaaaccctacagattaagtttaccgtaaaaaacgataccggccacgcggttaaaatcaatggcattcaaaagattagtttgaatgcctctcgaacaatttctgctaatggtattagtgatccaagtgccggacaaactatcaaatcaaatcatactcagactttttccgcaatgattttggttggaccaactaactttaaacttaatcagtttagcgtttatttctcaggcagttttaacgattcgggtcaacctataacaaaagcgccagcggttattaccgtgaaactataatttttaatgatatacacaactaaacaccgcatgctgacgtgaaaacgtctgcacacggtgttttgttattgcttttgagatgagtctgaatcagtcaattgctgaaccagtaaccgagtatagttacggttcccagttggattaggatgcacgttgtccgtgtagaaccaatccttgtgattcttactcaatccatgccaatcaactagcgtgacgttaggataacgtttagcagcattggcgatggttgtattgacagacgtttcccaattacgagtaggaacgtgagtgttaacccaatagatgcggcgattaggtccaatcatatgaataacctgatcaatttgactattagtcattggactgttagtccctaaattaacgaccacagtgttagccaaggctccctgagccttaagcgactcaatttgctttggggcttgccaaatttgacgacccacacccgctgaaacgtaggtgttaggaatcacttggcgaacgtctttagaaacatccaccatgacagaatcaccgattgcagtcaccgaaagatccttcgcctgcacgtattgacgcttagtcagaccatatgtcttaaccaattcctgctgatgagctgatagcttaacctttttccaggcttcctcacgctttttttcagcggcagcttttttagcagcttctcgttgcttctttaaagccgccttgttggaagaagccgcctgtttttgattatgcttaatattagtctgaagtgcagaatcattggcctctgaatgtgtggggcttgtaacagcaccaaacaatgcgacgcccgtaactaagatggctgggataaccgcataacgttgccaaccaaatgttttggggctccggaagaattgcttgattagtcctggcagttgaccatagtcataatgacgtaatggacgttccaaataacgatatgataaatcactagcaatcagaatcaaaacggtttccatcagcgcattaaacactggatgagccgcaatattagtcactttggcttcgtaaaaaatcataattggaaattgatacaagtaaatcccgtaacttcttgagccgacccagtcaaagatccggttggtaaacaactgattcataaaactggctggatgagccacggttgccaccaaaatggttgacaaaaacgtaaagaagaacatcccaccatgataggtcagacttgactgtcctgacatggtaaaaaacatgataagaaggattgccaaactgacaagcccagcaccgttcagtaaccacttagcgcgattattcaactcactctttaacttagttgcaggccaaacaaaagccaatgcaacaccaagtagaattgcaaacatccgggtatcagtaccatagtagacccggttagtcatggccgtaccagtatacaaataccccatccagattgctgacagaactgaaaggcctaaaacggaatagaaaatgggcttccggtctttaaacataaacagtagaatcactaaaatcagtggccaaaatgcgtaaaactgcccttcaatcgagagtgaccaaaggtgtgtaaacggtgactctccgttgaatcggtcaaagtatgactgtccatggccaatttcccaccagttatacacgtaaagtaagttagtactgataatggcctttaaactgacgaacaacgagcgctgaaacagcgtgatatacgctgcagttgtcaaaaccatcgtcactaatgctggatatagtcgtttcattcgccggacgtaaaaactgacgacatcgatccgaccgttttgctcatattcttgtagcaataaatcagtgattaaataacctgaaactacaaaaaatattggaacacctaaatagcctccctgcaagctataaggtaagaggtgatacacaataacaccaatcaccgcaatagtccggattccgtcgaacccagaaatatagcgactatgtttaagccgcttactccctgcgtgttgcatcgattctccctcgtttcatctcttagaattacttcaaaatgttattccacaaattcaaaggtaaagtcatcgatttggactaaatcgccgttacgagcacccttttctcgtaatgcatcatcgactcccatgccacgcaactgacgcgcaaagcgtagtgtgctttcttcatggtccatattggtcatctggaacaatcgctctaacttagcaccggtaagtacccatgtaccgtcctcgtcacgattaatttcaaagtcgtcagattcaaccgacccatcatccgttatcagcatcttttcaaggtcatcaacaccctttactgggaaagcaggtgtctggtctaaaatctcaacggttttctgaatcagcggtgttaacccatcgtgggtaacactggagattgccattacgactggcggtgttgcaagggttgtatcctccgccaatttggctttcaaagttgccaaattctcagctgaatcaggcaaatccatcttcgtagccacaacaatttgcggacgttttaacaaatctggatcatacttctgtaattcggcgttgatcttcaaaaagtcatcgtaaggatctcggtcttcaaatccactcacatcaatcaagtgaaggaggaccctggtccgttcaatgtgttttaagaactcaattccaagaccaacaccactagcagcgccttcaatcaaacccggtaaatcagcaaccgcaaaatcacggccatcactcaacttgaccatccctagattaggtgtcagcgtcgtaaagtgatattccccgattttgggttttgcactggtaatagctgctaataaggttgatttcccaacagaaggaaaaccaatcagccccacatcagctaataattttagttctaagcgaacccgacgctcttctccaggagcgccattttcagctaattcaggtgcaggattcttaggtgtcgcaaagtgaacgttaccgcgcccaccacggcctccttgggcaatgacaacctggtcatctgcgttaactaagtcagcaatcaccatgttggtttcatcatcgatgaccgtcgtcccttggggcactaaaatcacccgatcatcagcgccacggcctgtcatacctttaataccaccattttgaccatgatctgctttaaacttttgattataacgaaagtccatcaaagtacgaagccctgtattaactttaaatacaacactaccgcctcggccaccatcgccaccggctggtccaccgttgggctcatatttttcccgccgaaaagcaaccataccgttgccgccatttccggccttaacatttattgtaacgtgatctacaaacatattatttctccattattccaattcattcggactttcctaaccttgctattatctaatgaataaccttaaattaccaccgttttttagaacttttttaagtttgcgtttaacttgtctctgctgttttagctaaagtcagatgaatcgtatccgcaactgctttagaaataccgagttcgtgcaattcctcgggcgttgcagccgcgattttcttcattgagccaaactttcgcagtaatttattcctggttttggggcccactccttgaatatcgtccaaacgcgagctaagggagtttttagcatggacctttcgatgaaacgtaattgcaaaccggtgaacttcatcttgaatccgctgtaacaggtaaaagccctgtgacttaggatcaaggtgcaatggcgtatcgttaacttctgataataaatcggcagttttatgcttgtcgtttttaaccatcgcagccaccggaatagttagccccaattcgttttctaagacgtccttagcagcttctagctgaatagcaccgccatccattagaaccaagtcaggcatagtctcatgctccttaagcagccgggtatatcgacgccgaatgacttctcttgtactagcagcttcatcagcatgatccacggttctgagtttatattttcgatataagctcttattaggctgtccatcaacaaagaccaccatggcagagaccaaatcagctccttgaatatgcgaatgatcaaaggcttcaattttgtgtcctggcgcaattcccagggcatcagtgatttctttcattgcccccgtcgtcttttgttcatctaactccagcaaacggaacttttcttctagcactaagcgggcattttttcctgccatttcaagcagcgcccgcttttcaccacgttgcggtgttctcaccggcatcggcaacatctcttccaagacatccttcggcaaactttctggcacaaggatttcctttggaaaaacgctatttttacggtgataaaattggataataaaactggtcatttcttcaatctcatcgttcacaatcgggaacaaacgcttctcacgcttgatcaagcgtgcttgacgaatgaagaagacctgtacggatagccaacctttatccagataaaaattaaaaatgtcacggggtgtttgatcgttagaaatgattttttgcttttcgacagttacttcgatgtaatgcatctgatcacgaatttcagccgcccgttcaaactctaagttatcagaagcctttttcatctgagcgtttaaatgccgttttacagttgcaacattgccatttaaaaacgacttgatacgctcaatttgcttgtcatattgttctttcggtacttctttaaagcaggcacccaaacattgacccatgtggtaatacaagcaaggccggttctgatagccattgcaacgtcgcaacggataaaccttttgcaaaaaatgtagtgtctcctcagccgcgtaaacgttgggataaggaccgaaataataggcaccatccttacgaatggaactgacgatcagcatggtaggatcccgctcattggtaattttaatgtagggatacccagttccctgctttaacttaatattatagtggggctgatgtttttgaatcatcgtgatttcaagcaaaaaagcttctttatcagttgacgtcacaatggtctcaaagtcagcaatttctgagactaagcgagccgttttcccttcatggctactcttaaaataggaacgtacccggttttttaagtttttagctttaccgacgtaaatgatgtgcccgttaatgtttttcatcatataaataccgggcatatcaggcaaaagtgctaatttatgttctagatattcggtggccaaagaaatgacctccttccgcttcattctctggggtaccgctatctcaagcttccccagtttcgacgtttcattataaccccgaataagtgtttggggcaagctacctgcctatgttgacttacttgtcatttaaacacatcataataaaacaccatgattcgaaatcgaatcatggtgttttatgaataacaatgttaattaactgttaataatcttactgatgaagtcctttgtccgtggattctgtggatgttcaaacatttcgtttggtttgttcttttccagaatataaccgtcagccatgaaccagacctcgttagcaacttctctagcaaagcccatttcatgagtgacaacaaccatcgtcatcccatcttcggctagttccttcataacggcaagtacttcgccgaccatttcaggatccaaagcactggttggttcgtcaaacagtagcatttcaggatccatggctaaggctctggcaatggctacacgttgtgcttgaccacctgatagactgtttggataaacgttggctttttcttccaagccaacccgtttaagcaaacccatcgccttttcttcggcatccttatccgacatctttttaactcgaattggtgctaattttaagttatcaagcaccgtcaaattaggaaacaagttgaagctttgaaaaaccatgcccattcgttcacgtaatgtggtcaattcttcttccgaaaacttctgggtatctttgccctcaaacaaaacttgtccagccgttggggtctccaacatattcaagcaacgtaagaacgtgctttttccggaacctgaagggccgatgacacaaatcacttgaccaggcataactgttccgtcaatttcttttaggacttcggtatcaccatagtttttttgaagctttttaacttcaactaacggtttatcttgcatgtttcattctcccctcgaagtagtttagaattctcgtcaaaatgaacgtcatcacgaagtaaatgcacattgcgacgaacacaggcataacaccacgatacgtatcggcacgcacaatgtttaactggtaaatcaaatcggtaacaccaatgatggaaacaattgaactttccttaaccagtgagacaaattcattaccaagtgctggccaaatgttcttcagtgcttgaggcaagatgatgaaccgcatggtatcacccttggctaaccccagactagcagaagcttccgtttgtcctttatcaaccgagttaataccaccacgaataatttcctcaacataagcaccactgttcaatgaaacggcaatgatacctgataataatgctggcaaattaacaatgattccaacaccgaagtacacgaacatgacttgaaccatcaatggcgtcccacgaacaaattcgacgtatgccactgaaattgccttaagtaccttgctcttactaaaccgcatcaaagctaagattgtgcctaacaaaaccccaaagataactgaaatggctgagattaataacgtgtattcaatcccttttgcaaaataagtccagtaatgaaccattgaagtgttattagtgttaactttcatatacttccctgcgctagccaggtattgcgtggtcagatgttttgccttgatcttatcaatactcttgttgacggctgcggctaaagtaccagaaccctttttaaaggccatggcagaaccagtttcgttcttattcaacttataaccagatttgatcattgctaaatcatggtcattcttgacataagcttcggctgaaggtgtttcaataccaagtgcatcgatcttgtgagtctttaacgccagcaccaaatcggtgttcttgtccattcctttaaccgttgccccaggaatcttagttttggctaagttatattgcaacgtccctgtctgagcaccgatcttcttatgagctaatgcggctttatccttatacttgcccacatcggtcttattgatcaagaaactttgaccaccattataataaatctttgagaaatcaacactttggcgacgcttagcggttgggttgataccactcatagccacgtcagctttaccagtttcgacggctaccaaaacggaatcgtatgacatggacttaatcactaacttaacgcccaagtctttggcgacttgtctcatgatgtcaacatccatcccaacaacttgggatttaccattcttgctgacctggaattcgtacggcgggtaatctggcgaagtcgccatgatgatgctaccccgatccttaatcttctgaagcgaatcatccgcagcatacgcggtatggtgcgctggctgaactgtaaataaaaataataatgacaaacacaacgtcatgatggtgagtaatacgtttctccccttgactttcattcgcggtaactccctctcttaatttaagtaacttcaacactacaccaaaataagtctttatgcaataaaaattacgaaaaagtctaatttatacacgaaaaagcaatattatgtttaatatgcacttttatatacattattcacatggaaagtggatacgattacggtacaaaaatttagcgaccagctgttgactaatgatcccctttaatgcccaccaactcaccatttttcaacttacttgcattctcaccattagccatgataaactaggcccaatgaaggagttgaccacatcatgggattaaaagtgaaacgtcagaacaatctcgatgcaatgtttggtaagtttgccgaggttgatttaaaggacgaaaagcgcgacaaatttttaaaacacgatgaacaaaaagatgacactaaaaaggccaaagctttaatcaaagaacatcgcagttaccataaataaaaaaacgacacccagtgggtgccgtttttttatgcctcgagttcttttttagcctgttcaatttgtttacgaacctgatcaaagcccgtgccaccttcagaatgccgacgttcaacagcaacttccgacttcaaatcgttatatacatcttcttcaattttaggtgacgccttcttgagctcctctaatgacatatcctgtaagttttgatgcgtttggatacccttcaaaactaactgccccacaatgccatgcgcctctctaaatggcacacccttagtggccaaataatcagctaattcagtagcgtttgagaaatcattttccgtagcggctttcatattatccgccttaacggttaccgttgagagcatgccattgaagactcgcaatgctggcaacaaggttttaaccgtatcgaagaccccctctttgtcctcttgcagatccttgttgtaggctaacggtagtgacttcattgtcgccaacaatcccatcaagtgaccataaactcggccactcttaccacgaatcagttctgccatatccggattctttttctgtggcatgattgaactaccagttgtataagcatcagatagttctaggtactggaattcatgactgacccacatactaagttcttcacagaaccgggataaatgcatcattaaaatcgaactgttactgagaaattccaacgcaaaatcacgatccgacacagcatctagcgagttagcataaacttggctgaatcccaacgttttggccgtcatctgacgatcgatgggaaaagtggtcccagctaaggctgctgcacccagtggtgaaatatccgtatgcacttcattaaacgtaaaccgttccttgtcacgcttaaacatttggtaataggccatcagataatgaccgtatgagatcggctgagcgtgctgtaaatgcgtatagcctggcatgatggtttcaacgttcttttctgccaaactgatcagcgttttttgcacggtagtaatttcatcaatcaccttaggtaaccgtttcttcaaataaaggtgaaaatcggtagcgacttgatcattacgtgacctagccgtatgcaatttaccagccaccggaccaattctgtccgttaaaatactttcaatattcatatgaatatcttcgttttcaacgctaaaggtcagttttccagcttcaagatccgtttggattccttctaaaccggcaataatttgatcgcagtcatcagaaggaacaatacccgttttttgaagcattttgacgtgggctaaagaaccttcaatatcttcttcagccatgagttgatcaaaggaaatggaagccccaaaagcatcgacccatgcagccgcctgttcttggaaccggccaccccagagctttttggttgccattactttgtcgcctccgtttgatgcttcttttctgccttaacagccacttttaccttgctcttagtgttttgagtgactgcattaacaaatgcagactgctgattcttcatcttcacttgtgagtaaacggttgttggtaggccccataacttgatgaagcccttggcagcttcttgatcaaatgaatctgaagcggtataagttgccaaattcttgtcatacaatgaactgtctgacttccgacctaaagtgatgacgttgcccttaaacaattcaactttaatcacaccgctaacaacttcttggctcttcttcaagaaggcaagcagagcatccatcaatggtgagaaccagagggcgttgtaaatcatttcgcttaattgcttttcaataacaggcttgaaatgagctaagtcccgttcaaaagtcaaatcttccaactgcttgtgtgccttcatcaaaactgtagcagcaggtgcttcgtagacttcacgagacttgatgccgactaaccggttttcaatgtggtcgatccggccaacgccatgttcaccagcaattttgttaagtttctgaatcaaatcagctaactgcattgctttaccgtttaatttagttggcacaccttttacaaaggtaatctcaatatccgttggagtatcaggtgtcttgtcgatcgggttagtcaaagcataggcatcttcaggtgcactagcccatgggtcttccagcacgccggcttcattggcacgaccccaaatattagcatcgattgaatatggtgagtctaaatcaattggaatcggaatgttgtgcttcttagcataatcaatttcttcttcccgtgaccagtgccagtcccgaactgggcttaatacttcgagtcctgggttcaatgcatggatagcaacttcaaaccggacttggtcattacctttaccggtacagccatgtgcaactgcctgagcattttcttcttgcgcaacttcgaccagttttttactgatcaatggccgtgatagcgctgaaatcaatgggtattcgccctcgtagtacgtattaccctgtaaggcaaccattgcgtagtcttctgcgaattcttcaagcgcatcgatcacgtaaactttaacggcgccaacattgagtgctttttgcttaataaagtctaaatctttaccttcacccacgttaatgcagcaagcaatcacatcatagcccttatcctttaaccagggaattgctactgaagtatccaaaccgccagaatatgctaatacaactttcttatttttcgtcatgttaaacgccctctcattttttcattttaacttaatgatacgagattaacacctgtattcagttaatgcaagtgttttttgttatttatacacaaaaaaggccaatattacatttaatatacatatttttgaaataaaatgggtctaggatttcatgtaaccgttttcaaaaacaatggcatcaaaaaagttcgaccatcagtaatcaatcaactgatattcgaacttttctttatttattaagcaaaaaagctattactgattattgtgtgaagccggataacgtttatttaaacgttcaatattgccactagcaacttcttcaaagggaatatctgcccactctgctacctgagataaataccagagaacatcgcccatttcctttaccaactgctttttgtccagagattcaccctgaaaagtatactgcttaaccaagtcgacaacttgaccggtttcgctggaaagtcctagagcacaattagtcaaaacctgttcactgccaaaaagggtccggttggcagccttttgatagtcattaaattccattatgattttcccccaaacgcatgctgttcgatccattgccacacttcatctttaccagccttagtttgcgcagaaaatggcaataagtcatcttcagcacggatctgtaacgtctttttgactaaactcagctgtttattccactttgcccctgagatcttatccatcttagttgccaccaccagggttggaatttcgtagtaactgagccagttatacatcgtttgatcgtcactagtgggcgcatgtcgaccatctaccaatgaaacaacacctcgcaatgtatctctcgaagtgaggtaggtctcaatcatttcgccccatttttcacgttctgatcgagacactttagcatacccatagccgggtacgtcaacaaaatagagtgaatcctccacgtgataaaaatttaacgtctgcgttttcccaggttgacttgacgttctggcataactatttcgattgatcaaaacattcgtcaaagatgatttaccgacgtttgagcgaccaaccaacgcaatttctggttgtcctgttttgggatattgtttgggatcaaccgcactcatcaccagttcaacattgtgtacttccatgattttcctccgtccaactcttagctaaataaaagccgtatgccccataacacggaacatacggcttaaaatgtcagctgacattagtttcgaatcatcgactatgaagccttttgatcctttaaaattagctcgggttcctgatgatctttaacagtatcaccggttacaataaccttggcgacatcatctcggcttggtaattcaaacataatatctcgcatgacgtcttcaataattgatcgaaggccacgtgcaccggtattacgcttcaatgccaatcgagccatttctcgtaaagcttgatcttcgaaatcgagttcaacaccatccagtgaaatcagtcgttgatactgcttcactaaggcattcttaggttcagttagaattcgaaccaaatcatcttcagagagtttctctaaggcagtcaaaattggtaaacgcccaataaattcgggaatcaaaccaaattctagcatatcttcaggaacaacacgctgcattaagctttctgatttatcaattggttgatgagttgaatctgcaccgaaaccaatcgtcttatcgccaagacggtttttgacaatcgtttcgataccatcaaaagcaccacccacgataaatagaatattagtcgtgtcaatttgaataaattcttgttgaggatgcttacgaccaccctgaggtggaacgttggcaattgtcccttcaagaatcttcaatagggcttgttggacaccttcaccagaaacatcccgtgtaatcgagacattttcagcctttttggcaattttatcaatttcatcaatgtagataatccctttttcagcacgttcaacgtcataatcggcattttgcagcagcttcaaaagaatattttctacgtcttcgccgacataccctgcttcagttagtgtcgttgcatcggcaattgcaaatggcacattcaagatttttgccaaagtttgtgccaggtaagttttacccgacccagtaggtccaatcatcgtgatgttactcttttgcaattcaggaccatcatttttgttagtggccatttcattaacacgcttatagtgattataaacagcaactgaaagcgtctttttagcttcagtttgaccaataacgtactgatttaaagaatctacaatttgttgtggagttggcacatcaaaaacagtttgtgagctttcctcactaaattcttcatcaatgatttctttacataaatcgatacattcattgcagatatacacgccgggaccagcaacaatttttttaacctgatcctgcgacttgccacagaaagaacaatttacggggttggttgtatcagtattttcaaacaattaagagtcacccctctttaaattctacgattatcttattctttaacgcaactgctactataccatacaaatataggcgtgggaaaggaaaagctcaaatgaagacagcgtacacgcttggtacaacaccttttcacgcaaagaaatgttgctcgcttaagttttttctaaacttcattcctatatacgcaaacaaaggccctaacaagaatcaaatattctcgtccttagggcctttgtgagcagtgctaacgttaaaaactatttttcgttttcttcgtcttttttagacttgtcttgcttggctgaatcagtgatcaaatcaacagccttcttgatggcaatatcgtgcttcaacatgtcatctgaaagtgctgaacgaacagcgctttcttccataccatattggccagctaaatctttaacttctgcattcaaatcatcttcagaaggttcgattttttctgcttcaacaatggcttcaagaaccaagttggtcttaacacgacgttctgcatcagcagcaaactgcttgtgcagatcatcttcgctagtaccagtcagtttgaagtaagtcttaggatcgataccttgttgttgcatgttagctaagtattggtccatctgacggtgaatgtcgtcttccttcattgcttcaggaatctctttgacttcagcgttgtcaacggcttcactgattgcttcgtcttcgatagcatcatgtgcagctgtaactttcttttccttcaattcgtctttgatcttagcctttaattcgtctaagctatcaacttcttcgtcaacatccttggcaaattcatcgtcaagttcaggtaattccttttgcttaacttcatgaatagtggtcttgaatgtggcttctttaccttgcaagttttcagcttggtaatcatctgggaaggtgaccttaacatcaacatcttcgccagccttgtgaccaactaattggtcttcaaaacctgggataaatgagttagaacccaattctagtgaatagttatcagcttttccaccatcgaattgcttgccatcaacgtaaccatcaaagtcgattacaacagtatcgcctttagcagctggttcgtcttctttcaaaactaattcagcttgtgattgacgacggctctctaattcagcatcaatgtctttttggtagacacgagtgttttgttttgtaacgcttaagtctttgtattcacccagtttaacgtcaggcttaacggtaacaacagccttcaaaacccatggttggttcttttccatagattcaacattaacttctggttgatcaactggttcgatacctgcttctttgattgctgcctcatatgcatcaggcaaaacaatgtttaaagcatcttgataaagagcttcttcaccatacatcttgttgaagatttggcgtggaacctttcctttacggaagccaggaacagctaaattcttcttggtttttgcgaaagcttggtctaagccctttttgatttggtcggcatcaatttcaaaggttaattcgcctttgttgccgtcctttttttcccattttgcagacattatattccctccgaattaaatatatcttcgaatacgatcatattcaaattgcgtacaaactttagtttaacgtaaggaagctgaaaagtaaacattagagtgcattgcaacgcatggaagacacgttttttcatcaattaatttaattttgaaacaaatatgagacttgttagacccttattcattcaaataaaaaagtccgaaaagttaaccttctcggactttttatgttcatttaggtaggtattagtccatgatatctgaaacaacaccggcaccaacagtgtggccaccttcacgaacagtaaacttagtacccttttcaatggcagctggggcaatcaagtcaacttcgaaagtgacgttatcgccaggcataaccatttctacgccatcaggcaattcgataacaccagtgatatcagtggtgtggaagtagaattgtggacggtagtttgagaagaatggcgtatgacggccaccttcttctttagaaaggatataaacttcacccttgaacttactgtgagtttggatcgaacctggctttgcaagaacttggccacgaacaacttgttcacggttaataccacgaagcaagacaccaacgttatcgccggcttcaccaaattccaaagtcttacggaacatttccagaccagtaacagtactcttaagaacttcttccttaagaccaacgatttcaacttcatcgccgaccttgatagtaccacgatcgatacgaccagaagcaacagtaccacgaccagtgatggtgaagacgtcttcaacaggcatcaagaaaggcttgtcgttgtcacgaactggagttgggatgtattcatcgacaacgtccattaagtgttcgataaccttttgttgttcttcatcaccttggagtgctttaagagcagaaccgcggataactggaatatcatcaccagggtaatcgtattctgaaagtaattcacggacttccatttcaactaagtcgatcaattcatcatcgtcaactaagtcggtcttgtttaagaagaccacgatgtattcaacaccaacttggcgagccaaaaggatatgttcacgagtttgtggcattggaccatcggttgcggcaacaactaagatagcaccatccatttgagcggcaccagtgatcatgttcttgatgtaatcagcatgtcctggggcgtcaatatgagcatagtgacgtttctcagtttcgtattcaacgtgggcagtgttgatcgtgataccacgttcacgttcttcaggtgccttgtcgatatcagcgtaatcttcttccttagctaaccctttttgagctaaaaccttggtgatcgctgcggtcaaggtagtcttcccatggtcaatatggccaatagtaccaatgtttacatggggcttagttcgttcgtatgtttcttttgccattaatgaaacctcctgtatttttcacaaagattatgccaacaagcaagttgttggcaaccctttgctgtaaattatactacatcttctcgaaaaggtaaatcgagaatccctcaagaagaatccttaaatattatatagattaggttatcgtttgtaaacaataaacgctaaattcaatggaacttttttaagcacctgtcatctctgacataatttgtgacagttttcgctgccaccattcaagactatatgctactggtaacgttgctgactgtacttgatctcccttgattaggcgagttacccaagctctaggatccggaatagcccgatcaataaagggatataaaagtgtgacttgcaaacccagctcattttgatacaactgctgagtgacaggatcatggtcatcaatcatttctcgcagcacgttttctagtataccaactttttcaaactccgccagtgattttaactgattcccgacaatttcataatttttattatctaaccagcgaaattcaaagtgttctggcaatttaagcttttgcaccatttccaataagctaactcgaatgatcggcttaacaaatggatcaatcagtaagacctttgtcgctgttacccactcatcaaggggtaactccttgcccttttcaaatgcacgctgttgttgattaaacgtcagtgcactcaattgatagaacgtttgatagtcttttttaaaatttggttcctgacgcgcattagcttcggcttgttgaattaatcgggtgacctgtgcaggtacccgcggcaaagtagctgttagaacatgcgacattaacagttgccgattagccaataatacctccaccatcagtatcacatgctgttcatccattaagtaactatttaagttatccatcattatggtataagccatcttgtattgatggtcttcaaataggctctttaccagcaaatggttgattttttcacttggtgcagactgatactcttgttcatacagttgagccgcctgcgcccacttctgagctttaaacgcttcattcgctagttgtaagtttcgatccacgcttttcaccttcattgaattaatccactaaacgaaaatctcgtacgttgatagacaaacatacgagatttaaacgccttatttttcagcttgatgattcttttgcgtagcctgttttttgtgcttactcttcggtttatgacgccgaggatcgacttccatgataaccggtaaaatgaccgggtgacgccgagtttggtcaaacagatagtggttcagcttttcacggacatcttgcttcaaatgtgtccagtcgaactccttgttatctaaattagtctgcaccgcttttttaatgatctccgcactttcatgcatcagatccttgttcgctttaacgtatacaaaaccacgggaagtaatcttgggttcgccaatgatttgcttctttttatgatcaatggtaatcacagcaacaaagataccgtcttcagagagcaccttgcgatcacgcaacacaatgttaccaatatcaccaacaccaatgccatcaatcatggtattaccgacttcaacgctaccactcagcaccatgtctttgccatcgtagaccaattgatcacccttagcagtcataaagatttggtctgaagtcataccaacttcttcagcagctctttgatgtgctgacatcaaccgatattcaccctgaattggcactaagtacttagggtgaagaatattaatcagcagttgaagatcatgcttgctagcgtgtcccgatgaatttagatcatccgaaattgctttaacttcaccaccggcacgatagatcatatcgcgggttttagcaacgttagtttccatagcatgggaaggcgttgtggtaatgaaaaccaagtcaccctcttcaatactaagccccttctcctgcttgtttgccatccgctggagagctttaattggttcgcccatcttaccggtttgaatgatgacgatttgatcagctggcagtttttcaagctggtcttcagaaacgagcaaatcatcttgtggcaaaaccagcttgtttaaccgcattgcggtatcaacgatcttctcaatgtctcggccagtcaaataaactttgcgtcctgtcttagcagcagcatcaaaaacttgttgaagccgcaaaatatttgaaccaacacttgcaactatgattcgactcttagcatagttaaacgtttcgaccacgttttcagcaatatcaagttcactagccgtttcgctaggattttcagcattagctgaatcgctcaataaagcaagtacaccgttagtaccaatttgagccaaacgcgcgtagtctgtctgatagccagatgcggccgtttgatcaaacttgaaatcaccagtgtaaacaacactgccagcactagtatttagcacgattcccatagattcgggaattgaatgtgtggttttaaagaacgaaacggtgacatcgccaaaatcaatctcagtttgagcatctaccacgtggaaatcatcaaagtctttcacgttaggatcagattgacagtttaatttagccaactcaatggtcatttcagacccaaaaactggcactttaaattcttttaagaaataaggcagtgcgccaatagcatcagcatgcccatgagtcaaaaacaccccaacgattcgatcctggttttcacgcaaatagccgaaatcaggaatcacaatatcaatcccgagtaactcgttttccggatacttcaaaccacagtctaaaacgtaaatactgtcattaacatctacaatatacatgttcttgccattttcgcgaacaccgcctaatggcataatctttacttttgctttgtccataattcacctcaaaatatgttgttctggttccgctaaatcgccaattataaaaccctattaacgatcatgaacgcttatttttcctaaattctaaaaatttaggcacgactacaaactgtttacagtttatcacacttaattcaactatgtaacattccaagctagtacgagtaaaaaagtcattgatataacaaaaaaagccccccaaaaacggagagctccaaataatcaaaattaacgacgtagacccaatgattggattaagtcacggtaacgttgaatatcagtcttacgtaagtaagctaacaagttacgacgatgaccaatcttcttcatcaaaccacgttgtgaatggaagtccttcttgtgaaccttcatatggttgttcaattcgttaatgtctgctgttaaaacagcgatttgaacttctgctgaaccagtgtcgccatcgtgacgagcatactgcttcataatttcggttttcttttcttgtgtaatagccatgaaaaaatttcccacctttaatttatttgtccacccgttactgagttgccgtgagtgagatcgcagtcaactaagtaagggcaatttaagaacctttgctattatatccgttatcgcacagaataacaaggctttgtcttaaacagcttatcaagtacttttactttacaattaatggcgaactgttgcaatcgttgattttattctgtataatgacattcgttgaatattacagagccatctggcttatgagtgtggaggtgaattcattgccaattatcaaatctgcgatcgaacgtgcaaaaacgaacgttaaagctaacgaacgtaattctgcacagcttagcagtatgcgaacagccgttaagaagtttgaaaaagctgttacgaaccacgacgataacgcagctgagttatacaaagctgcttctagcgccgttgaccgtgctgcttcaaagggtttaatcaaaactaacaaagcttcccgcgacaagtcacgtatggctgctcgtttagctaaagcaaacgcctaaattaaaccaaatattaaaggatcagttcaattgcgaactgatcctttttttgttttttaagcaacttcatccagatactttaacataaagagttcgaaaagcatcatcgggtcttgactggtggacttcaaagaccgttcgatttgaatcaaacccagataagcctgacgaagatgtgctaattctaagcgtcggacactctgcatggccaatttaacccggtatggatggacctttaacgccgaggcaatactgccctgactataaccgttacgcattaaaattttcgtttgaatcagtaatctaaactgactgactaacaccgcattgattcgcaacggttcttccttcgtcaaaatcagttgacgatacaggttcagtgctgcttcaatccgttttcccatcacatcgttaaccaaatcaaaaacattttgatccagcgactttgaaactagttctccaactaccgttttatcgatttgtttggattccgctgaagctaatttcaacttcgataattcgttcataatcaacgataggtctgttccggtacgctgaagtaacaagttaagtgcatccggttcaatggcaaaatgatcttgttcaagattatgctggactaacgtgcgaacctgcctttcacccaccgcttctaaactaataacttccgcggcctttttaatgatcttaaccacttttttacggctatctagcttgccattagtcgcaaaaaataccacaacagacgttggttcagggtgttctaaatatttgatcaatccatcaatatcgtgatcgatcttattaccccgatgattttccgtagtcaaaaaataagcacgttcaacaaataccagccgcttttcgccaaaaaacggggctgacatagcgtcatctaaagcctgtgcaagcggtgttgattccatatcataggtggcgtaattcattgtacgctcagattctggaattaggtttaagaaagaccgctttattcgctgcgtcaaataaggttgatcacccgtaatgaggtataccggttttgaggttcccttattgagctgtgccattaccgtttcgtaattcaaaataatttctcctttaaaaaggtctgccaacgacccgtagcatgattagtatatcgatagcggatcataccgttaacctgagtattaaacgcaggtacatgattagctgccagagtggccaacgtctcttgattaggatgaccataacgattattccggcccgcagaaatgatgccgatttttacctgaagctgtttaacgacttctggattcgtcgatgttttactgccatgatgtcctaattttaacacgtctgtccgtaaagccggatagtggtttaaaatctcgcgctcacctgcttgatccaaatcgccggtgaacaaccaccgtaaaccacccatttggccagttaaaaccattgaatcctcattagttcctagtcctggtttaaacggatgaaccacgttgagcggtgtcccaataatctgctgaccagcctgaaccggcacaatttgagtgtgctgaatatacggctggatacgtttcataaattgcgggttttgggtcattcctaatggcacgtacaaccgtttaacatggacaccctgaagcacatcgcccacgtcgcctacgtggtccgcgtcctgatgtgacagacacagattatcaatatgggagatgccctgactctttaaataattgatactaatccgctgggctcgactgcgaccggtgatttttttacccccaaaattgacccggccacccgtatcaatcatggtaatctgccgattatatggtgaacggactaaaaagctgtccccttgcccaatatcaaaaaaagtcacttctccgaacgttggaaaatgaatcactaaaaaacaggcaagatatgccgcacccagtatcacccataaccgccgtttaaagcgctgcgacatcactaacagcgttaaaatcgtcaagaggcccacgacccaagctgttggcttaccaaatacaatcatacctggtaagctatcaatcatattcaacccattggtgaaaagctgcaacagccattccgttacgtcagctaaccaaggtatcatctgaccgccaattcctgccaccaacaccagcggaaaaatacagacgctaaagattggtaaaataagtaaattaacaaacatcgttaacacgtgccactggtaaatgtgatacaaaatcagcggtaagctcaataaatttaacatcatcgtggttttcaacacgccaaattgcttggtaaataaaaggccaaacgccaaaccatagctcaattgaccgcctaaatgcatcaataaagctggctgaaccaataaacctaacaggagactaattccccacgtagataaacctgtgagtcgccacccgcaaagctccgctaacagccccaaaacgaccactacaaccgcacgtaaaagtcctacctgagaaccagcaaggatgtagtaagtcggcagcagtagcagtaaaaacgctgaaattggcatttgggtgaaccccaagcgccgcagaatccaacttacgacagccacgatccaaacgatgtgaaaaccagaaatactgaataaatggatcaagcctaaatccgttaccgcacttagcgagtcgtaaaaatcagttgcccgccagcctaaaaataacccctgaacatacagctgaagcgtgcgaggcaacgtttgggtgtaattaactaatcgtgcacgtaatatatgacaggcattgatccaccacactattggattggtcgctggagaagccatcacaggcgtcaaccgatcaattttaatggtattaaaaattccttgatcggcttgatactggcgaaaatcaaattcattggcgttagtcgctggttgaggacgtgaaatatcaccgtggaccagcatggtggtcgattttttaatttgcaaactttgaagcagtctttgatcatccgaaaaatactgtccctggattgttttcccgtcacttgttcggccacttaactgcagccgaccctcttcaacccgtaattcatctggttgaaccgtcagctccactgaggcaccagtttgatctggcaacgtacgcgcctgttctaaacgctgcgtccgccaaaataagccactaaaaatcaacagcactaatgcagtccaaactaaaagctgtcgatcacgtaaacagattatccggatcacccaaataagtgtcaaaattaccgacagccaaaccaagccaaagaaacagccacttaaacagccagctagaattgctaaccaaataatattatgattgatgatcctgcagataggcatcaactgaagcacgttcaattgcttcggaatcaagggtcacctgatgtaactcgacacccttcatcttaattaacgacatggcatatgggtcattatggtagttatgcaagtatgaaatcttactaatgccagcctgtaaaagcatcttggtacactgtagacaaggaaaatctgtcacatagatttcagcaccatcagtggcttcaccaaacttcgcacactgtaaaatggcgttcatttcagcgtgaatcgtccgtaaacagtggccatcaactaggtagcaaccctcatcagtacagtgaacatcaccagaaactgaaccattgtatccaccagcaatgatgcgacgatcacgaacgattgttgcacctaccgaaagccggttacaggtactccgactcgctagtaacactgactgcatcataaaatattgatcccaaggaattcttttattagccataacggccgcctccatcatctcattatctggttaagtataccaaattttattagaacatgataacgctaaaccgtaatttgaggctttagtcgttctaatgttttgtcgccgaagccgttgacgttttttaactcatcagctgatttgaaaccgccatgttcttgtcgataagctagtatcttttccgcttttttctcaccgacaccatctaattgctgcagtcctgctaagtcagcagtgttcaaattgacttgtggcgtctcactttctgagctggcaccaccacctgctgccgatgaccccgctacagatgttggcaccttctcaccgcgttttggaatataaacaacttgagaatccgtcaatttttgtgccaagttaacctgtttttcatccgcattactagcaaaaccaccagccaactgaacggcgtcaataacacgcatcgttgactccacctttttcatcccaggttgcttaaccgcacccttaacgtccacgtacatcgttgtgttgacaccggtttgactcgttgctgtcacagaactggataacgaagccatccccgaatcagacatcaacgattgtgaagtaaattctggctgtgcgttagaaactggtcggttgcccaatagtaaaaagctaacagcaatgatggtcgatagacttaaaccaataatgatccaagtctgacggttactattttctagcagttcctttaacctatccacttttctccctcctttctctctaaacataactacggctaaaaaccaaaaggggttgtgccataagtctatattggtaagtatttcaatccattttttagtaaagatgagtgaggcctatcctttggttcaatgcgtcaatattgcctaatcatgcgccaaaattcagattcttaccatttaacgcaaataacccccatcccgacaaagtaccgtcggaatgggggttattcacgttaaattctagaatataccgagttttgtcacacactcgctaatgatgcgtattcaaatattgcacagcttggttgaaggttgaaactggcaccactttcatatgaggtgcgactttcttcgccgtctttttagctagctgataattagtcacatgtcctggttccaactgcaaaacagccttagttggtttcaaatacggtgcaaagaagatggttgcacctgctttcttagcagcaacgatctttttatcgataccaccaatttcgccaactgttccgtctggattaatggttccagtacccgcaatattttgcccgtgccggatgttttgaccagtcaactgaccatagatctgtaaactgaacattagtccaccagagggtccaccaatttgtccaggatccactttcacttcgggatcagttttaattttaacgttatcagtcaaaataatcccaattcccgtcttaccgctagaaagtttaattaacggtgcgctggccgttttcagtttaccatcatgttggtactgaacccgtagacgatcaccaaccgactttttcgcaatgtatttttgaaaaccatacgcattttcaaaatgatgaccatcaaccttggtaatcgtatcacctactgcaagttgatgcttaaaccgggaatttttctgaacatccatgacgtaaatgcccaggtagtttttggtgacttttttatgtgctgccttgaccgcaaccgctttagcttcgttgatggcactctgcatgtaaaaattctgcatttttacatatgtatcgttactttgaccaccagtaacactctgttcactctcaattgtggaatacggtgacacctttgccatcaagtatgtaactggccgcgcctgcgccaatttaaccgaggtaatcataaactttcccggacgtttatcagggtgatttttaattttaacaaacgtttttagattatcagccgatccaggagattcgatatactttggcatgggccaaaagaaaccaatcagaatcaggattgctaaaacaatgctgataccatactgaagaacctttttacgagtctgttttttcatactattctgacctttgtttttgatttaaagcttgagcaaccgctggcggaacaagttcggagatgtcacccttaaaatgaagtacctctttcaataaagaagaagaaatgaagctatacttcggatccgttacgagaaaaatcgattcaattgaatcatccaaataatggttcatatttgcgatgtccgactcatacgacaaatctcttaggtcacggagaccgcgaacaatcacactggcgcccacttttttaacaaattgaaccgttaggccatcttccgcttgaaccgttacgttgggcagatgagcaatactttgttgaattaaagctacccgttcctcaggagtgaataacatgcttttactaatgttgattcccaccgttacaatcacctgatcaaacagcttacttgcgcgttcaataatatttaagtggcctaaggtaagcggatcaaagctacccggataaactgcaattgtcattgattatcaccttcctgataacggtataccgtaatttttgtaatgccataggacttttcaacgattcgtgtgcaagcaccgatctcagctggcaaatcagcttcctgattcgtttcgcacatgattcggcagtctgaattcactaactgactggcaatcagctcttgaatttctttaacaattttttgctcacgataaggtggatcaaaataaatcagatcaaaactttgattctgtgcctgaagctgttttaaagcaatttctgcatcccgtttaatgaccgtaaatttatctggttctttagtaacttcaatattttgattaatggttttgatggcagcaccttggcgatcaatcaacacagcatggtcgattccccgagacacgccctcaatactcaaaccgcccgaacccgcgaaaaggtccaaactttgaccaccatcaaaataaggtccaagaatgttgaatacggcttctttcaccttatccgtagtaggtcgggttttcatcccagggactgctcttagtctccgaccaccgtactctccggcaacaacacgcattactcatcctcctcaaaatttacttgatcttcctctgcttcaggttcatcagataaacctaataaatccattaattcatttcgaggagactcaatgattcgtttaacaaaccgcaattgtttcagacgaccaatggtttccttcgcttcgtcctcgttaacatagataatggcataccgcatccgcttagaaacatattcaaggtgaccgtagcgcttaagctgccgaacttgacgtaagcttgacacatagacgactaaattggttcgagattgaatgtccattatgttaaccccctctttctgcgctcttgcgcacttatatttaaaataattcctaacgatattgtcagtgaaaagatacttgaccccccataactaataaacgggaaggtcacaccagtaattggcagccaaccaaccacaccaccaacattgataaaggcttggacggcaaaatacgtcgccacaccatagcaaaccagcgtattaaatggatcagtagccctaatgccaattcggatggtctgccaaataataatgcctagtagaatcaaaatgataacaaccccaatgaggccgagttcttcgcccgtaatcgccataataaagtcggtgttcggttcaggtaaatagccacgtttttgaattgaattacccagcccaacaccgaataagccaccattactcaaggcatagtacgaattaaccagttgctggccggagccgttagcatgaccaaacggatcgacgaaggcaactagccgcgctaatttataagacttaatggtccctgattccgaaagctttaaggcaatgggaaaaacaataaaagcgataaaagcgacagccataccaaaatataaataactttttttaaatgaaaaaccgctgctcaaacacatcataaaaacaatcgcggaaatgatcactgcactccccatgtcgggttgaatgaggactaaaccaatcatggcagcacacattgtaataggcagccacataccttgccaccaatggccactgacaatatcttccatctgagcaggcatggttgctgttttagccattaaaagaatcaacgtaattttaactaactcggcgggttggacactaatcggcccaatcctaaaccagccagctgccccattgacagttttaccaatgactaacagcgccagtaaagcaagaatcaatacaatatacaagataataagaaagattccgtttttgaaaaaatcatgcggtatcattagcataaacagggcaataaaaagaccgataatcacaaaaaccaattgtttaaaaaggtaactgataggtgtcgaacccatttgtacagccacgtttgaactcgctgaataaaccatcaccacaccgattccacatagaatcaagtaaggtataaataaccaataatccaaatcttttaatttcttgacatcgaaggcatttctaatttttgaaaccttcaattttcgcaaattctgcatctaaaaaatccccaaactactccactaaatttcttaaataaactcacttgattatagcatattggccggttttgatgtaaaaccgtggaaaacctttaacattttaccagctaattatgcagaaataagtttgtgatttataccggttcaggctcactttcacattgtcaaaggactcttcaggaaaataaactaaaacgcaacaaaaaatcccctcgcagacagcaaaataaaaataattttttcatttgccatccacaagaggatctttaaattggtataaatttaccaacgatatttaaatttagttatgacgagcccgcttagcagccttttcacgttcgttagtgttcagaatttgcttccggagacggacgtagttaggggtaacttcacagtattcatcgttgttcaaaaattcaagtgattcttcaagtgataaatgagtaggtgtcttgatacgagccatgtcatcggaaccggcggcacggacgttggtcaagttcttaccctttgtgatgttaacagtaatatcgttttcacggctgttttcaccaacgatcataccttcataaacatcagtacctggatcaatcaataacgtaccacgagattcaatacccatcatggcatacgtggttgctttaccagaattcatagataccaaagtacccttcttacggccagggttccagttcttgataactggtgcatacttctcaaaagtatggttcaagataccataaccacgagtcattgacatgaattcagttgagtaaccgatcaaaccacgtgaaggtgctaagaaagtcaaacgggtttggccgttgtcagtactttccatgttctgcatctcacctttacgttgtgaaagggaatcgatcacgctaccagtgtattcgtcaggggtatcaatttgaacttcttcaaatggttctgacttaacgccatcaacgtcgcggtaaataacttctggacgtgatacttgaagttcaaagccttcacgacgaagggtttcgattaagattgacaaatgcaattcaccacggcctgaaacaacccaggcacctggttcgtcggtatcatcaacacgaagcgaaacatcggtttcaagctcagtcttcaaacgttgttccaattgacgacttgttacaaacttaccgtcttggccagcaaatggtgaattgttagtccggaaagtcatttgtaaagtaggttcatcaatccgtaagattggtaaagcttcttgagtatcagaagcagtaacagtttcaccaacgttaatatcttccatccctgaaacggcaatcaaatcaccggccttggcttcgttgatttcaagacgcttcaaaccgaagaaaccaaacagcttagtgacacggaagttcttagtgctaccgtctaacttcataacggaaacgttatcgccgactttgatcttgccacggaaaatccggccaataccaacacggccaacgaaatcgttgtaatcaagtaaggcaacttggaattgaagtggttcgtctgagttatcgataggcgttgggatgtgcttaacgatcgtatcaaagattggcttcatagtgtgttcttgagttgcgatatctggatcgaagcttgaagttccgttcattgctgaagcataaacaactgggaaatcaagttggtcttcgtcagcacctaattcaatgaacaggtccaaaacttcatcaacaacttctgaaggacgggcgcctggacggtcaaccttgttaatgacaacaattggtgtcaaatgttgttccaaggctttcttcaaaacaaaacgggtttgtggcattgtaccttcaaaggcatcaacgacaagtaaaacaccgtcaaccattcgcatgatccgttcaacttcaccaccgaagtcagcatgtcctggggtatccaaaatattgatctgcttgtccccataacggacggcagtgttcttcgaaaggatcgtaatcccacgttctctttcaatatcgttagagtccaacgcacggtcagcaatctccgtatgttcatctaatgtatctgattgttttaataattcattaaccaaggttgtcttaccgtggtcaacgtgggcaataattgcgatgttacgaatgtcatctctggttttcaaaatcttgttcttcctttcataaacgcgtgaaacttcattatttaacggtcaaactgtagcgcattctccacactctacaccttgacttaacgccataaaaaaactgtgaccagcgtcacagtcagacgtttgaaccgatgattggcagaatgtcttgttgtgcttttactgttgctaccattacgaagtctgatgatagcatatctagaggcttcccgtcaactgttgtcaccgcaagtccaagagtttctgtcagaattttaccagcaccgaaatcccacggctttagatatgaaacgtatgcaaccgtttcaccttttagcagatgaatcatttcaattcctgctgaaccataaattcttaacccagaactagcttctgcaactttctgaaaattacggtagttgtgcattaccatgggaccactcagacaaacgaggccgtcacgtaaactgacattttctggtgcagctaacggttcatcgttttgaaaaacaccgatatcgggtccgcccgaaaacagctgattaccgattacatcgtagatatagcctaaaacaccctgtccatcgatataaagtgcaatcataatggcaaaatgatcacgttgcttaacaaagttcatggtaccatcaatgggatccacgacccaaacccagccttttgtctgtcggatttgatcaccaaagccctcttcacccagaatttgactgtcgggcgaaaaagttctgatcttattaatgagtaatttttcgttttccttatcaacgttggttaccaagtctttacgactggatttttccgaaacacttagattttgctgcatcttactcaagataaatttccgagaagtgctcaaccactgtttaactgtacgatcaattcggtgaagttctgtttcattcatgagcttaaccccctatcgtcattttaaccgactttttggtggtctcacgggctgtttttaacgtgcgataccaactatacccggttagctgttcgaactgcttaccaagctgtttttcctgtgacttggatggtacgacagttttaaaagctgaatacgcggacaatagcgaatcaatcaaaacgccttgtgaaagttcgtaagcatcttcaacctgccgataaaaagcagttactgtaataatctcgtcagttgtccaatctgacgccaagggataactaaagttcttcaaaatggcaccccgtctattctttattatttctacagatttattatacagcaaaaaaggaccaggcacatagcctgatcctttcgttaaattcaagtttagatgtgggttgggaaaccaatcgcaacatcagcagcttcttgaattggttcactcaacgttgggtgtgggtgaatggttaaagcaatgtcttcagcgttcatgccgctgttaactgccaaacttaattcagcaatcaaatctgaagcacctggtccaacgacttgggcaccaagaagattatgattgtcatccttagtagttaccaaacgaacgaaaccgtctggttggtcaagtgaaacggcacgtgcattacctgcgaatgggaacttagccgtgctgacttcgattcccttatccttggcttcactctgcgtcaaaccgacagtggcaagttcagggtctgcaaagcagacagccggaacgccaacccagtcattagcagtgttcttaccagagatagctccggcagcagttttagcttcaaagaaggctttgtgagccaatgctggacccggaacaatatcaccaatagcgtagatgtttggaactgaagtacgaccttgttgatcaacttcaaccaagccatgatcgccaaccttaacatcggtcatttccagaccaatgtcatcggtattagccttacgaccaacagtaaccatgcagtaatcagccttaacagttgattccttgccatctacagcataggtaacagtaacactcttgtcatcttgttctgctttctttgccatggcaccggtaatcacatcgatacccttcttcttcatttgcttaaggacaaccttaaccatgtccttatcgaagttaggcagaatggaatcagtaccttcaacgatagttacgtgagagcctaagttagcatatgcaccagctaattcagttccaacgtagccaccaccaatgacaacgaattctttaggaatttctggtaagttcaagccaccagtagagtcaacgacccgaccttcaaacttgaatccaggaatttcaactggacggctaccggttgcgatgattaagttcttgaattcgatggttaaaccatcatcagcactcatgaactgctttggaccggttgatacaacccgcaacttggtgtttgaatcaagtacggcttcaccttcgatgacgtcaaccttgtgcttcttcagcaacatggtgacaccaccggtcatccgctcaacaaccttcttttgtttccattcctgcgtcttactaaaatcaatcgaaggcgcttgagtggtaatcccaaaggttgaagcatccgaagcttcttgaaaacggtgaccagcgttaatcaaggcctttgaaggcacacaaccaacgttcaaacatacaccaccgagtttgttcttttcaataaccgtcacactttggccgagttcagcagcacgaatggcagcgacgtagccgccaggacccccaccaatgatgacagtgtcacgtttttcagcatctgacatataaggatcatccttccattaataacaattctggttcatgaagcaaatcgttcatcatgttcaaggcacgttgtgctaaggcaccatcaatcagacggtgatcatagctcaacgataacttcaacatgttaccaacagcgatttctccatcatcgttgacatatggttctttagcaatcttaccaacacccaagattgcaacttctggttgattgataacaggggtaaagaagccaccgccaattgaaccaacgttactaatggtaattgaaccgccagacatctggtcagcactcagcttgttatccttagcagcctgggtgttatcagaaatttccttagcaatttcaaacatacctttagaatccgcgttcttaatgtttggaacgtacagaccatgatcggtatcagttgcaattccgatgttgtaatagtgcttgtaaacaatttcatttgtagtgctgtcaattgaagcatcgaattctgggaacttcttcaaaacagcaactaaagccttaaccatgtatggtaagaaggtcaaatgaatatcctgatcagcagctaatgccttgtacttcttccggttagccatcaaagctgaaacttcaacgtcctggaatgaagtaacatgaggtgaaatatcctttgaagtccgcattgccttagcaataactttacgagtcattgacattggttcacgggtttcaagatcaggttgtgcttccttgtaaggcttgattggagctgcagctggagcagcgacagcagcaggtgcggcggcagcagctggagcagcggcgccattgaagttatcaatatcagccttcagaatctgaccgtggttaccagttggggtaacggcagtaatatcaacacccttatcacgtgcgtattgacgtactgatggcattgctaatactaacttgttaggatcagattgtgcaggaacaccggttggtgctgcaggagcagcagcggcagcaggtgcagctgctggagctggttctggagcagcttcttctttaggtgcttcgtctgatgaagcatcagatgagtcatcgtcaggagtatcaggtgaaccatcatcgatcacaaccaaagtgtcaccgatttcagcagtttcaccctcctgcttaacaatttgtttaatagtaccagccacaggtgatggcagttcagaaacagacttatcgttttgaatttcgactaaaacgtcgtcttctttaacggtgtccccttctttaacatcccatgttgcaacttcaccttcggccataccttcaccaagctctgggagtttgaatgcataagccatggaaaaacttcctttctattacaaagtagttatatttagtagttcaaaatttcgcgtgctttttcttcgatgtcgtcagcgtttggaatccagtcgttttcaacttgagcccaagggtaaacgctatcaggagcagcaacacggccaattggtgcatccaagttcataatggcatgttcagcgatctcagcagtaacctgagcaccgacaccggccatcttttgagcttcttgcacaacaactactttgtgagtcttttcaactgacttgaagattgtgtcagtatcaattggtgacaatgaacgaaggtcgatcacttcagcagaaatgttttccttggccaacttgtcagcaacttttaatgactcattaacttcagcactgtaagcaacgatagtaatatcagtaccttcacgaactacttttgcagtatctagaggaactgtgtacttgccttctggaatttcatccttcattgaacgatataacttcaggttttccatgaaaagaactgggtcgttgttttcaacggctgaaataatcatacctttggcatcatatgggttagcaggtgttacaacccgcagacctggggtaccaacatagtagttttcaaggttgtcggcatgcatttcagcggtatgagtaccaccaccaaatggtgtccgaacggtgattggcattgaacgcttgccactaaagcggaaacgttcacgtgacatttgaccacctaatgagtcaacggcttcaaaagtgaagcccataaattgaatttctggaattggacgccagccagtagcagctaacccaattgataatcctaaaattcctgattcagctaatggtgtatcgaagacccggtcttcaccatacttgtcttgcagaccttgggtagtacggaacacaccaccatttttaccaacgtcttcaccgaagatcaacgttttcggatcttcgcctaaaacaacgtctaaaccatctgtaatcgctttgatataagttaatttagccatggttacttcgactcctttgcttcgaatcttgcaatatcagctttgatttgtggagttggttcttcgaacgtcgtcttcaacatatcaacaactgattgtgtaggtgtattttcagcttccttcattgatgctttgaagctgtctttatattcctcaacaagtttgtcttcttggtcttgtgaccataatcccttgtcacccaatactttacgcatacggatcaaaggatcagcgtcgaaccaaggtttttcttcttcttttgtccggtaacgactaggatcatcaccagcacttgagtgagcaccataacgataagttaaggtttcaaccaatactggaccattaccagcagcggcaaagtcacgtgcttctttagtagcaatgtaagtagccaaaacatccatcccatcaacttgaatagatggaacaccagatgcaacggctttttgagctaaggtttcagcagcagtttgcttgtaacgtggaactgaaattgcccagccattgttttgaaccatgaatacagcaggagcttggaatgaagatgcaaagttaacaccttcgtagaagtcaccttgcgaagtaccaccatcaccggtatatacgaatgatacggcatctttttcaccgttcttcttaatacctaatgcggcaccggcagcttcaacgtattgcgcaccaatgataatttgtgggaaccagttacgttggtcaccataatcatcaccaacggcattaccctttgaccataagaaaccttgggctacggaagcaccgtgttgaattaattgtggcaagtcacggtaggcagggaacaggaaatcttggtctttaaatgctgcaattgaccccatttcacttgcttcctcaccataagtcggggcatagaagcctaaacgaccttgacgagagaagttcattgtttgttcatgcaatgtacgctcccaaaccatctttttcataaaatcaactaactgatcatctgaaaaagtatcgaaaagttcttgattcacgatcttcgcatctttgtccacaatttggaacgttttcttatacggatcgctcatcgtggctttaattgatgcgaaatcaattacttgcccagttttcttcgccataactaacactttcctttccgtttgtatgcaaccagtttcaaaaccaccttcatagttttgaaaccgtttgcttttctcaactacactcttaaattaccacgctttcacaattcatgcaagccctttcattacttttaaaacgcaaaagttgcccagttgcctgtgaacataggaatccttttttctgaaaaaatgtttgtattttctttcacatttttttaatttcatttttgtaacttattatgctaaaattgattgttagagcacttgttttttcaatttcggaggtaattttcgtgattttaatgaaagacatcaccagagacggtgaccctgtcctcagaaaagaagctgccaaagtcagtttccccctatctgaggaggatcaaaagttggctgatgatatgatggaatacttaaaagtcagtcaggatccagaactatgtaagaaatatggtttgcgtgccggtgttggtttagccgcaccgcaagtcggcgtttcaaaaatgatggctgcagttcttgtaccagctgaagaaggcgctaagtctccatttactgacgtcattattaacccggttattattagtcattccgttcaaagcggtgcgttaactgagggcgaaggatgtttgtcagtagataaagaagtgcccggcttcgtaccacgtcatgaccggatcaccttacgctaccaggacactaagggcgaaacacacaaagttcgtcttaagaattatccagcaatcgtttgtcagcatgaaatcgaccaccttcacgggatcttgttttacgatcatatcaataaggacaatccttacgaagttagcgatgataccattatgtttgaataaactttcgatggttagtatttctcaaagttaagtcacactgaaaacagcttacagctcagccattcggctaaacagtaagctgtttttgtttgttttaattattctggttggtgacgttaggcttcgttttaggatccaaccggtgtaaatcttgaatgtactcaatcgtagcttcattaacaaggtatgccacaccaagatgaatacgttttgtatgccgccaaatatccgttaccaaaaacgctgactcgcctggctcaaccaccgaaacaatttgatgatcctggcaaaattcagctaagatatggtttaaccgttgccttaaaattggtaactgatcatccgtaatctggtcaatcaagagcaaatattcaaacgccatcacacccctgccccaaccatcaggaatgatactagcgtccaaaacagttgcgggacttgaaataaaatgttcatctgctaaacgttggagagctgctttaacggctacattagtctgttccagcgctgcactttgcgcttttttagtgttgcggcttacaatcatgtgatggataagtaggtagagacagattgcaataatcacagcaattgaaatcgtaactgttcgacccatggcgaccactcctttttaaattatactaacacaatttatatttcaactttatcattctgcggaaacttgaatgaaagctcgctgcattgcgagattctgcccggttggaaaactatacaattttattcatatatgataatatattagcaactgttgttcattaacaacgagacgttcggtacaaataaaagatcggttagcgatcaatgcagtaattcactgtaactatagaaaggaagtagacaatttcactatgatttttaaagtttactatcaagaagaccagattcgtaaccccaaacgtgaggatacgaaatcactttatatcgatgctgccacggaagttgaagcacgcgctttagttgctgaaaacaccaagcacaacattgaattcatcgaaccacttgagggtaagttccttgaatatgaacaggaaaacccggactacaagttgacggagtttaataaatgaaaaaattaaacgtcaaaaacaatgaaacagcgatttttggcgttggtggtttaggcgaaattgggaagaatacatatggtattcaattccaggatgagattattttaattgatgccggaattaaattcccggaggatgaactacttggaatcgattacgtgattccagactatcattatctcatcgccaaccagcaaaagatcaaagcactggtcatcacccatggtcatgaagatcatatcggtggtgttccctatctgttaaaggatttaaacgtgccagtctacgctggaccacttgcgcttgcgctaatcaaaaataagttggatgaacacggtttgctccgttcagccgaacttcacgaaatcaatgaagatactgtactgaagttccgaaaaacaagtgtggaatttttccgaacgacccactctattccggataccttaggcgttgcagtgcataccccttctggcgtgattgtccagactggggactataagttcgatctgactcccgttaccaaccagccacctgatttacaaaagatggcgcgtctcggtgcggaaggtgttctttgcctgatgtcagattctaccaacgctgaacggccaatttggacgaagtctgaaaaatgggtcggtaaatcaattcgccggatttttgatcaagtcgatggtcgcattatctttgcaactttcgcctcaaatatttctcggatggaaactgcctgtgaaaccgcactatcccatggccgaaaaattgcggtcttcggtcgaagcatggaggcagccatcgtcaatggtcgcgaactgggatatctaaatattccagatgaagcgcttattgacgcaaatgaattacgttctttaccagctaataaggtcatgatcctttgtaccgggtcacaaggtgaaccaatggctgccctttcaaggattgccaacggtacccaccgtcagatttcaattcagcctggtgataccgtggtcttttcaagtaacccaattcctggcaacactgttagtgttaaccatgttattaacgaacttgaagaagccggggctaatgttattcacggtaaggtcaataacatccatacttctggtcacggtggtcaagaagaacagaaactcatgcttcggttaatgaagcctaagtacttcatgccgattcatggtgaataccgaatgctcaagattcataccgaattagctgagcaatgtggcgtaccgcttgaccatagttttattatggaaaacggtgacgttctcgcactcaccaaagattcagcacgaattgccggtcacttcactgctggtgatgtttacatcgatggtagcggcattggcgatattggcaacgttgtgttacgtgatcgtcagctgctctctgaagaaggcctagttgtggtcgtcgcaacgatcaatctgaatgataaaatcattcaagcgggtccagatcttctctcacgtggtttcgtttatatgcgtgaatcaggtgagttattaaatgaaggtcgtcgtctcgtcttttctactattcgccgagcgatgcgttcaaagaaggctaacgaagcttccattcgaaacgccatcattgatgatctacagaatttcctttatgaaaaaactgagcgtcatccaatgattttaccgatgttaattatggattaaggtattagaaaagccatttgcgattgcaaatggcttttttgtggttcgctaaatgtgagactttcaggccctctaacatctccataatttttctcatcacattctaactaaatctgaacactttctaaatacttcattctagccctgactaacaaagtcggctataataagaaagtatgattttcgaatgctattggaggatgagttaggtgtcaatcagttactacatcattttaaatgagtttgccggtggtggcagcgtcaaaaatctatggccagaaatcaaagccactctagatgaacggcaggtagactataaagttggccgctccacttatgctggacatgctcagcttttagccaatcaatttgccaaagctcacgctgatgatgagcctacaacacagcatcgctacgtcgttttagcaattggtggcgatggcacgcttcatcaagctatctccgggttagctgaagctcacctagaacgccctattccggtagcttacttaccagtggggtctggtaacgacttcgctcgaggtattaagatggccactaactggcataaagcgctcaatcagattttaaactgtaccgctgaaaattggctcacagtaggctctttcttcgataccaataaacagacccatggtgtatttactaataacgttggcgtaggttttgacgctgctgtggtcacatctgctaacggtgcgccgtccaagagtatcctcaaccgattacatttaggtggtctaagttatctagccgcaattatcggcgtgttctataaccaagaagcttttcctctgaccgtacatgttggtcagcacagagatatttactcacacgcttatttagtaactgtcactaatcatccttactttggtggtggcgtaaagattgcaccatcagcttctgttaatgaccctaatctcgatttggttgtcattgaaaaagcgaacatttttaaacttctttttatactattaatgatatcaatgggtaaacatttaaagttaaaatcggttcaccactatcatgaaaacaaaattcatttaatcgttccttctattgagtatggtcaaatcgacggtgaagaaatgggtggtcgctattgggatacctacttcgaaactaaacagtaccctttttggattgatcctactatttaatttttttcacactaaaaaacatgccatcatctgctaacgacacaaataggcgctattccgacaaaaacggaatagcgcctattttaaaagattttattagcttctagttaccttctaatccagaaaatgacagaaactcatctcaatattacctgaacgtttcatttagctctcttgctccgacctattttctgaaaaatacgcaactaatcttcggaagcagccattgcttctaaaatcatattcaaatagtcacactttgctgaaagttcttgcatctgccgaccatatttaggctcgatggtaatcgtctcgtgatgacacggttcaacctgtcgagcttcagtcgcctttaattcagttagttgttcgtttactttctgatattcagtgaggatctccgtacgattactcatcagttacacgccttcttaattgcaaaataattttaagtaatttttaaacaagaaagactataacaccaaacttcaactttgtgaaccacattttacaacaaaacttcaaaagattgcgaaagcaacttctgtaaaaaataaaaaacgcgacgtttgaaaatcaaacttcgcgtccttaaatatcatatttatcttctctaaccgttcactgtaccagcgaaacttggcttgaaatatgaactgattgattgaatctgaacattttcaccaggttctggcgcggcaacgaactgattattaccgatataaattgccacatggtaagtcgcacccttagacccccaaaataagagatcaccaggaactgcgtgactaacagagtgggtagagacgtgagcttcttgtgccaccgtattgtgtggcaaagaaactccaactgtatgggcataaacgtaacttgtaaaccctgaacagtccattcctttaagggaagaaccaccccagacatacggaatcttttccgaagctaatttaaccgcataactggttacagacgtcactggcgcaccagcagcatcagctttaaccgtcttcttagccttaggtgttgtgttggttgcttgcttcttagtggttgttgcagttgctgccttagtgttagtagaacttgccacacttttaaccgtggtggtagcgctcgtctttgctttggctgcagtccccttaacctttaatctttgaccagtataaatcgtgtcaccattcaaatgatttaaagaccgtagccgattaacagttatcccatattttgcactgattttattcagcgtatcccccgacttaactttgtatgtagaggctgtggctgttgtcttgactggtgaagtagcagcatttgctttcgtggtaacttgtgtatttgacttcggtgtcttaactgttgtctgtttagcagatgtatgagttgttttagctgatgctgatgaagaacctaaaacaattttttgacctgcaaaaatcatatctttgtttaaatggttggttttctcaattgaactaactgacacaccgtacctgttagctagcttccaaactgtgtccccagatttaactgtaacagttttagcgctggcttgaagtggcccggcaaacataaaacccgcaactccaataacaccagcagtgatgactttggttgtcgtgtgttgttttcccaaatcagatcactcctcctaattaactttcttgtccttgtgaatgcgctttacagaaattacatgttcatattaacacactttctaaataatcagcaaaaaagtttaagattttcttgcgataagcaattatgaaagcgtaacttatgtccaatgataactgatttaacgctgtttataaggctttgtaacatacaaaaaaactagttgctattttcatgaatgttagcaactagttagtatttttatgattattcaattactttttgcttaataaacgcactgaatttagaataaattactaaagaaatcaacaattgactgccaaattctacttaaagttcccatcatgccactggtatctgcattactggcaaaatcctttaactgcgccatcttgttacctaccgaattgctaatgttatttgcaacttgttttgcattgtcaacgtaactcgaagtccctgaaacgggtgctttttgaacgttacccaacgcgatgacaatgttattgatcacggtagttgaggtttgagactgaatgccttgctttgctaatgcatcatcgagcatctgcttaatctggtcttgagtagcgtactgattatctttttgtcgctgtttggccagatcagaggatacgctacccactgcagccattaacttgcccggatactttttatcatccttattttgattgatcgctggctgcgttgcatccataatgccgttagcagcctgcgtgttttgttgattcaacgtcaagccgtccgctgccaaagctttataaacaccggttaaagctgattctccggaaactgttttatcagcagtcaccgtaataatgacatctttaacaccggccatagtagccaccatcgcatactgctgtgaagttacttgtgtaatattgttctgaccattgtaatccgcaatattcaccttaacgccagtaccgggatcagctggagccagcgatactgaactgatcatactggcatcactggtacctgcagaattgatgtatgtgccataatccgaaccggtgaccgtgagactttggtaattagactgaacacctaatgcttttgaaatagcgtccttatcctcagaggccaatcccgaaccataaacaacatacggttttgataatgcctttgtttgaaccgcctgtccagatgacgcattagttgattctgaacttgacgtcgcgtcgttagcagtatctgccaacgcactcactggcatacttgcacccaataatagtaacagcgcaccgctaattaaactgatacgaactgcttttttcataatgaaatcctcatttcatataggttaagttaagtgtatcacgacaaataaaagggctaaacacctagttagcccttttaatgaattcataatgagtggtaaatcagctgaccaatcttagccattaaggtgattgcccctagtcgatccgtaaatccttgcgttaacacggcaacatcaatcacatgcccgttctttacaaagcgtgccacatcatgatcgatattcggcccttcacccgttttattgtagatggcaacatcctcagcagtttcatccattgttaaaggtaacttcccgcgaaactgctggtttaagaaccaaccgtgtacttgaggataatgctgcatcaactcccggaagagctttagactatcaaacgctgagatcagattttcacgacccgttttttttgcctctgtatccattagccgtcgttgtaaactggtttctgcgtaatgattggcatcaagccagtgattgattgcagccatggataaatagtcaatcatcacgtttgcggcataattatcagaatcagcaatcatcaatcctaagagatctttgattggccactcttccggtgtcagtaactgcagcacgcccgcaccaccaacttttggcgttttagagacgttaatcacttgatttaaatcctcgttttgagcaagttgagttgctaaaacaccaagtttgatcaacgaggctgccggaaattgtcggtgctcctgatagctaaaaactaggttatctgtattatacatacaaattgaaacttgatttttgtagggtgcaattagctcgttaagacctgtttctaagttcattgccaataccttcttgctgccacaaattctggtgcatatcgcatttcagttaatttagcaatgtccacttgtttaccaggtgtccgcgactgaatcatctgaccgtcaccaatgtacataccaacgtggtgtacgaatcctttaccatgttcataagcaaagaacagtaaatcacccggttgcaaattttctggttcaaccgattgcccattattacgctgatcatccgcatctctaggaatagcaattcccaatacacggtgtagggtatacataaatcctgagcagtcaaaaccatacggtgaaatgccagcccaaagatatcgaagccctaaaaattgtcgagccatgctgaccatcttctcaccagcggttttgccctcagcattcacagcaatactgtcagctgctacgtaaccttctcccaagggcgtcactacacgtaataaattcccctcagtgcccaactgagttaattcagttcccataactatctcaaaaaccgggttctgttgttcatcatacagtgttgtgaatggcacagcgacacaaagatgagtatttgcttctggatacgccactgtcgaagacgatagcagtttactcggcagccaaccaatatagcccctgtcatccgcatcatcagcctgagttgtcagataaactttagcccattcaccctcaacgctgtccacaatcacttcgtcattaaaaacggcctgagtttctagccgtttagagtcacacaaatcaatggtctgctcagtcgtcatggcagcgacccactgtttggtttcaccatttagcgctaactgatcaatatctcgtggcgcttttggactggtccatagcgttgccacgggcacaataacacgtcttttttccatccactcaccccacttactttgtttgaaattcaatccctaaaccgacatcggtaggaatcgtaatgactgcaccatcatgtgtaattccgccagttgtcggttgggtcttaaacatcatggcagcatctaaatcgtagtattgaatattggccttagcagctgccatggccgcagctgccgttacagaaacctgcgactcgatcatactgccgaccatgcaaggaaccccaaaagcttctgaaatcgcattaatcttcaaggcgttatcaataccgcccgccttcattaacttgagattaataatatcacaaccgtccatttttagtagccttaacgcatccttaacagaaaagatactctcatcggccatgattggtgtatcagtatgcgcggttacatacgccatgccttcaaaatcgtctgcaggaacgggctgttccactaattcaatgtccaagccttcctgcgccatttgattaatcactttagccgcctgttttttatgccagccctgattagcatccagtcgaattttaacgttgggacccaccgcttgccgaatggcacgaacttgttttaagtcctcaaaaggtgactgactgccaactttaacttttaaggtatcaaacccctcagtaattagctgtttggcatggccgaccatttctgcagcggtaccaacgctcaccgtgtaatccgttgaaatcgtctgacggtagcctcccagcaactctgacaaagaaacgccataatgtttagccagcaaatcgttaaccgcaatattcactgcagctttgggactgtgattgcccaccagcgcagtatcaatgatttgtttaacccgttcaggctgatttaacgacgctccaatcaacttcggtgcgatcacctgttccacagcaaacttaatacttgcggaagtgtcaccagtaatgggcgcagtcggcgcagcttcccctagaccagtaaacccatcagagtcggttagtcgtacaattaaactgctagctgttgttactgttcgcaaagccgttttaaacggtgattttagtggtacagcaatcggaaatgtttcaatttttttaatggttaatgacatcgcaaagtctcccaattttttaaattattaatcgtgttgtttatgccacaatcaactgaggtttaaatcattcgggtcaaaccgaaaccgttttttattataagttagctttccagccacttctaacttagtcacaacctgaccggcagtttcacgggtcgttccactcaaccgcgctaattcaattaaggtgattgggtaaggaatcaacacatccccttcaggcgttttctcgcccatatcggtgccaaaaatacgtagtacctgcaccactctactggtagcactagacgtcactaatttttgcagtcgattctccatttgattgagtaactgactcatttggctaatcacttgccttgttaccagagggttcagggcaatgatggcttcaaatgttgccataggaactgaggcaatggtgattggcgttagcgcagtcgccgtatacggatagtcttcatcggtatataacccacggtatggaaatcccttggttgccttaacgtaattaatgaaggaaaaattacccgtttcatcctgcctctccaaccggacaacgcctttaatcacaaaataaaaacgttgtcgcaaatcaccgtgatcaaatagcacctgaccctttggaaatgttttgaccattaaatcatgagtcaatttcgtaaattcttcttgtgtaaaatcacgaaaatcaggtagttgacgtaaataatggcgatatgtatcctccgagtgcagcatgaagcagacccctttcttatctggctattattatacgccaaatgatttgaaatttaagtttgattttcaaaagtaaaagacagaccgaattttcattcggtctgtcttttactaggcacttacatttctctagacactcgactccgcgttgacagttgaaacaatcgtccctgagccattttcaataaacttgccaagattacttagtgaagtgatgacagcttgtccctctgggcggtgagtcacaaattcaatcgctgcttccacctttggcaacatactaccggcggcaaactgcccttcagcaatatactgctgtaactcatctaccgaaattgcgttcagttgctgttgatctggcgtgttgaaattcacataaacatgatctacagcggttaaaataatcagttgatcagcacctacccgctcagctagtttctctgaagcaaaatctttatcgatcacagcttcacagccaactagctcatgaccatgacgaaccactgggataccgccaccaccagccactattgggattacgccagcgttaactaagtggtttactgcacctgcctcaaccacatcgattggtcgtggcgaaggcactactcgccgatagccacgcccagcatcttccacaaaatggaactggggattggcagactggatggtagtgatttcttcgtgattataaaacgggccaatgggcttcgtcggtgtttcaaaagccgggtcattttcatccacaacaacttgggtgaccacggttgcaacgtccacctctaatccaagtgccgtcagttctgctgccattgcattttgcagccaataaccaatactgccctgtgtcatggctaccgccgtgtctaatggcatctctggattatctggtgtacttcccgctgcttgctgcaacaagatgttacccacctgcggaccgttaccgtgagaaatgatcaatgagtcaccttgctgaataaatttaacgaggtacctagcagtttctcttagagcgcgttgttgcgctgccgcactcgcatcatttgctaaaatcgcatttccgcccagtgcaaccacaattttgcgtgctgtcatgggaaatcatcctttctaccaagttgtccgttgaataaacaaaaagggcgctctgtaaaacaccacattgtgttttgcttaagccccctaaaagcaatcttcaattatacagatggaataaataagttacctaacgttgcggccatcatcgccttaatggaatgcatccggttttcagcttcttcaaactgacgtgcatacttgctacggaagacttcatccgtaatttccatttcggttaagccgtacttttcttcaatttctttaccataatcggtagtcgtatcatggaaggctggcaggcagtgcatcacgatcagttgatcatctggtgtccccgtcttctttaaagctgccatattcacttgatagggttgcagcaggttgatccgctcttgccagttattctcacccatggatacccaaacgtcggtataaacgatatttgagcccttcataccttcatccaaatcatccgtaatcagtaatttagcccctgagtccttagcgaaaccgttagctaaatcttgaatctcctgtgctggatataattcttttggcgctacgatgtgaatgttcacaccaagaatggcaccggtaacgagcagggagttagcaacgttattccggccatcacccataaatgtcagtgtcaggcccttcaaatgaccaaagttttcctttacagtcatgaaatcggccaacatttgagtaggatgccattcatccgttaaaccattccaaacgggaacgccagcatattcagctaaatcttcaacgactttttggctgaaaccacggaattcaatgccatcaaacatactgccaagtaccttagcagtatcttcaactgattctttcttacccaattggatatcgttagcacctaaaaattctgggtgagccccaagatcgattgccgcagtggtaaacgcggaacgtgtccgtgttgaagtcttctcaaacagtaacgccacgtttttaccttcgaggtaatgatgcggtactcccgctttcttgagggcttttaaatgcagtccaaagtcaatcaaatagtttaattcatcagcactaaaatctttttcggccaacactgaccgtccttgaaaaacactctttttaaagtctgtcatgatcatagctccttttttggttagagatcttctcgtaccagcggcatactcatgcatcttggaccaccacgtccccttgaaagttcactggaaagaacttccagaaccttgagtccatgttcacgcagcacctgatttgatacgtagtttctattataggtgactacaacgcctggtgcaatcgctaacgtattagatccatcattccactgttcacggtccgcaatcaacggatcaccgccaccagttggaattaaatcaatatcatcaagtccaagcacgtcctttaagacttgctttaaatctaagtgatgatccacgtgtaactcgccatctcgatcttcggtaacgatccagctgtcgatttgaccgccctcacccaaaatacctggatgaacggtaaattggtcgtgattgatcatcgtaaagaccgtgtctaaatgcatcatcgcatggttatgaggaattcgaatcgccaatactttttcaaagccgctcttcttttcgaataacctacgagcgatgtcttcaatggcaccagctgaagtccgttctgagacaccgattgcaatcacagtgtcactgaggactaattcatcgccaccttcgattcgaccaggttgatcacggtcacgccaaacgtgcagcccttgatcagcaaacctcgggtgatgagcaataatggtttccataaagagtgattcacgctgccttgctgggaaggtcatgtggttaatgctcaggccatcaccaattgatgcagcaggatcccgcgtgaaatacaagttaggcatcgggtccaagaagaatggatagtcttgttcttccgctgcactcactaaatcttgcggtacgaaatctaattcgtttttccgcacaccggccatgatcttaacaaccatttcagtggtcgtcatgcttaataaatactcttctaaaacatggtggatcattccagccgcatagccagattcggtcagcattttatccagaaaatgaatttttaattcggcaccgccaccgtctaaagcttccacaactaatttttcgagatatagaacttcaacgccattatctttcaatgtatctgcaaagttatcgtgttctttttgagcaatgggtaggtaaggaatgtcatcgaataagagccttggcatcatttcgggtgtaaagttttcaacttcggcacccggcctttttaacatcacaacgtcaagcttgccgatttccgatgttacatgaattggttttgtcatggtagttacctcctatctcttttggacaccttaatcatatgatgaatcagcagtcgtttcaccgatgatttcacagttggaatgccaaggatttcacacttttaaaccgttgtgattatttagacaaaaatatgcagaaattcaatgtatttaagctttgtttgcttaaatatacaccagtttatgcatattattagaaaattaaaattagattaaatattttttcgcattactatttactttagataaagggatattcgcagttttatcgtttttaattcatatttggttcacatttttattgtatatctgaatgaatcattttcacactgtcacgaacaatcagttctaatggcaactgcttatcctgatgggctaacctaggattattgagtcgctcaatcaatagatctgtggcaacttgccccatctcaaaggctggctgatgaatcgatgttagcttgggggtaataaagttagcgagatcgatatcatcatagcccatgattgacaggtcgtccggaatttttaatccccgttcttgaacgccacgatataatccaatcgccatttcatcgttaatcgagaaaaccgccgttgcatttttagcgagaacgtctgccgtagcctgatacccgcccaacttggtcatggaagattgaataaccatgtcatccgacagggttaaccgatacttcgccattcctgctctaaaacctgcaattcgctgttgaatattatgggtaatgttttcgccaacaagtaacgcaattcgacggtgacccctcgacagcaaataatttgcagccatctgaccacccttataatcgtccacccaaacacgatcgccaatctgagcgtcgttttgatcaaacagtaaatagggaatcccgtttcgtgtcaaaattcgatcaatgtcgttagcatctaaagttgcgctggcaataatcaacccgttggctgctcgtttgatcaattcttcaatatacatactttgtaacttctgattttgattggcatcaaaaataatcggtacaaaatgatgtaattgtgccgcctgttgaattcccttaatgaacatactaaaaaagggattagctaggttaggaacgagaacgccaattgtttgagtagaacccataatcaaattacgggcattatagtcaggcacataccccatttttttttgcagtttaagtacgcggtccttagtatcactgctaaatcgttcgcccttaccatttaaaatttgcgaaacagtcgttactgatacgcctgcagcttcggctaaatccctaattgtcactttttgcgccacgatttcctcctcattgcaatctggttggattgaagcatccctcgcttactcagattgtcacggtaacactatgtactaaatcccccatttcaaattggtttggaatgaggggtaaaggatgcaattaacctttaatgattgaatcaatttttgccaattcatcagccgaaaaacgaatgttttgtacggcttttaagttatcttccaagtgagagacctttgacgcaccagtgacaacgctcaccactacaggatccttcaataaccaggctaacgccatctgagccattgtttgatcccgattcttggcaatttcgttcaactgatttagcttctctgctaactttgcccggccctgatccatcacttctgtactgctccagtgaatctggaattcttcaggaataccacctaaatatcggttagtcagcaatccttcagctaaaggaccgtacgcaaccataccaagattattttccttcaaagtgtctaaaacaccgtcgtcttcaacttctcgattaagcatgttgtacgataattgattaacaacaaatggtgtgtgtaattccttaaaggttttcataatcgctttagtttgcgcatcattatagttcgaaataccaatgtaaagcgccttaccagaccgaacgatgctgtctagtgcttcggcagtttcggctggatccgtgttagggtcaaaccggtgactgtaaaaaacgtccacgtagtccaagcccattcgtttcaaactaccatcaatggcgttgatcagcgtcttgcgagaactcatctcaccgtacggccctggccacatgtgaaaaccagctttcgtcgtaatcaccagttcatcacggtaaggcttcaaattagcctggtaaacttggccaaataagcgttcagcagctcctgatccaggaccatagttgtaggccaaatcaaaactaaaaataccactgtcaaatgcttttaaaataatcttttcactgtcagaataattggcttcatcaccaaaactgtgccacatgccaaatgacacggcgggtaactgtaaccctttattcccagcacgacgaacgggcatccggccgtcgtaacgattttcatccgctgcatacatcataatgattctccttctctcgtgattggtacatatcaattttaaaaggagaatgacacccggtcaagtggaaaaggatgtgaatatgttagcaacgtcggcattttgccttcaattatttaagactgcaaactaagcttcacggcatcactgacgtggccgccagcttgcttcaatagtgccttggcttcagcaatcgttcccttggtttcaatcagtaaaatagccaaaggaacgttgttatctgcacggtccaatgccctctcagcggctaaagtcgaggtttgagtggcagctgcgataatccgtttagcccgccgattcgttttttcgttagtgggtaccacattaatcataaggttttgataaaccttacctgaccggatcatgataccgctagaaaccatgtttaacaccatcttttgagaagtcccggctttcatgagggttgcaccggtaatcacttccggtcctacgattggacaaattgcaacgtcggcattcttctctagagggctgtcagtcacacaagctaccgcgatagctaaagcaccaacttgttttgcatagtgcaacgccgctaccgtgtacggcgttgcaccactagcggcaataccgatcacgatatcttttttatttaagttgaccttttgcaaatcaacttcagctgattcagctgagtcttccaccccttccaacgtgtgaaacatggcttctggtccaccagcaatgatgccaaaagtttgggactcttccagtccgtacgttggccttaattcggtggcatccagtacaccgagtcgcccagatgtccctgcaccgatatagatcaaccggccacctgcatcaaaacgtttcgtcgctaaattaatggcctccgagatttgtggcaactgtttttgaactgaccgtgcaacgcgctgatcctcacggttaataatctccaccatatcgtcagtatcaacctgatcaatatgagtagagtggcgattacgctgctcggttagtaaatcttcaaaattcatttcaaatcctccattttcataaaccacccctgatttggaaagaggccatttttatttgttatcgctttcatcccttactaacaggtatatcatgtttcaatgaaaatttcaattcaatttaaagatgaagaagatattttcagctttcattgaaaatttttagcttagtaaggaggttaatttgaaagccttacacagttcaaagagattttggaacacaaataagcgtcatcccaataactgggacaacgcctgttcgtgtaaccatttgaaatttaaaattaattatttagtgatataaatatccttcaagcctcgactcatcccggctggattccaaacgtaaccgtggacgtttggccgccatagctctgttgtggatggctgatacaatggaatgaccccttgatccttcatcagaaccttttcagcgccaactaggtcttcatatcggcgttgctgatcattagcatccgttgtttgagaagcatcaatcagtttgtcgaattcactgttggaccatttgccattgtttgtcggattattggattcctgtaaactcaagaaattaattgggtctgcaaaatcagcaccccacatcgacacaactaagtcaaaattaccgtttgaagaacgtgctaaacggttcttgtaaggcacattatcaatgttgactgtcaggcctggcagtttctggaattgatcttggagatattgcgtcgtggttttcgcctggtcggtatcatcgctcaataatgtcaaagtcagcttcttttcgcccacttctttcatcccttgagtccaaagtttcttggcattacttgaatcataagtaacgccggatttaacgtaggcatccgttgcgaagtccgccttagtcttgggattgcgactgagattagtcgacacaaaccccttaggtgcagtggaaccatcgcgcaagaccttagttgctaacgcctgtttattcacgatttgagaaagtgcttggcgaattttaacgtttctcaacgctttattgcgcttttgattcatctgcagatacatcattgagccgccttcaaacttctggaagcccttattactctgataattagccacttgagttcctgacaacggtgtcacatcaagcttattttgattatataagtttaatcccgtgcttgggctcttcactacttggtacttgatctgactcaaatgaacgtgctttttatcccaataattaggatttttcttcaaatcccacgtattattcgtcccgttccaaccggccactttaaatggcccgttgttagacacatcctgactattattgccatattgtttgccatatttttcaaccgctgactgctcttcagggaagaacgttgggaacgctagcagcaacttaaagtaaggtaccggccggcttaatgtcacaaccagcttatccttacttggtgcagcgacccctaacgtattggggctcatcttccccttttgaatggcactaaaatttttaatgccatcaaacaaataactgtaattggccgccgtctttggatcggcagttctgcgccaagaatatacaaagtcctgcgccgttacgggtttgccatcactccacttgtcgtctgaacgaagattgaaggtgtaagtcaaaccatcctttgaaacttgagttttagtcgccaaagcattctcaatttttgaatgctgccctaatcgatataacccttcgtttgttgcatacaaagccgtcaaactcactgattctgatgcagcagagttatccagtgttgagatggtatctgtggtactaagatttaaaacctgcttatcagccatttgctgactactaccgttactagattgggattgaccgcaagccgccagcgtaaacgctaaagcaatactgccgatacccactaggatttttttgaaagtcatactgtttgctctccatctctaattgaaattgtttcagacccaaaaatactatctgaacgatgattttatccagatagtatctttgagtgacatttaataatgaactaacttctaacgaataaacaactggccaacactttgttcggaatagatccgtcgaatagcttgacccattagattaccaactgaaatgatttctagtttatcaaactgcttagactcaggcatttgaatcgaatcggttacaatcactttcttcagtggtgaatttttcatttgtgtcaccgcattcttactaaatactggatgggtggcaacagcatatacgtcttttgcaccagcgtttttcaaggtttgtgccgaaatagatatccgcacagctgtatcaataatgtcatctaccaaaatggcgttctttccatcaacggaaccaatcacagcatctgcagaagtcgttgacttatcaggatcccgattatcaataattgctaatggtgtctgcaaaagatccgccatccgccgtgcctttgaaacccctgcatgatcaggtgaaaccactaccagattatccgtcaaaccatggtcaataaaataacctgctaataacggtgttgcttccaagtgatccattggaatatcaaagaagccttgcaactgcgcagcatgcaggtcaagggtcactacccgatcaacaccatcatcttccaacagtgatgcaatcagtttagccgtgatgggttcgcgagaccgtgctttacgatcggcacgagaatacccgtagtaggggataacaaccgtaatggaatgcgcactggcacgacgaacagcatccaccataatcattaattccatcaacatggtattaacgggatctgaaactgattgaatcaagaaaatgtcatcgccacgaatactttcatccaccgtaatcgcaatttcaccatcactaaaatgcttaattgttgcctttcccagttcgactccagcagctgcagcaattttttctgcaagtggtcggtttgaatttaacgcaaacatcttcaatggatgtttagtttcactttgatttgacatgtttttcctccacgattcgtattatcgacaaaactacttaaccaaatagtacactatcactatttgttagtaaacgattttggcgtgacttttcccattccaatcattggatcgatttgcccgctgctaaccaatgacatggttaagataccatcgtttaaaagcttcgattcatcttccactgctgatgacttcgcttcaggcgccaacgtctttttgactggttgttcctgagactttggctgactctcttttggcgcatctcgttgttctacaaccgatgcctgaacttcgctgatggtaaccgtcagccgatccactagcgccgtatttcgattaacagattgccgcttaacactttgttcaaaggccgactgttctccaagtagaatcaaagttgatttcgctcgggtaatcgccgtatataacagattacgttgcaacatccgtgaatattgcatgaccatgggcagaatcaccattttgaattgactgccttgtgccttatgaatcgacgtacagtaagctaaagtcagtttatcccattcattgcgtggataagtcacttccgtttggtcaaaggccacggtgagcttatcgaccttatccgaattacccttagctttagcaaaagtaatcccaacaattgaaccaatatcaccgttaaaaacgttattttctggactgttgactaggtgcagcaccttgtcgccaatacggaacttttcaccgcggaattcaacttcttttttgcgagtgtcacttaacggattcataatatcttgaataatggtatttaaccgtgttacgcctgctgggccacgatacattggcgccaatacttgaaaatcatccgcagaaaagccgcgttctttagctttacccacaatttgttcgataactgatggcatctgataagcgttacaacgaataaacgatcggtcagccttattttgcgtaaaatcagctggcaaccttcccattttaacctcgtgagctaaaggaataatcgaggaatcatcgtcttgccggtaaatcgtgctcaactccatggccttaatgcgatgactactcagcaaatcaaagaatacctgtcctggaccaactgatggcagctgatccttatcgccgaccaaaaccacctgcattgaatccggaatggcccgaagcagtgtccgaaacaagtaaatatcgaccatggacatttcatctacgatcaatagggaaccttccaagtctttagcagtcacatcatcgttattctcacggcctgtaagccctaataatcggtgaatcgtgctggctggcaaccctgttgtttcactcatgcgcttagctgcccgtccggttggagctgcaagtaagattgggaaaggcttatccttatactgattaatgtctaatgatagctcatgtaacttagcatataaattgacaattccgttgataatcgtggttttccccgttccgggaccaccggttaacaagaaaacatgggactgaatcgctgataaaattgccgattcttgggagtcatcgtagctgattcccagattccgttcgactacgcgaatttgtttttcaatgacatcgtcatcaaaagtggtcaagtcagaggcctgcaaaattcggttaaggtgctcagctgcttgccattcggcatcgtaaagcccctttaaaaagatgcggtctccttcaccaaccacttttttggctttacctaactcaatgagctgatccgcaataagctgaggatcaatcgattcattgcgactctcctggagaagtcgaatcgtaccgttaaggagcggttccgcacttgtaaacgtgttgccatcagacatagcaagctcacccaaggtttgcagtaacccagcctgaatccgttggggtgattgggtaccaatcccaagttgttcagcaatctgatcggcacgtttgaaactcacaccattgatatcctcgactaattggtaaggattttcctgaatcacttgtaaggttttttccttataccgttcaaaaatagcactagccagccgactgccgaatccatagccattaagaccaataataatttgttcaaccccattattgctggatagattatcaattaaagtctgctttacctccgttttcaaattaagcgggtctaacacagacggatcctgattaatctgatcaatggcggtcaacccaagtagcgcaacaatcttttcagcggttttcttccctaaacctggaaagtcatctcctgaaagatattggataatgccttctttggtggtcggtgcctcgttttggtaattatcagcttgaaattgctgcccgtacttgggatggtcaactaacttaccaaagaaacgatacggcatttcctcagcaacgtcagcaaaattaccagtcaccacgatttcatcaccgtgccagttcaggttagtagctgatacttttaccaataatactttataaaaactatccggactttcaaaaaaggtcgctgccactgtgccaacaatgtaggactgctgtggctgttgctctgcatcaaacaaatttatattttcattcgccattcagtccaccccactttcagcttactgctttgattggtcgtctttcttcttagttaacacggcttgaatatcagccaaccgcgactgaccattttcataatacttagggtctagctgtttggcttgctcaaagtattctgtcgcgtcctcacccattacaacggcagcaatgccccggtcgaactgcgcgtgaccattcttggggtcgcttgccagagttttatcatagtacttagcggcatccttaaaactacccactgctagtagattatccgcaattaactggttaacttgtggatcctgctgatgattctccgcagctgtcaatgcgaacaccagcgctgttttatggtcattattccccatataactctgtgccagcattaaataagcatcgcttttaagtttactatctttaaccttattaaactgttcaatcgccttttggtattcaccagcttcataatagacgtttcctaagccatacgttaacgtatccttagcagcgcgactcttatcagcgaataatcccaacgctttcatcatgagttcctcggcttgagcataactcttaaggttgactaataacgccccaagatcgtagtaagtatggtagttgtccgggtcgtcatcaatttcttggatcaatcgatgtaataactgttctgattctttttgttttgcatctcgctctgcttttttttgagcagcttctgtttggttattcgtttcagtcatagtgtcgcctctctaaatggtgtctgttgcatcaagtttgcgtttcaaataatcggttttattccaggcaactaactgatagtgtgcaccagaatcatgtgtttctaaaatagtcgttgacgtgttacttaatccgccacggtctcgtaaatgcgccagtggtgtccccaataaggcattgatctcagcattaagcgcggcaccgtgactcactatcagcacgttttgctcatcgttaggataattcttaacgattgtttgaattgcgggtgtcatccgatcaatgagttcttggaaactttcaccaccaatttcaactggtcgatattcagccggcgcattacgaaaagcatcaaattcttcaggaaaacgcgcctgagcttccttgaataacatgccttccattttacccagatggaactcttctaaccggctcagtaaactcagcgctggccgacccggtagatactgacgcactgtcctagctgtgtcccgtgcccgtttaattggactggcgtaaacatgagcaaatttaaactgttttaagtaagcccctgcttgtttaatctcgtcataactttccggtaagagtggtgaatcaccaccagcaccctgataacgtgattcaaggttccactcggttttaccatgtcgtaaaaaaaataatctcaatgttcttccctctcaactgatgatggtaaaaaataaatcagtactattatgacaggttaactcaaaaaaaccaacccaagttcagcgaagaactcaagctggttcgattgttatttaaacgtattgaagttgacgactcttgctataagctgcgtcaataatggcgcttcccaagcattcttgaccatcgtaaaagacgacggcctgacccggggtaattgcccgaacaggatcatcaaactctaccgtgaccttctgacgatcatcagaaagatgaacggtcacgccggtatcaacctgacgataacggaacttagcagttgcccggaaatcctgaccgcgatcaatattgttgacccagtggatatctgaggcatcaaggtgagtggcgtaaaggtgctcattatgataacccttaccgacgtaaagaatattcttctttaaatctttaccgataacaaaccatggctcgttatcctcaccgtcaccaccaataccaagaccacgtcgctgaccaatcgtatagtacatcaagccagcgtgctcgcccttgacttcaccgtcaaccgtcatcattttaccaggtgttgctggtaagtaatgaccaaggaaggacttgaagtttttctcaccaatgaagcagatcccaacggaatctttcttgtgagcagtagccagaccagcttcttcagcaattcgccgaacttctggtttagtaatatccccgattgggaacatgacacgatccagctgttcagtggaaagctgactaaggaagtaagtctgatccttgttagtatctaccgaacgcatcaagtgcatatgaccatctgcatcgcggtttaactgagcatagtgtccagttgcgatatagtcagcaccaagatccaaagcgtagtctaaaaacgccttaaacttgatttccttattacagatcacatcaggattaggagtccggcccttcttgtactcatctaagaaataagtaaagacccggtcccaatactccttttcaaagttaacagagtagtaaggaattccaattttggcagcaactttagccacgtctttgtagtcttcagtagctgtgcagacgccgttttcgtcagtgtcgtcccagtttttcatgaacacaccaacaacgtcatagccctgctgctttaggcgcagtgcgacaactgacgagtcaaccccgccactcatgccgacaaccacacgtgtttggctgttgtcttgcataaaatcaccatcacttcataacagattctggagaatctacgagttgaaggtcgcaaaaatccagtataaatgataatacacgccaatcactgctattgcaagcgtttagtccttcgctggcacgatgatttcacgttctgctaggttttccatgatgtaatggaactgttcgagaaatgcgtccttacgttccatcttaaagatgttaacctctcgtagaccattacctgccaaggcagccattttaaagccacttaaatcagggttaaccgtgacttttaattcaacagtcgcactatagggagaagttggatctaaggaccgtttcaacgtaaagctgccgtttttgctctcaacgaaacccacgtctctgagtgaaaacttcttgatgccgtcactaattgtataagcttggtcatcaccctgtaatttagatgttcgattaaatgccatcttatttcacctcactgcgtgcctttacgcgagacacaatttttgaaatattggttaccagcgctgaaatatctttttcagtcgtgtaacgaccaaaactgatccgaatcgattctgaaattcgtggactatcttcaccaaacatagccgttaacacgtgagaaggttcgattgaacccgccgtgcaggctgaaccaccggataccgcgataccagctaaatcgaggttcgtttgcatgacgtaagttgaaatgcctttgatccaaagattcaaaacgtgttgcagattgtttcgatctaacgaaccgttaacttcgaaatcgacgcctgcatccgttaaacccttaacgatttcctgcttaaactgatagtatttagcttgccgatgcgctttttcctcagtggtgatcgtcttcacagcagctgccataccagcgattcctggcacgttttcggtaccggcacgccgcttttcttcctggtcgccacccttaacaaaactaggaaagttgatccctgttttacggtataaaaagccgaccatttttggaccgttgatcttatgtgctgaggtggacagcatgtcaatatgatcgcgcttaacatcgatatccagtaagccatatgcctgaacagcatccgtgtggaaccaggcttgatgatcttttagtaattcaccaatttcgtgaatcggcatatgcgtgccaacctcattattacccgtcataatcgtaactaaaatcgtgtcgtcgcgtaaagcctgtttaaaatcatccaaactgatttggccgttttcgtcaacgggtaagtaagtgacttcaaagccttgctcttccaaaaagtgcagtggcttcaaaaccgcttcgtgctcaactgcggtggtaataatgtgcttacccagtgactggcgagcatatgccgtttgcataatcgccgtattatcactttcagtgccaccacttgtaaaaataatctcatcttcatcagcattaatactttgagcaatcacttgccgactgttttcgagcaccgtatgtgactgacgtcctaaaccatataaagttgacgcgttcccataaacattctgcagcttatccgtcatctcagcgagaacttcctctgaaattggggtagtagccgcattatctaaataaatttcttccacgttaaaaaccccttctatcaattaagctgcaaacaaagccagtaacatttgagctgaacgcttaccagcctcaataataaagtcgtcaaagctgacaccagcattctcatcgccaacatcagacatggcccgaacaaccacgtaaggtgtgttgaactgatgagcaacttgaccaaccgcagccccttccatttcactggatagggcatccggaaaatgttttaaaatttgttcaactgcttcatgactggcaataaactggtcaccagaaacgatcaaaccagtcttaacgttcaagccagtggattcagcagctttttctaaccgtgcaacccactctttatcagcatcaaaacgagctggctgtcccggaagttgaccgtaaacgtaatcgaacgcccgcgcatcaacatcatggtaagcagtttgagtagacaaaaccacgtcacccacgtgcagtcccttaccaataccaccagcagaaccagaattaatcaccacgtccacgtggaacttggtgatcaacagtgctgtggtcagacctgcctgaactttaccgatcccagaacgaactaaaatcacttcttggtcgttaatggtcccttggtaaaatgacacgcctgaaatatcaacgacataatcgtgaaccagcgctttcttcaacgtttcaatttcttcatccatggcgcataaaataccatatttcataatattgccctcactttatcagtttaaaattcaacaaaaaataggattaaaaagaccgcaataattcccaaaactaaccaaaaaatagcccaatttaaacggcgcttcaaacggttaattttatccgttactgccgcttcttcctgttctggatcatattctggttcactatgttctttggcataacgtctttccgccttcaaccgctcgcggtcacgtcggtcaaactcttcttgcttacgacgttgttcttcccgataagcactgcggctcaaaggacgtccatcgttatctgaccgatcatcatcttgatatgcgatatgcttcacctacttctttaatgccatcatttcaaaacgccaaacggccatcaccgttttagcgtcttcgatttcaccattatcaaccatcgttcttaactcatctaccgaataagccttaattgtcaggttttcaccttgatcacgaggtaattccgattggactggctgtaaatcagttgctaagtataacgtcatatattcatctgaaaaaccaaccgaagaatagaaaccggctagtcgttctagatgattagggtgtaagcgaatttcttcatttaattccctaatagcggcatgttgaggatccgcatcatcgcgttgatccagctttcccgctggaatttccaacgtgctgcgaccaattggtgaacgccactgacggactaaaatcattttattttcgtccgtaatcgccataaccgctacagccccagagtgatgcacgatttcacggtaagcctttttaccgtttggtaactcaaccgtttgccgttcaacattaataatggcgccatcgtaaatagcgtcatgtgccacgactttttcttctaaattcattcaatcatcccttgtcagtcactcttgcactactcttcagaatcagaagtcttttcttctcgaacagaccgcacacgtgctgccattggtcctttttggccttcaacaatgacgaattctacttcttgacccggcgttaatttcttgaacccggccatttcaattcccgtatagtgaacaaaaaccgattcacctgcttcgcttttgataaagccaaaaccgttctgttcgttgtagcgttctacttttccctttatcatactgccactccattcaagttgcgatcatcatttagttttaaaacatcatttttcttgaaaattaagcagcgtcatcttaatcccaaccaccattaacttcaccatgaaacaaccttgtttcggttaaacagcagtataagatgaaataactcgctttttattctaaactaccaagcctatttaaatcaaggtaacggttctcgtaaagcgaaactattaacaaaaaattgacgattaattggcaccaaaaactaaaaaacgggaatgaggcgtacatcagtcgtcccattctcgttcttattttgatttaaaaattacttttcgtcgaaatctacgccaaccgtttctgggaactctgcacgcacaatcttggcgcagcgatcacagaagtgagggtagtccttgtcatcgccgaccgtttcacgcgtcatccgacaacgttcacaaacttcgccatccgcttcagcaacaacaacggcaacaccatcgttaaagttttcagcatctgcaggggcatctgccattgaagcaaccgttaatccagataccaacagtacctgacgaacatcagtatctaggtcattcaatagcttagtctgtttgtcatccaaatataaggtcaacttggcttcggaagccttcccaatcagtttttgatcacgagcttcttccaaagacttcaagacatcggaacgtaattccatgaaggcatcccagttagccactaactgttcttcattgttaaagtgttgaacagttggcatctcagctaattgcgcgtaatcttcaggctccttcaggaatggccaaatttcttctgccgtatgcggcaaaattggtgtcagcaacttcgtcatccctgccgcgatgtcataaagaacggtctgcattgaacgccgtgaatgactacccttagcatcgatatacaggatatccttagcaaagtctaagtaaaaagctgagaggtcagagatcacaaagttcattaattccttgtaaatatccaagaaatcgtattgatcgtagtggcctttgacactttcaacaaattggttaaactgtgccagcatgtatttgtcagcagatgctaagtcttcaacaggtaccgcatcggtctttggatcaaagtcactggtgttagccagcatgtaccgcatagtatttctgatctttttataagaatcagaaatcttcgtgaaggcatccattgaaacccgcacatcagcgctactatcaacggaagcaacccacagacggacgatttcagcccccatcttcttgataacttctgaaggtgcaatcgtgttacctaatgatttgctcatcttatggccttcgccatcaagggtaaagccttgtgacaacactgccttgtaaggtgcatgacctgaaacggcaacactagtaatcaaactggagttgaaccaaccacggtattgatctgaaccttcaaggtagaggtcagctgggtattccaactctggtcgttcaaccagtacaccctgatgagatgaaccagaatcaaaccaaacatccataatgtcagtttctttagtaaacttaccgtttggtgaatgtggtgatgtaaagccttctggtaataagtccttagcatcgcgatcaaaccaaacatctgaaccatacttctcaaataattgagccacgtgttcaatggtctctggtgtaatgatagcttcaccatcttcaccgtagaaaattggtagcggaacgccccaaacacgttgacgtgaaatgacccagtcgccacgatcacgaatcatgttgtgcagacgtttcttaccccaatctgggaagaactgaacgtcgtcaatagctgccaagatttcatcgcgcatcttatcaactgacgcaaaccattgcggtgtggcacggaaaataaccggttttttagtccgccaatcaaatgggtaactatgcttataaggcatgtagtctagcatcagaccagcttcttttaacttatccaacgaaatcttgttggcgtcatcgtagaaaacaccctcaaaatcgggaccagcttcactggtcatataacccttatcatcaactgggacaataacatcgaggccgtattctttaccgacattgaagtcatcttccccaagaccaggagcggtatgaacaagtccagtaccatcatccaaggtaacgaaatcacctaacatggtaaccaacttacgttctggatagaatggatgttgtgtcaaagtccggtcgagttccttacccttaacaactttcagagttttaacgtcttcccaaccgaatttttcggcacactgatcaactaattcagttgctaaaacaaacttgcggtcatcgcctttaggctgaacaacggagtaatcaaaatcggcaccaactgtgatccctgctgaagcgggaatcgtccatggcgtcgttgtccaaacaaccatgtatgtattgtcgttttccaagacacccttgccatcaaccacttgttcgccgtagtaggctgaaggcgaagtaacatcgtgatattcaacttcggcctcagccattgctgattcagatgaccatgaccagtaaactggttttctacccttaaaaatcaagccacgtttagcaaaggcaccaaaaacccgaacttcttgcgcttcaaattctggttttaacgttaggtatggatcatcccagtcaccagcaacgcctaagcgcttaaattcttcacgttgacgatcaacttgttccaaagcgtatttccggcataactttcggaattcaaccgtagacatcttcttacggtcgtaaccctgttgcgttaacttttgctcgattggcaaaccatgggtgtcccatcctggaacgtatggtgcccgaaaaccattcattgacttataacggacgataaagtccttcgaaatcttgttcaatgcatgacccatatgaatatcaccgttagcatatggtgggccatcatgtaagataaacgttggcttaccttcgtttaatttttgtcgcaattggtacactttgttatcagcccaagccttttgacgttcagcttctttgactggtaaattaccgcgcattttgaacttggtcttacccaaattcagtgtgtcttttacccgcaattagggtccctcctcgaattattagatggtacaaaaaaaggcctcacccaagggacgaagtcttcgtggtaccacccaattttagaatcaataactctcttatcttagccgttaacggagccgacccgttctgacttacgtttcagtcagacagctagaagatgatctgcatagcaacaggggttaccggatttccatcatcacaccggctcgctgaaacttattactatgctttctgttctccataccgctttaaatttaactgcaggctacttgttagaatcatcagtattatcatcaggaaaaataacaaccgtctcagtctgctgatccttattaggatcaactggctgatcagcatcataaatctcatccgatgaatctgacgaatcagactgatcatctgcctgtgaagtcgagtttacgccatcatcattctcattgtcaaccccgttctgcttaattgcagcctgaatatcatcataagttgatgaaccatcatctttaagcagattatcccagctatcactcttaatttctgccaactgactttcaagcataacttgcaaacgttgacgaaaaacccgggtactcttcttcagatcatccgtttcaacagctaggttttgggccctcttagaagcttcagaaattaaatgattagccttgtcagcagcttcactaatagtatccgtagcttgcttctgtgcttcctgattaatgatttcagcttctttttgagagttagactttaccttatcagcagcctcttgggccacaataattgactgattcaacgaatctttcaaatcgttaaaatatttcagcttttcttctgcagaatttaactgatccgtcaacttcttgttctgatctaaagtaatctgataatccttaataatctgctctaaaaagtcattaacttcatcaacattatatccccgtaacttggttgaaaactctttattatgaatgtctaatgggctaagtaccataacttgttcctccccgattgcaattatttatgcagcactgccagtgtgactttcagtttatccttcttggtcacgccgttaacacttgttaatctaacccgtccgaaaccacgaactgaaatgatgtcttgatgttccaattggtaatcaggccggtcaaagtcgttccagttcagttgaattcgaccagcttctattaactctttagcgtggtgtctggataaatggaaaccagtcgcaacaacgttatcaagtcgagttgaagaaagcgtggtgctttcctcttcccaagcatcaagcgggatcagatgatcatccaatgccacctgattcaaccggatcttaatttttcccatccgatccacctgagaaacaacgtagcgactcatgtccgcagtgataaagaactgccagtgatcaccatcagtaatgatgtcacccagaacatctcgatcaattccagcgccaagtatggaacctaaaatttggccatgctgaagctgggtaaacttccttggataatcaatgtcatacaagttaatttcaaagtcgagatcagctgaatcaacatacgtcgggtaaataacggcccgcttcatttctgctccatgatagccaccctgaaaactcagcttcaagtcagaatcaccattaactaacgtcgataaaatgtattgctgtctcggatttaaaaaatgggttaaaattggccgatattcatcactggcctgttgaatccaacccgtcgcactttcaatgaaaggtgcttcttctacccgaaaatgctgcgcgatgcgatcagccaaagtcaactcctcctactacattcccataagtcgaaaaataatttgttcaagatatgctaagccaccacgaacaatactcaaaacgaagatggcaaccaatggtgcaaaaccgatcataccgatagttgcaaaattaaaccagcgttgaaacggctcaacgattgcacctaaaagctgccctagcttagtttgataagctcctgggaaccagcttagtaatgcataaacaacaatggccatgatgtaaaggtcaattgccctactcaatagccaaaacacaaacgtcacaaaagcgaccaaatactcactccttacttcagtttctcgcctaaagtggcagagagatctccagttatttcaaagtttttgggcgtgcataaaaaaatggcatccccaattcgttcaatatcaccatcaatagcgaacacggttcccgttaaaaagtcaacgatccgacgggcattagcatcatcaatacgaccaaaattcacaatcacagcctgctgattcaacagttgactagcaatatcttgcacatccgcatataatcgcggttcaaataacgagattttgctggctttactagtgcgcggtgcatttaacgacaccactttattatcatcatgatgttgatgaaaactatgcgccaatggttgatcggcaatctgttgctgagtgtcctgggaggtttcagcatcatcttcgtcattatcatccataccgaaaaagcgactcatactaaattttcccatgaaaaacgctcctttcgctatttatcagggttaatcactcatacactaatcgtttttacgacggtgcttgaaaaatggtggggtatcaagactagtgtcatcatccgaagcatttgacgtattatcatcattgttgaagacactgaaatcaggcttagaaacaccatcgaattcgttagaagatggtcgacgagtttcgtttgatgcctgactttgaccgctttgactagcattaaaactatccatttggctgttcttatcatcgcgacgtgaatcgtttactggcgttgatccgtcagctaaacggcgggctgtgcgagtcttagctgaatcctttttcttatcaataccagttgcaatgacagttacccgaacttcatcaccgagattttcatcaattgacgtcccaaaaataatgttgacgtcactagtggctgatgaagaaacaatctctgaggccgattgggcttcaaacaaggacaagtctggaccaccagtaatgtttaacagcacttgttcggcaccatcgatagaaacttcaagtaatggtgatgaaatagccttctttgtggcatcttcagtccggttttcaccattggcggaaccgacacccatcaaggcagcaccttgatcctgcataaccgtcttaacatcggcaaaatccaagttgacatatccaggactggtaatcaaatctgaaataccttgaacaccttggcgtaacacgttatcggcttcttggaaggcttccatcattggggtctttttgtcgacaatctcaagcaaacggttattagcaatgacgattaacgtatccacgttttccttcattgccgcaacaccctcagcagcgaaacgagaccgcttaggaccttcaaaagtaaatggccgggtaacaacaccaacggtcagggcaccctgttccttggctaattttgcaacgacaggcgcagccccgttaccagttccgccacccataccagcagtaacaaacaccatatcagcaccagctaatgcttcactgatttggtcttcgctttcctgagcggccttagtcccaatctcaggattagatccagcacctagcccacgagtcagcttaggtcctaattgaatctttgtttcagcctttgaagcctctagtgcttgcacatcagtgttggcaacaataaactcaacacccttaacgtcttctgtaatcatccggttaacggcattactgccaccgccaccaacaccaataactttaatattggctcctcggttttgtgttgaatctaacgaaaattccatttttaaatccctccagtaatcgggttaatcaaagaaatcagtaaagaatttcttgataccctgtccacgttgttttttcggcttattcgacttattagtacgactctgatcaggtttaacatgccgtgtatcactaacttctaaagtttgctgtggctctggccgtgtctcaacttgtgaagccaactgatcattgcccgctaaagctgattgaactagcaaagcaacttcgcccatcttgccacgatagttgaccagcgataatgcctgagtgaacgatggatgccgaagccccatctgatcaggtatcgacactctaactggcacgtcaaaaacatcctgagctaaatcagtaatgcctggaagtgcagccacaccaccggtcaaaacaataccacctggtaaagataacgcattggttgcatccaactgtgtcttaagtttcccaagaatctgcatcaaacgagcttcaataatttctgctaaatacttttctgaaatatcacttggtctgctttggccgacaacgtcaactggaaactgattatcttccgaagcacgggatgaatcagcaaaaccatagttacgttttaatttttcagcattctctatcgaagtattcaaaacgacagaaatatctttggtaatatagtccccgccttcaggatcaacctcggcaaatttcagccggtgatcatgaatcactgcagcggtactctgtccaccgcctaaatcgagaaggatagtgccaaaatcctgttcaccatcactcaaaatacttaaaccttgagcaatcggactgaccactgcaagttgtgcattcaacccagcttgttcaaccgcttttttagtgttatgtacgattgttttgggcccagtaaacagcataccgttcatttctaaacgaacgccaaccatcgatctcggatccttaatgccatcaaagccatcgacgataaattcatcaggtactaaattgatgatttctcgttctggtggtaaattctgaataatcgctgcagacgcaacgtctctaacatcttgatcagtaatttcacgtgcttgatccccaatggcgatcatgcccgttactggttcaatttttaacatatttgccgaaatacctacaatcacatcgtgaatctgaatgctggccttttcctcagcagctttcacagctcgtttaatcgcttcgcttgccttatcaatgtccacgatcacgccccggctaagtccggctgcacgttcattaccaacacccagtacgttcaactgtccctctaaatactctgccacgatgactttaattgaggttgttccgatatcaagtcctacatacatgcctgaagtatccatagtagcaggaacctcctccgatttcgatttgatgaatgctcatgaaaagtcttattttactttccagtttaccacaaacaccactggttaaaaaaggcattattgcccttgtattgcgcaatgaagtgcaaaatgtaaaaacgctttcactaactctggaataatctggttttttcttcgtcctaaaatgaatacgaataagccccaatctctaaattaacaatccccttatgcgacattttcgctgcaatactgggataatacgccattttactggcaaaggtggagatagatgcataaacttcattaccatcgttcatgtataaatgaaccctttgcgcatttgactttgatggtgaaaactgaatttcagaaatcgcggtctgaattttgggagaaagtttagcgtattgctgaatcatttgggagagctgcttagaagatttaaacttatcgtaaactggataactgcccgttggctgctgttgacgctcatttgaaatcacgccgctggttaacgcaacccggtaataaccattagctggcacaaagccggccgtggtgtattctttcacgcggatggtcagctggttgaaatgagcgacggagaaagcaatctttttcaccctcggcgtacgggcttcagcctttttacttaagcgttgttccttccccacgacccggtatattgagtcaccctgtttgataccgctaagtttgactacttgctgcttagaaagcgcatggttcccaataacgttaattcgaccaatgtggcttaaaggcgacacatagtagcccgagattagcaaaatgatcccaaaaataccgatcaaaatgcccattcgctgtgcaagacgacgatgtttctgttgtctcaatcgtggcaatttggcgccaatccgccgtacacggttggtctttttagccgctgcacgctgccgctcttccgactggtatttttcccatggcgtaattgcaacgtgacgttttgatttgtcacggttgattttaaaactcatcttgcactcacctcgatattacgattggctaacctcttttaaaagcgacagcatttccgtcgcagctttaggtttaccaagttttttggcagcagcggccatcgctgaacgcttctgatcatcattcatcaattcatccatggctgaaaccagcgtttgattggttaaatcggcttctttgatcattagtgctgcattcgcattaactaaactcatagcgtttttagtttgatgatccgctgtcacgtacggacttggaatcaaaatggaaggcacgcctaatgcggttaattcagctaaagtcgtcgctccagaacgaccgaccactccggcaagctttggcagtacctctggcatattattgatatatgactgaattgaaatattatcagcagaagccattttattgacttgactcatgacatggttatagcgcttgggaccagtcacaaaaacgacttgatacgatttctttgctaattcaggcaaagcttcgaccatgacttgattcagttttaatgcaccttggctaccaccaacaaccataatcgttggtacgtcatcctttaagttgaaggctgacaaactgaaatcacttttgatgttagctacttcctgtgcccgtggattaccagtcatcacaaccttgtcagctggaaattgggctcttgcgtcttcaaagttaatggcaattttgtcgacgtaacgactaagaaatttgttagtcatgccgaccacactattttgttcatgaatgaccgttggaatatgctgcttagctgcagcgtataaaacggctccagaaacatagccacccgtgccaagaaccacatccggcttaaacgagcgaaccagcttcttagcttgatggacactcttcaaaaataggtagaccgtcttgaagttttctaacgacaatgaccgtttaaatccttgaatggtcatggcttcaaatgggatccctaaatctggcacaattttactttcgattccccgatgagaaccaacatagagaacttccgcgtcggaatcctgtcgttttagttcgttaattaccgctagtgcaggataaatatgaccgcctgtaccaccgccagaaaccattagtcgcattagttctcctccttcttaccagttaattcttcaacggctttaataaatcgatcaccacgaacctcaaaattagggtattgatcccagctggcattagctggcgacaataagataatatcgcccggttcactatcttgatatgccattggtacccctgcctcggcgttttcagcaaactgaatttgtttgatgccagctttcttagcggcatccgccaataagtccttagtttcaccaaacaaaaccacagccttaacgtgttccttgaaaaatggtaccaaacgttcaaacgtataaccccgatccaagccacctgctaataggacaaccggtgccttgaaaccttttaatgccatctcagtagcttcaatgtcggtcgctttagaatcgttatagaattcgcgtccctcgctagtcagtacgtactgtgttcggtgtcgtaccccactaaaggtcgttaatacgtgtttgatggcctcgcttgaacggcccttaattttagctacggcaattgccgctaatgcattttcaatattatgatctcctggtactttaacgtcagccgctgccataattggctcgtctttgtaataaagggtgccattaagctcataggcgccatccttgcttttggctagtcgtgaaaatggtaccacttgggccttactttgctgacttaaaccaactaattcttcggagtcaaagttaacaacgaaataatcgtcagctgtttgattctgggtgatccgcatctttgcccgaacgtaattttcacgagttttatgataatccagatgattagcaaaaatattagttaacacggcaatgtgcggatgaaactgggtcgtccctaacagcatgaaactggagacttccatgaccagcgtatcctgctctgtcagttgctgagcaacttgggaagctggaacaccaatgttgccggcgtatgcgctcttccctgcttgacgttcctgattcatcatcttagtgatcatcgttgtcgttgtggtttttccgttactaccagtgaccgcaattaattctgcatccgtaatctcactagccaactcaatttccgtaatgatgggcagttttgcctgggtagccgcttttatcagtggaacatcataaggtataccaggatttttcaccattaaatcaaaaccggcatcaagttgagaagggtcttgttcacccgtcagaatggtgtagccgccttcagcttgcagctcttgcgcttctgaatttttctctaagggctgctgatcactaaccgtgacttcggctcctaattttttaagcagtcgagctgcatttaaaccactcttagctaatcctacaacaataactcgtttaccttcatatgtcttgatacgcttcatacctttgtccgccacctatttaatttttaataccttaataacaataacttaaaagaacctaccacattacccaaatacctgtcacagctgttatggcactaatacaccaaaaagtaatgtcaatgcgccattcgctccaacccttcatctcaaaatgatgatgaatcggcgacattaggaaaattcgcttaccagtcgtcttaaatgaaagaacctgtaaaatcacactggcagtctcaatgacgtaaattaagccaatccataacagtgatacttcatgatgaactaagattgaaacggcagccagtgcccctcctaatgccaacgatcccatatcacccataaaaattttagcgggcttatgattgtagatcaagaaggccaataagccaccaacaactgccaaacaaaacattgccacgtctaactgatgctgatgcagggcaatgacaccataggcaataaacgaaatagaagctaccccagcaaccaggccatccagaccgtctgttaaattaacagcgttggaaaaaccaaccagccagaataaaataaacaaaaagtagccaaataagcctaaattaatggcaccgatacctggaagtttaagtaacaatggtagtccttcgtgcaagtaaacagcaaagaaaactgccccaccaacaatctgtcccaataatttttgccaggccttaagcccctcattttgccggcggaaaagtttgatggagtcatcccacatccctaacaatccgtacagaatcaaaataaacagcaagatcagtgctaccggacctaattgtccaaacactaatccgctaatcaacgtggccacgatgatggccaaaataaacatcagaccacccatcgtcggcgtacctgattttttttcgtgccaagaaggcccttcttcacgaatcatttgaccttcatgtttagcacgaaaataacgaatcaatgctggcataaatgccgctgtaattacaaaactaattagaaatgataaaaccgaactcatgactttctcctcttatgtcccacgaagtgagttactttaaactaactgttagtttgtcagattgaccaatctgtttaccaactgcaatactctgttttgcgacaaatccattaccctttgttttaacgttcagtccaaccatttgaccaagccgtaaaacatcactagctgaccaactggttaaatcaggcatgctctgcgtaccgcttgtaattaaaatgacgcgttgcttagacaaaagcgactgcccagcaattggcgattgcttcaaaacccgggtaccggtaccaatcgtcgttaccttataaccctttgagattaaatcgctcttggcaccagaagctgaccggttaacgtaagaaagcattttatcggcagtctgttgattactggttgaagtatcctcttgcaacgctcgcttcatcactggtttgaaaacgtctgccatcaattgggtcgccgtttcagtcccaggtaaagttggctgtttcatggtgatgtacatcacatactttggatttttagctggcgccataccagcaacagaatagaggtaactattatcaccactcaaatagcccgatttaccgtcactaacttgagccgtacccgttttagcagcaacacgaataccgttaatcttatagtcagacccgatcccgtatttcttatacacaacatcttccatgtgaccacgtactgctttggctgtggtagccgaaactggctgtccaacttctttcttaccatacgatttcacaactttaccagtatttggatcaacaattttacgaacaaggtaaggctttaacattttaccattattcgcgattgcagataacccctgcatcatttgaattgctgtaacctgaataccttgtccaaacgccgtgtcagcttgttcaatcgtacggttaaacgcgatattgccactttgctcaccgggcaacccaaagtgggttgattgcaaaaacttaaatcgtttaatgtacttctcccaggtcttggcacccatttgctgttccaaatgtgccatggccacgttacttgaaagtgcaaatcctttattataggtaattgttccccaaccaccaggattccagtcaggtaccgttcgaccgccaatttcataacgtcctgactgataggttgcgttgccgttatagttgccgctatcgatggacgccgccatggtaaagactttcatggttgaaccaggttcataggcatcctgaatcaaggtattacgccaaaccgaattcaagccttcaccagtttgcggatcaaatgttggtcgctgagtggcagccacaattgccccggttttggcattcatcagtaccgcattcatcgtcttagaatgggttttatcctgtaaagcagacatttgggtctccaacaacgtttgcaatctactatctaaagtggtgtagacgttatcaccattaagcggttttttagccttttgattagaattaggaatctggtaaccattattatcctgactaaccttcttgaagccatccgtccctttcaataaatcgttatctgcaccttcgattcccatcgtaccaactaattgccccttagctgtcgaggtaacgttaccgattaagtgagatgcgaatacaccgttaggatacaatcgtgcttgacgttgaacaaaggtcagaccagttaaatgcgcccgatcaattttttgttttgtcgtcaatgaaatattctgacccgcagctccgaattcaacctgaaaggcatttttactcttaggcgtgaggtaggccagtgcctttttctcactaattggtaaatattttgataagacctgtgccgttttatttttattggtaacgtacatcggtttaccagcaatagaacgctggtttttgtctaaaactgcatagagtgaatacgtgctggtatcctcagctatgggttgatttgaggcatcatagatcgtaccccgttgtgcttttaaagtttgattggcagtgtacagctttttagcttgactgcttaaattcacgttttgaacgttcttaccaattgcaatataagaaaaacgaccaatgaatagcaaaagtgctaaggagaaaagcaccagcaggcttcgtccaaaaacccgctgattgcgtcgcacttgtttgctagtcaccgttcgtttaggtgattgtttcatttattcacattccttactttactatttgaaagtgtcatgccgttttgtttagcgactttctccaatcgagaacgattcattaactcgttaatggtttgtcggtcactggtatttttattttcaagactcgttatctgagtgtcaacgtcttgcaaatgctgctgagcagttgaaaccccgttagtagcactaactaacatcaacatcatgccaattaaaacgattcccccaaccgttaaaagacatttttcaaacttagaaaatgggagtcttctaggcttactgacaacctgttttgaatgactatgtaatggaagtgtcggttgctctggaagcacctgtggttgaaattgagttgccaaattattttgagccatacttcatcatcatcctatcccttagaatattaaatcataaaatcgttatttctgctcaattactcgcagtttcgcactgtgtgcacgatgattttctgctaattcatcttcgtcgggtaaaattggcttacgagttacgagtttaaaatctggttgcaagttatctggaatgacaggcaagcccgctggtaaatcaggtaagctgcttttctccttaaacatcgttttaactaaacgatcctccaaagattgaaacgtgatcacacaaatccttcccccaggatttagtagtgtgagtgcttgttctagtgatgcttcaagggccgaaagttcatcgttaaccgcaattctaatcgcttgaaaaactttttttgccggatgaccaccgtgacgtcttgccttagctggaatcgcttctttaatcagctcaaccaattcgccagtcgtctcaatcggcttttcagtccgcaccgtttcgattcgtctagcaatcgacttcgcaaacttttcttcgccatagcgatgaaagattcgcacaaggtcttgataaggccactcattcaccactgtttgcgccgtgagtgaggcactctgatccatccgcatatccagcggcgcatcgtagcgataactgaagccccggtcggcatcgtcaaattgaggtgaagaaacacccaaatcatacaaaataccatcaacacgctccacttgctgttctgccaaggattttttcagttccctgaagttagcgtggattaacgtcaaccgatctacctgaatatcgtcagccaattgttccttgttatagtcgatagctgtttgatcctgatcaaatgaatacaaatgaccactagtcaattcggtgaggatcttatgggtatgaccgccgccaccaagcgtgcaatctacgtatatgccatctggttgaacattaagttcatggacagcctcatttaataatactgttcgatgatgaaactctgccatagtcttctccctcacctaaagatcaaaatcaattaggttttctgcaatgtcatcaaaattttcctctgctttatccgcaaaggcctgccagcgctcttggctccaaatttcaaagcggtctgagacaccgacaatcacgcactgtttagccaattcagcatgtttgatcaatgtttggggaagatttacccgcccctgcttatcaaacgaacacgtggtagcagctgaataaaagaaccgaacaaaggcacgtgcatcgcgcttatttaaaggcaacgcacttaatcgcttttgcataatctcccattgcgccatcggatagccaaacaggcagccatccataccgcgagtgatcacaaattcttctcccaactgactacgaaatttggctggaataattagccgccccttagtatcgatcgaatgctcaaattctcccatgaacatccgactcgcctcctaattactcactaatttaactaaagtttaccacaggtccccactttctaccacaactccccaagtattaattatataaattttaaaaaaaaccgttcaaacaatgtttgaacggggaaaggtttggatagtaggcgattagccagctaaataactaattaattaaggctctaatcactgttaaaaggtaagttaaaaaaagtaaaatatctgttagtcgccaataaaaaaggagaaacttattccataacagttcacctttggacaatccccaccagagagttatcccaattgaaattatcatccagatgaaaaccacagcggcaaaccaaggatcagtccacgtgtgggataattgccagataaaccaaagactgagcaatggtagacaatctattggatgcagcttggggcgccgttctttgggaatcaagccccttaacatccttagtatgaacagaactgctatgagaataataatttgaatgataatttgagtcaccgtagtccgtcctttcgtaaagccacccgtttctgtagttaacacacaaccgaaattttaccgcattcggtcgtttaaaatcaagaaagtttagcaactagattgcatttcttaatcgtccacgttaaactatttgaagtaatacagatgaaaagtggtgcagatatgcaaaaaaaacaaaaatcaaccttccaaaaaattaccatggtgctagtttggatcatgatcattgcgaccctgggttcattagttgcaagtgccttacaagccattggcatgttcggttaactcattggtggggattcgtcccatataaaatactaaaaagctcctgaagtggttttcatcacttcaggagctttttagttgagacaatttcaagtttaattacgcatccgagcttttttgtttataaacttgacgcggtttactaccatcttgaggaccaataaagccgccctgttccaagtcgtcgatcaacctagccgcccgattgtagccaattctaaagtgacgttgcagcagcgacgtactggccttctgctggtcaaccacgaattctaaggcgtcgttaaacaggtcatcatctgattgagaagcctcttcggagatttcctcatcactgaccatcatgctctcatcatattcagctgtctgctggtcacgaataaaatcagtaacgtgttgaacatccttatccggtatataagcaccttgaatccggatcggtgagttttggtcaaccggcatataaagcatatcgcctcgtcccaatagcttttcagcgccattggaatctagaatcgtccgtgaatcaaccccgctggaaactgcaaatgccattctagatggcacgtttgctttaattaaaccggtaatgacatccaccgaaggacgttgggtcgctaagatcatatggattccagcggcacgtcccatttgagccaagcgaataatagcatcctcaacttcattagaaaccgtcatcattaaatcagccaattcatcaacaatcacaacgatatacggcaaagttggtaacggcttatcagtcgtttgattttgcgtttgaacaaactgattatagccagaaatctttcgttgcccgactttagcaaacaaatcataacgctgttccatttcatgaacgactttatgcagtgccctagccgccttcttaggatctgaaactactggtgtaagcaagtgtggaataccgttataaacactgagttccacctttttaggatcaatcagcattaatttaacctgacttggtttggcattcatcaaaatactggtgataatgccattaattgccaccgacttcccgctacctgtcgatccggcaatcagcaaatgcggcatcttggtaagatccatggtgatcactttaccagttacgtcccgtcctaacggcacctgcaatagatgcgctgccccatgaggaaccgcttcgctaacgtcgcggaacgaaaccgttgagatttcctgattaggaacttcgataccaattaatgatttaccgggaattggcgcttcaatccgaatttccttggctgccaaagctaaggctaagtcatccgctaaattaacgattcgcgatactttgaccccaatcgcaggatgaagctcatattcagtcacggaaggtccgagattaacgtgcttaatttcagcgtcaacgccaaaactatccaacgttttctttaaaatcttggtgtttttttcaatcgttttataatcatcctgctgatccttttgcggaattggtgttaacagatcagtaccgggaagttgataattgggatcatctcccacagttgaaatcatcgtaggctcagattcttcagtagacttttcaaacgtctgctttgaagctggctctggttcatttttacgggttgccacactaatgggaatatccggtgatttgggttcgatcgtttgttcagtcgttgactgccgttcagcaactggggtaggcaaatccttttcggttgctggtaccaccttcgcaggcttgggcttaaccggccgtttggctgattttgaccgtgcttgtttaatttcttcgataccccgaactaacatttgaccgccctttttggcaacttgaccgaaccatcgaccacccacttgcacccatctaagaatctgagtaccagaaacgttaaaggcaatcattaaaccaatgatgactaacaatacggcaatcactttagcgccaccaaaagctaccaagaaatgagtaattgtgagtaaaacggctccaagggttccgccacctacagccgtactaacactattattcaacaaatcactgctgagtaactgccaagtataactcaagaaaccggtgtgctggttttcggataaaaataaatcaacgtgcagccacagtaatatccccagatacatcgttccaatactccaaagccatttactggcgatccttggtaactgaccagtgatcaataaagccagaccaaccgctaaaccaactaaactgacaaacggataggtatctccaaccacaaaacgaatcaaattagctgctaagttaccaacgaagcctgctttaaagaacgccaaaaggcacaaagttaacatgatgaggcctaccgcattggcagtatatgtaacgctgctttgacgtccttttttgcgccggttagtcgacttcgtttttcgacgtcgcgtggtctttcgcttttgtgccaaaaatgtcccccctatttaactcaatttaatttagctcacttattttagtttatcattttcgtaacgatgactgagctccaatttaggaaaactttgctgacgtagcacttcgtaaatcacaattgccgcagaattagaaagattcaaagcccgaatatgcgtatcatcctgtggaatccgaatggcctgctcgctgtgctgacgcatgaatggctctggcagtccggtcgtttctttaccaaacataaagtagtaatcgccattatcaacgtcggtatagtcatgctgcgtgtacgcaaactcagcgaacttagaaactaaaaacagtcgcttaacatctggtactgtactcataaattcctgaaggttcttatgataacgaatatcaactttgtcccaatagtccaaaccagcccgctttaaatgtgcgtcatcgactgaaaagcctaagggttcgattaaatctaaaatagtatcagtaccagcacaagttctggcaatattaccagtattagctggcattaaaggttcaaataagacaatatgattggacatagtcatgctcctcgttaataaaattataaaagtcaccgcataaaaaaacgcaacccctcggtgtcagcacggcgaggaactgcgttaatgaagtgcaaattcgacagaggctgacgatttctcgacatccactcccgaacgatttctcaacagttaatataacgcgaatttgtaaagaatgcaagctgattacgagatggacctagcctaacgtgaaaacgcgtgttatgacactcgtctgaatgtttaattctgtgatgccgttactttttcatcatcgtcttaacgacgtatattataaatgaactgtcattagtccacactaatcgtcaaaaattgttatgttataatgactgatagattatcaactaacttaaaaggagacttaccttgaaatttactgaaccgcttgctaatacctacaaccaactgacacaagctatcggtgatcaaactacccgcgtgacgattggaaacaacggcacaacacctagcaaaggaaccattgccgaagcagtcctttatgctcatgaacatgatttatctttgactgtcttgattcagccacggttaggtgtcgcaaattttactgatccagagcttaaaattatggaagccgatatactagaagctcagcaattaggtgccgatggcgtcatcatcggggcgcttacggctgaccaccaattagacactgaagccatgaataacttgattgcagccgctggtggcatgtcggtcactttcagtacagtaattgatgtacttgcggatagcgaacaggcaaatgcattagagtggctgtctgataacggcgtggataaggttttgacgcacctgacgggtaaaacggataccgctcagctatcaaaactgaataatgtagctcaagccgccaatctgcaattgattgttttaagtcatagtgaggctgagagcaatcaactgaacgaacagcttaacttgacttattttctccaagagatttaaaatcactcatttacctaaaagtatcctgtcacatcagttttaaagctgatgcagcaggatactttttttatcctaaatgctattttcacgttcaatcaatgttgcgaagtcatcaggcatcggtgcataacacgtaatctgccgctgggcaaatggattataaaagcttactgaagcgcaatgtaatgcttgtcgatgaatccaaggatttgtttgctgtccatacaggaaatcacccactaaggggtgcccaatactagccatatgcactctgatttggtgtgtacgtcccgtatgtaaacggacccgtaacaatgttgattgcgccatccgtttagcaacccagtactcagtttgagccgacttgccatcttgccgaaccatccgtttgatgaaggaaccgggttccctgccaatgggggcatcaatcacatcgtgttgctgtttcaccacccctgaaacaacacaaaaatacgtttttttcaaactgtgctgcttcagctgggtgtctaagacggtgtgtgcaaagtggtgtttggcaaaaatcacgataccgctagtttcacgatccaaccgagtaacaatatgcgtcacttgactagcagcatgggtacggatcagataccccttcactcgattaaccatcgaatcatccgcatagatgtgtgacggaactgatgccacttctgctggtttattaaccaccaaaaaatgatcatcttcataaagaatctccagcgacgtatgagatacctgcaaatgatcactgggtatttccggtggcaaggtcacttctaaccgctgattagctcgcattttataagtcacacgaactggtatcccgtcaacacaaatcttgccaccagaaaacttgatttgctttagaagcgtcctgctgattccctgctgacgcataaacgtgcgcacatagatcggcgaatcaccagtatactgccaatcaaatttaatcaaccggcttcaccccaataaaggattctgatactcgtttccaaaactgtgtatgccgatattgtgcaaaagcaattcgttgtttagaaattcggtacgtgactgatttaatttgacgattttccaccattttttgatcacaagtcatcaagctttcatctaactcaactggttctactcgaacccactcatgaggtgaaataataatgggcgaacccaacgttctgaagacgcgattattgatcgaggcaatttcagaaacttgtacaacgtttaactccgaactgattaccgcaccgccagccgatttgttataagccgtggaaccagttggggttgaaacacacaacccgtcaccgcgaaaaagttcgaataactgatccttaatgtaaacgttggccaacattgtgccggtaactttcttaatggttgattcatttaacgccagcatcgtttccttatcaccattactatactcgattaagatatctagaagtggataactcacactctgtccgttgtcgtgaaccaaactatcgatcagttcatcgacttcataatcacgccagtccgtataaaagcctaaatggccggtgtgaataccaacgaaacggatgctggcaagttggtattcatagtggtgaaaagccgacagcagcgtaccatcaccaccaacagtgatcaaaatatccggattatcattgtctaaggtcaagtgttcagctttaattttggacttcagtgcgtttgaaacccgtgttgaagctggacctgtattactaaaaatgccaattttcatcactgatcatcccttttattaggtggttgcggatctgatcctttaccatacgaaaataaatgctgtgcttcttgaatctcttctctgatctcagacatttcggtatccaacttgaacgcagcttctccagctcgctgtaatctggcgctgagttcttctggaaattcaccctggtatttatagttcaaagaatgctcgattgttgcccaaaaattcatggcaagcgttcgaacttgaacctcagctaaaatttttttctcacccgtcaccatctgaacaggatactcgattacgatatgataagagcgatatccactgggcttttcattatgaatataatcgcgctcttcaaggatcgtcatgtcagaacgttttcggagtaaatcaaccacttgataaatatcctcgacaaactggcacataatgcgtaaaccagcgatatcttgcatatcctgttcaagtcgttcctctgatacgtgccggcgattcattttttccttgatactatccaccggttttaccctgccagtcacaaattcaatgggtgaacgctgatttttgttttgaaattgcttgcgcattccccgtaattttacttttaattcatctaccgcctggttatagggcagtaaaaaatgattccaattttcaatcaagctgttcacctcgatatagtttaaattgactgcggtttgttttacaaacagactttattttagcatattttccattatgttgggccgcctgataccagaagaatctgtcaacttgattgacagacatgcggaactttaaatttatttgtataacaacggaaaacaacaacactgattgtgacagcctttgaaaccggttttaccctttccagtaggatttgcatagcctaaatccttgcatttcgctcaaaatgctttatgattatttttgaactgaaggtcgtttactagttaacggctaattaatggaggaaattactttgctagaagtatatctatttatcaacccattaggcagtcgctgtatgaagtcggaaaaatgtattctacgtctcgctgatcaaatttttggcgatatttcttatcaatttattccgcttctcaacccgcaaatgattgatcagcatttgaaagcgaccaatcaagactgtcatgacttgaacttacgcaatgaacaattcgatctgcattatcgcaccattctcgactataaagctgctctttttcagggcaagaagaagggccggttgtttttgctaaacctacagaaccaaatcgtcgatcagggtcaaccctattccgataaattggttttggaggttgccaaacacgtccacttggatcttgacatgttttccgaagatcgtcaatctgagttagcgcgccgtgcttttcaagcggatcagcgcttagcctctgagatgaacgttgctgacccatccactgccattttatataatgccgatgtttctgactatggcttaatgctagaagacgtcacttaccaaggattatacgaaatttgtgaaaacaacggtttacttgctaaacgggcattagaacatcaaaaatccacacctaacttacatattctttaatctatgtgagttcatatcaaaaaagcgatccgcacttttgcaggtcgcttttttaattgcaataaaaatcacatcgtctttgctaacgtttcaaactgatttaatcgttgctcaaattcagcaaacgcctgatcaagataagccgtttgggtcatatcaacaccagctttttgcatgacattgataggataatctgagctaccagatttcaaataattcaagtaagcatctcgttttgcggtatcgccactggtgattcgttgggcaagggtgttagcagctgcaaaaccggttgcgtattgataaacgtagtaattgtaatagaaatgaggaatccgtgaccattcatccgcaatctctgggtctgaaataacagcgtcgccatagtactttttattcaatgccaaataatgctgactcaaaaactcagccgtcagcggttgacctgcagcatcttgttcatgaataaaatgctcaaattcagcaaactgtgtctgacggaataccgtccccttaaaaccatcaaggtaatggttaagaacaaacgcttgaacttgcttttcaggatacttcttcaacaagtagtcagttaacagtgtttcattcgtggttgacgcaatttcagccacgaaaattgaataatcaccatactgatacggttggttatgtgtggtgtaatagctgtgcatgctatgacccatttcatgaaccagcgtaaataaactctcaaggttatcttgccagttcaataaaatatatggtgctgtatcgtacatccctgaagaatacgcaccagagcgtttacccttattttccacaacgtcgatccaatgcgaatcaaacgcctcttgaacgtgacttaaatagtctggtcccataacagccagtgcttttagcgcttcagacttagcttcttcaaacgtatacgataattggggttccccggtgattggcgtatacaaatcatacatatgcagttctggtaatttcaagatctgcttacgtaaagcaacataccggtgtaacaatgataaatgatcgtttacgctggtgaccagtgaatcaaacacgctgaccggaatatggttagcgttcattgcagcttgacgggcgttttcataatgatgaacagaagcctcaaaattatgggttttaacgtttcctgaaagtgttgcggctaaggtatgacggaactgatgatagaccgcatagagctgtttaaacgccattttccgcacttcaggcttagttgattgaattaactgatcgtaaaccccttgcgtcaattgtacggtaccaccatcttcatcctcaaccactgggaattccaaatcagcatcgtttaaaacaccaaaggtattgctagaagcgcttaacgcatctcctgcttgagctaataatttttcagcagctggagttaaaacgtgtgcgcgttcatccgtaatcgtatgcaaatagtgctcataaggtttaagcgccggctcagtttcaatccactgattcagcgtagccggttcgattgccaacaattctggttcaaaccaggcaatattgctttccagcttagtgaacatattttgtgtgcgaccactcagcgcctgattttcagcatttgaagtatcctgatcatgtttcaaagaagcataaacatagagtttttcagcggggcgaatagtgttcatgatggtttcaagcacctttaccaggtcatcagaactgtgagccattttcccctctaattcaggtaaagcatcaatctgtttcatcaccctatcaaaggcttgctcaaacgcttgttgattttgaaaaatgggcgtcagatcccatgttaactcggaattaacctgatcacgcgttggtaactgtttgatatctgccaataacagcacttccttttcatcgaaatttgtcactgtccatagcttaccacacgactagcgaggtaatgcaaccaattgccatgatttttcatcaagtgcttttaaaatgccctgttgttccaacaaatcaacgtaccgtcgtaactgtctcccccaactattgactagctcctgagtcgtacactgaataagttgcgacccttcaaaatgagtactgatcttggctgcccatttttccagatccagttgccgaattaaagaactaactggtttttccattaataaaacggtcatcagcgccgcccagataatgggtgagccgcaaattaagggctcagcatcagtgaattgataacaaacttgcggcatggcctgcagtaaactgtgatgttcatagcaaaactgttgcattttcaaccatttaggtattttgtagtgtaagcccatctgaacctgacgttgaagctgtttttttagggacttaactgtcgattgcggcctttttacggattgattgccagtgctggtctttgcccatccctgtaggaaccctgccccatccaccgtcaagtgatgccagataatcaaacacggctgatgcgtctgccaaaaaataatgtaccatcccagcttataggaatattgaagccatttttcggcatatcgaacggaagttattttttgtaaataagtttcccctaaaatccagacgacctccatgccataactattgtatccttgactgcgctgctgtaattttcccacggaaattggcgaacattggtattcaaccgccattttacggccgtcgcgttttaacagtaaatccggacgttgtgccagtgttttaatatagggttccagttcaacgttaccttcaccaaaataatcagctaactgccatttgcccgttaaatgagcctgactttctgattcactgaatggctgacatgatgaattaggccgatgagcaaaatgagcgaccatccgactaccacgttttaaagtgacttgttctcgacaactggggcaaaaataacttttctttcggtgcgcattgattgcttgcacaggactgctctgttcggtttgagcaattagcatctaaacacctgctctcttttggagatttaacactaactacgcaaatgaattgatttaaattttgttcaaacaactgatagtagtcgtaaaatggcgcaaaaaaagcgctaagccaaaacaggcttaacgcttttactcttcaaccattaacttattctgcagtaaaataacggcgggttagttgtagcgcactttgcgccataatctttttcccgtgttcatcaagaacatcggcggtaatcttcgttttttctgcatactcataagcaacggctagttcatctttaatactttcaggagacatttcattcacacggaaaatcaattccaaataataatcgttcttatagtgatacaagttagaagcagcttctgacaacttcaatgcttcagcaatcgcaatcatatcatcaaagctatgaaggcgtaaaacggttgtatggagcggtgacactttggtgacaggtgatgaagtcttgtctgctgattgagcagcagctggttcattctgattatcgtcactatcagtctgcatcagttgtttcttcaaaaagtcaggcacttcgtcttcgttaaccatttcaatgtcaggtgattctgtgtcatcttcattatcggttgaatcatcatccgctccacctttgctgataaataactcaagtccgttacggttaggtaagacttgaaaagtaacggcatcagtttcttgaaattggtgatcaacgtcaacttcttccaaaatactataaaagaagctttcaatttgcttgtggttaccaagcagatcaaggacggtaatgccccgttgggttaaatcatcatttccaatcaaaacgcgaatcgtgttctcattaattctttccatttccatgacccaacacctctttctgcccgcaccaagatttacctatctccatactaaagaattttcgcagtttgtaaagtatctggcttaaatttttttaaatattgtgaatttatatggtagctagcgaaagcaaaataccgtttagaacggctttcgtatgctgaaattacccagcgtcagcagcctcaatcgccttctcaagctccataacacggatatgtcgcggtaaaaaacgccgaatctcatcttcattaaaaccgacctgtaaccgcttctcgtcgaaaagtatcgggcgccttaatagacccggatgttgggttatcaagttgatcaactcgctcactggaagggtatcaatgtctatcgtcaagcgtttgtaatcctttgaccgtttcgaaataatatcctccgtcccattttcagtcaactgtaagatcaacttaagttgtttggcacttggcgcctgcacaaaaatattttgctctacaaagtcaacctcgtgtgtcttaagccattttttggctttccggcatgatgtacaactgggtgaagtaaatagcgtgactgtcataggaattgcctccaaacttataagaactggggaaataattaccattgattcatttgctatctcaactataacaaactcccggttccctgagaatggaattcactaaaacatcatgaacatctcagttaatcgtcacaatttaacctgaaaagttttccgtaatgctgctaattcaaccggtatctgaccagctgctgcttgggcttcttgctgtagcacagtcagatcaccaacttgcggtaagtgtgttagcatcaagtggccaacgtgagcatcagctgccaattggccggattcaccggcagtcatgtgccattttgtccccgttttctcattaaagaaattagtatctgtcatcaaaagattggcatggtctgcaaactgaactaattcgggaatataggctgtgtcagcagtgaaaaccagcgtttcgccagtcacgtcctcaacaattcgcatgccaaatgcaggtaccggatgcttcatcggtaaaaatgaaatcgtcaacggtccaaggtgtaaagtatctgctggtgcataaccttttccttccgaagcatggggccaagttaaactaccgaacattaaagggtcggcagttgaaccgtaaatgggcagtatcttttgattaggccgttcttcgtgtaattgccagtaatattgcagcacccccacatcggcaacgtgatcatgatgataatgtgaaagaattaccgcgtccaactgcagtggatccaaaattttttctaagctgagtagcgccccactgccacaatccatcagcaaatgataaccatttgactcgattaagtagctactcgttccaataccgttagcgggatacccgccataatagcctagcaccgttactttcatatctatacttcccttcaaacactttttacattaagacttatgaacgccttaaattaccattttagcctagcaaattgtataataatagtgatccagtcaggaggaatgaactatgattactcgtataagtatcacctatggcaccaagcaaattttatcaaagctccaaaatcgctatccagatagacaattgctgttactggattcttctgcctctggtgacaagcttgcactactagatgtttctggagaagaatcagtgtttagctcacccattcattatgacatcaaacttcaccgcgggacaactgattggcagggatttattaactttatctacattgataatttatctcctgacgatcaaaaagtctttaactcaaaagccaatcattttgttacaactgacccaatgccagaaggaatgcgttcaatctattttatgaaagaagaaaagaaccgttcaaataatatcctactttcaacttgggaagacgctgctgatttctctacttggaaacaggacagttcatttaaaccattcgtttatttcctaactggtcaaaataattatcatgaagctagctaccatttctttaaacccgaaaataagtaaccgtttatgatgatccatacgactatgaccgtgtggatcattttttaaatttaagaggagaattgacttgcaaaaccaagcaactgaaaaattatcaccatttaaaacgccgacacaagaacaaagtgagttaatcaatgacgctaaagatttcatctatgcacatcttcacgatgcaacgccagctgtctttgtgattactggcgatgctggtactggcaaaagcgtggttttaagtcagttattctaccaaattcagcaggccgcccatgataatactagcgacatggcaaacaccagtaactattttatggtgaatcacccagaactgctcaaagtttaccgtcatattgctggcgaattacctggattactcaagaaaaattttcaaaggccaacgtctttaatcaatcagatgaataagcaccacgaaacctttgacgtgggagtaatcgatgaatcacaccttttactatcccaaccagaccattacaataactactatggccataatcaattattatccttactaaaattatgtcacgttttggttattgtcttcgatgcccatcaagttttaagactaaaaacgtattggacgcaggaccggctaaaaaaattactagcaccgtacactcagcaatgggtccacttaaaccatcaatttcgcatgcaggctgataacagtttgatttcttgggttaatcacttcactggagataggatcttactaccattgcaaaagagttttcgtcatcattatgatttcagaattttctcagacgcagaagaaatgcgccaagcaatcgttagtcaaaataaacgtttggggctggccagaattgtttcaacaaccgggtacccttctactttagacggcggccagcattttattactgagggcagatttaaactaccatgggatcagtataattatacgtcaacgccttgggcagaaatcccccaaaccatcaacgaagttggttcaatttatacttgtcagggatttgaccttaactatgttgggctaattctaggccctgtggttaaattatcttctgatggacaaaaagtcgaaattgatactagtaagattactgatgttgagtcgtttaaacatcgaactgacatggccgatccccaagaaatcctaaacgctaaaatacaactaaacctcaacgctattaatgttttaatgaaacgtggtgtaaaaggcttgtatctgtttgcacacgatccagcattacgtacccggctttactctgaatatcagataattaaccactaaaaagggcattcacaagactcataccataaatgagttagtgaatgctttttagtgttaaaaaataaattctggttaaacaaaaaaaccgcccctaaggcgatcaacgtactggacggtccgtacgagactcgaactcgtgatctcctgcgtgacaggcaggcgtcctaaccagctagaccaacggaccattcgaattgcgggggctggatttgaaccaacgaccttcgggttatgagcccgacgagctaccagactgctccaccccgcgataatatgaaatttactaaaatgacccgtacgggattcgaacccatgttactgccgtgaaagggcggtgtcttaaccacttgaccaacgggtcatatctaaaataaaagaagcataacggagaaagagagattcgaactctcgcgccgctttcgcgacctacacccttagcaggggcgcctcttcagccacttgagtatttctccaatgggcctaaatggactcgaaccatcgacctcacgcttatcaggcgtgcgctctaaccagctgagctataggcccaaaaagcgggtaacgagaatcgaactcgcgacaacagcttggaaggctgtggttttaccactaaactatacccgcatggatcttctttgagcaatggcgcgggacggaatcgaaccgccgacacacggagcttcaatccgttgctctaccgactgagctaccgagccatataaacggtccgtacgagactcgaactcgtgatctcctgcgtgacaggcaggcgtcctaaccagctagaccaacggaccatacaattgcgggggctggatttgaaccaacgaccttcgggttatgagcccgacgagctaccagactgctccaccccgcgataataaggaggatgagagattcgaactctcgcgtggtttgacccacctgacggttttcaagaccgttcccttcagccagacttgggtaatcctccatgataaaactgtaaaaataatgatcacctataaggaccatatggaccttgtaggactcgaacctacgacaggacggttatgagccgtctgctctaaccaactgagctaaaggtccgagtcgaagatcaaatcgcggcgggggggatcgaaccctcgacctcccgggtatgaaccggacgctctagccagctgagctacaccgcgatggtgtttaaataaaactatctaaaaacttttatttaaatcgggaagacaggattcgaacctgcgaccccctggtcccaaaccaggtgctctaccaagctgagctacttcccgttcaaatgcacccagtaggagtcgaacctacaaccttctgattcgtagtcagacactctatccagttgcgctatgggtgcaaaatattaacataaaaaatgccgaggaccgggatcgaaccggtacggtcatcactgaccgcaggattttaagtcctgtgcgtctgccaattccgccaccccggcgtatatggcataagcggaagacgggattcgaacccgcgacccccaccatggcaaggtgatgttctaccactgaactacttccgcatattaagttgaaatgccgactagaagattcgaacttccgaccccctgtttacaagacaggtgctctaccaactgagctaagtcggcaacacaatagatatagtatcaaatctaacttttaatgtcaacatgaagattgacgctatgagccgtgacagtctcgaactgtcgaccctctgattaaaagtcagatgctctaccaactgagctaacggctcaatggaggatacagggctcgaacctgtgaccctctgcttgtaaggcagactctccaactgagctaatcctccataaatatagcgtggcaacgtcctacccttgcagggggcgacctcccccaactactctcggcgtactgaagcttaacttctgtgtcggcatgggaacaggtgtatccttcaggctatcgccaccaacttatgagatggtgtctcaaaactagacaatatcattttctttaccgatgaacaccactactgtggttaagtcctcgaccgattagtactatgtccgctccgtgcatcgctgcattccacttctagctatctacctgatcatctctcaggggtttatcttccatataggaatgggaaatctcatcttgaggcgagtttcacacttagatgctttcacgtttatctcatccaacatagctaccagcatgcgcctggcggaacaactgtacacccgcggttgtccattcggtcctctcgtaataggacagctcctctcaaatttcctcgcccgcggcggatagggaccgaactgtctcacgacgttctgaacccagctcgcgtaccgctttaatgggcgaacagccaacccttgggaccgactacagccccaggatgcgatgagccgacatcgaggtgccaaacctcccgtcgatgtggactcttggggggagatagcctgttatccccagggtagcttttatccgttgagcgaggcccttccatacggtaccccggatcactaagcccgactttcgtccctgtcgactgtctgtctcgcagtcaagctcccttgtgcctttacactctcgaatgatttccaaccattctgagggaacctttgggcgcctccgttacttttggaggcgaccgccccagtcaactcctacctgacactgtctccccacgtagtggtgcgggttagagtgtcaacacagggtgtatcccacacaatgcccccgaaaatagcgtccggtctacggctcctacctatctgtacaagcgtcaacactcaatatcaagctacagtaaagctccatggggtctttccgtcctgtcgcgggtaacctgctttcacaggtatatcaatttcaccgagtctctcgttgagaaagtgccagatcgttacgcctttcgtgcgggtcggaacttacccgacaaggaatttcgctaccttaggaccgttatagttacggccgccgtttactggggcttcaatttgagcttcgccgaagcgtaacatccttaaccttccagcacacgggcaggcgtcagcccctatactcatcttacgattttgcagaaacctgtgtttttgataaacagtcgcctggcgtgagcctatcactgcggctgcactgacgtgcagcacccccttctccgagagttacggggttcatttgccgagttccttaacgagagttcactcgctcaccttaggattctctcctcgactacctgtgtcggtttgcggtaggcaggttagattatcactagaagctttttcggcaggtggacatcgccacttcgctacttaaatttcgctccccatcacacttgttaccgttaaagcatttcatttactcaaagacttgctgcttggcacatatccaacagtctggtttgcttagcctctgcgtccctccatcgtcaaacaacttacttacaggaatatcaacctgttccatcgtctagcttcggcctccacttaggtcccgacttaccctgggaggacgagccttccccagaaaccttagtcattcgggggacagattctcacttgtctttcgctactcataccggcattctcacttctaagcgctccaccagctagtccttacgtctatattcgcccttagaacgctctcctatcacgcactattggatgcatccacaattcggtatcctagccccggtacattttcggcgcagaatcactcggctatgtgagctattacgcactctttaaatgttggctgcttctgagccaacatcctagtgtctagcaactccaccccttttccacttcgataattgggaccttaactgggtatgggctgttccctttgacgatggatcttatcactcaccgttgactccggaataaatcaatggcattcggagtttatctgaattcagtaacccgacgggcccctagtccaaacagtgctctacctccagattcttttccgagggtagccctaaagctatttcggagagaacagctatctccaagttcgtttggaatttcaccgctacccacacctcatcccagcacttttcaacgctacacgggttcgggcctccagtgcgttttaccgcaccttcaccctggacatgggtaggtcacctggtttcgggtctacaacaacatactaaacgccctttcagactcgctttctacggctccgttttcccacttaaccttgcatgaatcgtaactcgccggttcatttacaataggcacgcggtaccattaacgggctcccacttgtgtaggcacatggtttcaggaactatttcactcccttccggggtgcttttcacctttccccacctaggtactggttcactatcggtcactagggagtatttagccttgggagtggtcctccggattccgacggatttcacgtgttgccgccgtactcaggatccgctgggtgaacctttcgtctacgggttatcaccctccctgtatcttcccagacgttcgactctgttacttggtaactcaaatgttcagtcctacaacccaaagcaagctctggtttgggcttccccttcgctcgcgctacatgggaatcgcattgctttctcttcctgtggctacttagatgtttcagttccctcactctgcccttagctatgattcactaagataatacatcgactaagatgattgggtttccattcggaatctccggatcaaagttaagttacacccgaagcctatcggtgttagtcccgtccttcatcggctcctagtgcaaggattcaccatgcgcctttttaacttaacctcatcacttacgtgacggattattgagtattacgcgaagaagataaactttactaataaaaaactcaaaatacgcggttgggtgttctcggcttttaattaatgaataattgaatatacaagaaaattatattatctagttttcaaagaaccaattgagagtagacctctcaaaaactaacaacaagttgtctcgtgtgcagtttcgtattattccttagaaaggaggtgatccagccgcaggttctcctacggctaccttgttacgacttcaccctaatcatctggcccaccttaggcggtggctcccgaaggttacaaccgacttggggttcaaatctcaaggtgtgtgacgggcggtggtgtacaaggcccgggaacgtattcaccgcggcatgctgatccgcgagttactagcgattccgacttcgtgaggcgagttgcagcctcagtccgaactgagaaggctttaagagattagcttaccctcgcgagtttgcaaatcgttgtaccatccatgtgagcacgtgtgtagcccaggtcataaggggcatgatgattgacgtctccccaccttcctccggtttgtcaccggcagtctcccagagtgcccaactaaatgctggcaactgacaataagggttgcgctcgttgcgggacttaaaccaacatctcacgacacgagctgacgacagccatgaccacctgtatctgcgtccgaagggaacgtccatctcttaggttagcacagatgtcaagacctggtaaggttcttcgcgtagcttcgaattaaaccacatgcccaccgcttgtgcgggcccccgtcaattcctttgagtttcaaccttgcggtcgtactccccaggcggaatacttaatgcgttagctgcggcactgaagggcggaaaccctccaacacctagcattcatcgtttacgggcaaggctaccagggtatctaatcctgttcgctacccatgctttcgagcctcagcgtcagttacagaccagacacgccgccttcgccactggtgttcttccatatatctacgcatttcaccgctacacaatgggttccactgtcctcttctgcatcaagtctcccagtttcgatgcacttctccggttaagccgaaggctttcactcagacttaagaaaccgcctgcgctcgctttacgcccaataaatccggacaacgcttgcacacctacagtataccgcggcgctggcacgtagttagccgtggctttctggttaaataccgtcaacacctgaagcagttactctcagatggttcttcttcaacaacaggttttacgagccgaaacccttattccctcacgcggcgttgctccatcagactttcgtccattgtggaagattcccatgctgcctcccgtaggagttgggccgtttcagtcccaatgtggcgagattacctctcaggtcggctacgtatcattgccttggtgaaccttactccaccaaactagctaataccgcgggtccatccagaagtgatagccgaaaccatctttcaagctaaaaccatgcgtggttcattgttatacggtattagcacctgtttccaagtgtatccccgcttccgggcaggttacccacgtgttactcacccgttcgccactcatccatgctgacaatcagtgcaagcacttcaattcacgggaatgcgttcgacttgcatgtattaggcacgccgccagcgttcgctgagccaggatcaaactctcaatttatgattgttgtttgtgactcattaatattactagcgaaattgacttcgcaaattacatttgatatcaaccgaaattgatataccctgcacatttgtgaaacaaaactttgttcagttttcaaaggtctacattgttctgaatgactgatgaatatttaatcagtcaacttttaaatcatatcatccgagttaatttatgtcaagcaatatatttaaattgtttggcgctaagttatgttctcaaatgcaatgatatcaatctctgcaaacatctgcagaaacaacagaacttaattagtataacaatcgttgtgatataagtcaatcattaatttgaataaatatcaatcaacttgataaaacatactatgccaataaatcgtaactcctatacgttcatcttctcactgagaataactgtataattattcgacctactagcgtgtctgctttttaacaacgaatataatattaccaagatatgtaatctcggtcaagaagtattttactttttttgaaataaaaaagaatgatgcttttagacatcactcttctaaacgatcattatttaagttcgggtgcatccgtcttgtagtcagcggtggccttcccatggtttttagccattaaactcgttggttctgatttttgagcatcttttaattgctggatgccattagtgtatttgtaattaaacttagtcttatcaaccgatttaaagtcctttaattgatagaacctcagcaaatcaccttgaatgacccgatcagatagcgataactctgacgtaacgtggttttgctcacgtgctagggtcttcttttgagtcgcattaggcttaataacagcccccgtcttcgtatcgtaaacagtactaccctgtttgacaaactgtggcgtcacaaaatcaccatttctgaacgcaacggtttgactgcgattctttgccagtaaatcgttaccaaattgaatggtattattatccttcacgccaagtaagtccatcaatgttggcaagacatcgatttcaccaccatacgtgtgttgaataccacccttcaatccatccgcatgaatcatcagagggactttttggaactgtgccaaatcgtaactcgtaaccttcttcttaccaagcaattgtgcaatagcagcccgatggttatttgaaatgccataatgatccccatacaaaacaatcatactgtttttatataaaccagattgcttcatataagttaaaaactcaccaaaagcctcatccaaataatgtgcagtctgaacgtaaggatccaccgtcttatcacccgttttagttgcggggaaatcagtattttgcttatcaagttcatatggatagtgattggttagcgtaatcagcttagcataaaatggctgtggtaattgctgcaggtattttgcagagtcacggaaaaagatcttatctttcaggccataaccaactgtataatcagacttttccttatagtactgtgagctaaagaagtaatcatagccccatgacttataagtattgtcccgattccagaaactagggacatccccatggaatgctgcagaagtatagcccttttgacctagcatagctggcgctgcctgaaacgtattttgagtcccgtattcagtcatagccgacccttgtggtagcccaaacaatgagttttcaagcatcatctccgcatcagaagttttcccctgcgctacttgattatagaaattatcgtaactcaaggtgttctgatccttataaaacttattcaggttaggcgtaacttccttaccatccaccttgtaattaatcaagaattgctgaaagctttccaaatgaatgataatgacgtttttacccttttcagtaccaaaataagctggattatccccaacacggttgtgctttaaataattcttcacactttgaagatccccagcgttggcatgtgctcgcgttgaactttgtttttgcgtctgatacacactaaacgcagcgtactcattcaatccaagatacttaaccaagtaattattatcaaacgttctggtaagcaacccagaccggtccgcatttgccatgccatattcagcacccatcagcgaaaaagctaaaacggataccgttaacgcataccggcgcttaaacggccgactatcaacgcggataacgtgcgtcattaataaagcaatcagcaaaataacatccagatacacgaagaaatctgtcggatgaataatctgcccgacactctttcctaagttgttttgaacattaccagatcccttaataacgctaaacgtcataaaatcagagaattcacggtagtaaagaatgttagcaaagatccaggaagtctgaatcagatcaattaaaatcattagccagtagactaagcgtccacgaaagtataatgcaataccaaacagtaacagtgcagctggaatcgggttcacagcgagcaaaaactgttgcacgccacccttaacccctaaactaaactccgtctgatacgcgatatacgtcttgatacaaaataaaacaactactaggataaagaacccaaaaacggtattaagcttagcagttgtccgtttcacaaaatccgacataacatcgtgcctccaggttaaacttaacaaatgccattatatcgaatctccataaaatagcaatcttatccaaattactttgaaaaaacttcaaacttaaaatgatagctctagcttgatcacaagcgtattaatcactttacaaaaacaaaaactatggttccccatagtttttgttttaattatcagtaagtaattcaaacaattcaatcgcaatcaaatcaatgttatcaaactcaaaatgttccttggcttgatactcatccaaactatatgtttgtgtctccgggtgatagataacttgcgccatctcaacgccctctttttcaaaacgacgaggctgtggttcatcgccggcatcttcctgcattgctttaagtcgtttaataatgccgattaactgtgattcttccatgagaatcccctttccgaattcattttaacagtctaattctaccaaatcctgtagcagtaagcacgagtttttgtaaataacctgacaaattttaaacactgtggttcagacaacccaaaaggaggctaaatcagcctcctttttaaatgatttctatgcttctgaccgcaacgaatgatgcgattcttgaattcgcttgaacattttttccatgtcggtgtccgtaaagtgaatcagtactggacggccatgcggacagttaaacggattctccgccgtcttcaaatgttcaatcagtgccttagcttgctgatcgtccaaatgatgattagccttgatggcccgcttacagctcatcataatagccgtcttttctcgaaactgcgctacagttaggtgtccatcccgtaacacccagtcaaccatttctttaactgtatcagcttcctgacacgccttaaaccaggttggatgctgacgcagtataaaactgttaggaccaaattgttctaaatgcagccccactgaagctaaagtatccagtttatcagtaattttcaacatgtcacttgtactgtaatcaagtacgattggcaccagtaacctttgctgatcatcgctgacttcacctatggcttgacggtagtactcataattgactcgctcctgagcagcgtgctgatcaagaatataaagtccctcatccgattgtgcaagcagataagttccgtgaaattgaccgatgtaaatcaagttaggaaaacggtcctgctgatttaataattcggtttcctcagatttttgcttggttgttggcctattacctgctaccggttcgttgaacggtgtctgaggctgttgatacttctgctcaaacgctgatacttcaggagaattcagttcggctgtcgaatgaatcacaattggatgcgaggtgccatcagagggtttctgtgcaaacagcgctttattatcaatagtttcttcatcactagctgcttcatcgtcacccacccttagctgctcttcatgaggcctgaccgactgagtagtggccgggctcattgtctggacatcatgtgtggtcgaaactgcttctaagtcttgtgccactcgattagggtccacatgtccccgccgcaaattagtcagcccatctggtatcaaattttgctcactaagctttgctcgaatggcagcagtaattatgtcgactaattgaggttccttactgattcgaacctcctgcttagtcggatgaacattcacgtccactagcaatggatccatttcaaggttcaaaacagccaccggatagcgaccaaccatcaatttagagccatagccctcgacaatcgcttttgttagctgataatttttaatgtatcggccattaagtagaatcgtcatgtaattacggcttgctcgcgtcagctcaggtagtgaaacataaccactaattttaaaatcagcatccgcattttcaattaaaagcattttttctgctttgttcatcccgtaaatactgccaatcacctgccgcaaatctccccggccagctgttctcagtaactcacgattattgtgagtcaatgaaatttgaatctgaggatggcctaaagctagtcgattaacgatatcaacaattttagaaagttccgtattcagcgatttcatgtacttcaaccgtgctggtacgttataaaacaaatctttaacgataatatctgttccgcgacgcgcttctgctggcttctgagagatcactttgccaccagaaatgtgaatggcttgaccctcaccaccagtggacgtcaccatttccacatccgcgatagaagcaatacttggcagcgcctcaccacggaagcctaaagaatgcactttaaataggtctttacggtcaactatcttactggtagcgtgccggtgaaaagccagttccagctgatcagcatcgataccgctaccgtcatcgatcacttcgatcgactttagtccagcctcatcgactataatgtcgatttcatgactgccggcatcaattgcattttctaccaactctttcacgactgaagcaggccgttcaatgacttcaccagctgatatttggtttgccaataccgccggaagttcatggattgctgccattttatcacctcattaccgttttttcttggactgctctaactgctgttgccatttataaacctggttcatcacatccattggtgtcattcccatcaaattcagtgatttaacctggaaagctactttatcagccttagataccttttgctccggttcaccaaacaaggacagttgggtatccgcttcttcatcactagtttgtggagcaggttccgttggctgcggctcaggttcaaccgttcgatcttcagtagtgacttgaactgtactatgttgatcctgagttttttctaagtgagtcagaatcgtgtctgcccgtttcagcaatgaatctggcaaacccgctaacttggcaacgtggatcccatatgatttgtcagctgggccatcttgcatttgatgtaagaaaactagctcaccgttcttttccacagcaccaacgtgaacgtttttcagatgtgtcaaactcttatctaacaccgttagttcatgataatgtgtcgaaaatagcgttttagcatgaacccgatcgtgaacaaactcaataattgcctgagccaatgccatcccatcgtaggtcgcggttccccggccaatttcatcaaataaaatcagtgaattagcagttgcgtgggaaagcgcttcgttagcttccttcatttccaccataaaagtactttcacccgaaatcaaatcatccgcagcaccaattcgcgtgaagatctggtcaaaaatgggcattttggctgacttagccggaacaaagcagcccatttgtgccaggataaccgttaaagccaactgtcgcatataagtactcttaccggacatattaggcccggtaatgagcaaaatagacgttgcctccggcatcttaacatcattagggacataagtttgacgacccagcactttttcaactactgggtgccgtccttcaacgatttccaaatcatgatctgactgggtgaacgtcggtgctacaaaccggtatttctcactgacgtcagcaaagctttgtaatacgtccagttctgaaactgcatgcgctaagctttgaattcgctggatattggctttaactagttcgcgaaccttaacaaacagcttgtactctaaatcagtggacttttcttcagcttcaagtatcaaccgttctttttctttcaattcaggcgtggtaaaccgctctgaattagttaaggtctgtttacgttcataacgaccttctggcaacttgttcaagttagctttcgtcacgtcaatgtaataaccaaaaacccggttatacccaattttcaggttattgattccagtaatttggcgttctgaggcctcaagttcggccatccactgcttaccgttatgcatggcttcacgataggaatccaacgttttgtcataaccgtctttgatgaccccaccatccgttacagatagcggtggttcattcacaatcgcagaatcaatggcttcagtgacattatcgattggatccaaacgcttatagatatcactgaacgccgattccggcagttcatttaaaatatgctgaagcttgggaatctgttgtaaagatgacttcaactgaatcaaatcacggccatttacactgccaaaagccactcgaccagccagtcgttccaaatcgtaaacctgtgtcagctcttcttgcaaactatttcgctcaaaatactggtcaactaacacgctaacctttttttgacgcgctaaaatatcgttgcgtttcactaatggccgatccaaccactgctttaacaggcgaccgcccatggccgttttagtttcatccagtagccacaacagcgtcccgctctttttgccggtacgcatattctgtatcagctccaaatttcgctgagaatagtggtccattttcaaaaagaaggttggtttgtaaataattgcccgctgtaaatgtgctaaactccgcttttgggtggtgacaatataagttaacaggtgctgtaagacggttaactgctccgttgcttccacgccctgtgtcaaataactgagttcagatttcacctcagcttcgtcctgatgagaaatcagaatgccaaccgttgtcagtttctcgagaacatcatcagaaactgacttatccacaacggtttccttggtttgcaaactcatcacttcgtttaataccgaatcaaaactatccagtgaagttacctttaactcaccagtagataagtcagcataggcaaacccaaacttctgattgatttgagtaagtgccgtcaaatagttgttttctttcgcattgccagcgcccgtatcggtctgagtccctggggtgactaactgaatcacctctcgcttaaccattcctttggctagtttagggtcctccatctgttcacaaatggctactttatagcctttatccactaaaatatcaatgtagttttgaacagcatgatgcggcacaccacacattgggattgggtttttagagctgtgattacgagtcgtcagcgttaattctaatagttgagcgcctttgatggcgtcatcgttaaacatttcgtaaaagtcacccaaacggtaaaataaaaaagcgtctgggtactgatctttaattttttgatactgaaccatcatcggcgtttgattcggtttcgccaatttttccacctctacttcatttcctacaaattaacgatcatatggatgatcatcatcaattaacactgatttgattttagttgcgtgaccagtttcatcattaatgtcaatgacgcaaccagacatgattccgggttcactagtctccacttcatatctggctggccgttgattaaggaaccgtgagatcacactagctggctgcatgcctaaaattccagcagatgggcctgtcatgccagcgtcactcataaacgcagtctgatgatcgatcacttgcgcatcattggtttgcacgtgggtatgagtgccgacaacggctgaaacccgccccttcaaatacagtgcaattgctcttttttcactggtaacttccccgtgaaaatcaacaaaaatcactggtgtttcttttctaatctcagtcactaacttatccgcaacagcaaatggatcatccagcggcggtaaaaatacacgaccttgcaaattgatgacagcaagtgtcgcctgattaacttttaatttcgtccaaccgcgacctggtacgtcttcgcctggaaagttagctggtcggaccaacttagtcgtatcatcgatgaaatcgtaaatttccttattatcccacgtatgattacccatggtgacaacatcggcaccacttgccaacaactgtttataaattttttgactgatcccgcgacctacaggagttgaattttcaccgttcacaatcgttgcttgaggctttaaatcacgtttcaattgaggtaaataagtttgaatcatttggacgccacgatcaccgacaacgtctccgataaataatatccgcatgttgatcctctaatctatttttagtatgttgcaacacgttttagtttaacacattagcgatataaaaaagcaccctcaagcaccgttgccagctcttaaggatacttttattttttgtgctaaattaattatttagcatacgctactgaccgaacttcacgaataacggaaaccttgacgtgaccaggataatccatgtcactctcaattttttctttaatatcgtgagccaatgcaacagcgtccaaatctgaaattttttctggtttaacgattacgcgaacttcgcgccctgcttgaatggcgaatgacttcttaacgccgtcaaattcatcagcaatcgtttctagcttttctaaccggtgaatatagctttcaagtgaatcgcttcgtgcacctggtctagaagccgagatcgtattagcagctgacactatttcagaaatcacatagtgaggcgttgctgttgactcgtgagctgcgattgagtcaatgacaaccgggctttctttgtacttcttagctaaatcgattccaatctgaacgtgagactcttcaacgtcattttcaaccgctttaccaatgtcgtgtaataatcctgcgcgttttgctagcgtgacatcctcacctaactcagcggcaaaaattcctgataatttagcaacttcaatagcatgcgttaaaacattttgaccatacgagatccggtaattcatctgaccaaccagcttaatcaatgctggatgcatcgaatgaataccaaggtcaaatacagtttgttctccaagatcttgaatcttctcatccaattctttgcgagccttttcaaccatctcttcaatccgagctgggtgaatccgaccatcttgaatgagtttctccaacgcgatcttagcaacttctcgacgaattgggtcaaacccacttaaaacaactgcttccggagtatcatcaataatcagatcaatacccgtaagcgtttctagggttctgatgtttcggccttcacgaccaataatacgccccttcatgtcatcattagggagtgtgacaaccgacactgtggtatcagataccatgtcggccccacttcgttgaatcgcttgaacgattaattcctttgctttcgagtccgcttctttagcggccttttcattggattccttaatcatcttagcgcgttcggaacttaacgcttgctttgcttcattaataatcagggactgtgcttcctctttggaaagcgcagctgcttcttcaacagctgcttgccgtttctcaacaagtgagtccgcctgctgttgtaatttagctagtttttgctgttcagaactcaacttattttccttgcgttctaaaacatcttcccgcttttgaaaagcgttatctttacgatcaagcgcttcttctcgctgtaaaactcgatcctcttgtttttggacttctccgcgttgccgcttcaaatccttttcaacatcggcccgatagcgatgaccttcctctttggcttcaagcaaagcctctttggtatcagtctcagcctgctttttcgcatcagctaaaatgccttgtgctgtttcgtgtgctgcgtccaaattgcgttcaacaattgacttatggacaaagtatccgatgacagcacccacaacgatagcgatgattgcgaggattatttcaggaatacccatgattccacctccgcatcatcaaaatttttgattgctaaatcagtaaatttttagatgtaaattgattattgacacaactaatattctaatgttaagtcgcaacgctgtcaataaaagagtggctaacggtggtcaagaagcccgtttattagaatataatggcaaaataagccatttaaattcaaagctatattatttgcacctgataaaacaaaaaatctaggagtaactctcccagatttttatattaatcattatgcttttgtaggtttgtttttaggggcttttgaatccttattatccttgttatctttggcatcaaggtctaaagtttcaacattcttttcatctaccggttgttctgaatcatcttcggtagtgccgtccatgttataagctttacgcaccttggctttgatctccgccatggtatcaggatgttcggcaagataagccttggcattctcacgtccctgaccaatccgatcatcgccgtacgaataccatgaaccagacttattgacaatatctttgtcaaccgccatgtccactagctcgccggtctgtgaaataccagtcccgtacatgatatcaacttcggcacgtttgaatggcggcgctaccttgttcttaaccactttaatccgaacacggttaccgataatatcggttccctccttgatttgctctgcgcgccgaacttccaaacgaatcgttgcgtagaatttaagggcccggccaccaggagtggtttctgggttaccaaacattacaccaactttttcacgaatttggttaatgaaaatcgcaattgttttggtcttgttaatcgatcctgataatttacgaagcgcctgtgacattaaccgcgcttgtaacccaacgtgggcgtcccccatctcaccgtcaatttcggcacgaggaactaaggcagcaacggaatcgacaacgatcatgtcaacagcaccacttgccacaagtgcatccgcaatttctagaccctgttcgccagtatcgggttgtgaaagcagcaaatcatcgatgttaacacctaaatgagtggcataggctggatccagtgcattttcggcatcaatgtaagctgcagttccaccgttcttctgaacttcagctaccgcgtgtaatgccacggtagttttcccagaactttctggaccgtaaacttccacgattctaccgcgagggtagccaccaacacctaatgcattatctagtgctagcgacccactggaaatcgttgagatctgagtatcagctttatcacccattcgcatgatagaacctttaccaaagtttttttcaattttctttaatgcagcatctaacgctgcttgccgttcgtcagccatgtagttcctccttagtagccatttgcaaattaaactatacctttcttaacactaaattgcaagcaaaaatagaacaaaggttcgtattttaattgaccgctaatctttgccgaatgagatctaatccagccattaccgaacgtgctcgaatctgctgacgaccattagtaaagcggtacaaataagcctttggctcctcatcccgatatgcaatgccaatccacacagtcccagcaggttgcccttcaagctcatcaggacctgctacaccagtaaaggaaacggcaatgtcagtctgcatttttgcccgtgcttgtttggccatccaaatagcagtcgcttcgctaaccacgccttgcgaatcaattacatcagacgggatcgaaagcaactgatgtttggcttcgttcgcatacgtcacaaatccgcctggaaaaacggctgaaacaccgggaacacttccaatcgtgctttggaattcaccggcagttagactctctgctgctgttattgaaagtttacggtcgataagttgattaacaaccacgtttgcaagtgaattatcatccccatagccataaaaatactgtccgtcacgagcgagtatcttatcgactgtgtcttgtatcaaagtttcagcctgatcttcgttcgctgctgaagcagtcacacgaagcgtcacctctgccatttttgcgtatggtgcaattgttgggttcgtctggtgatcgatcaaatcggacagatcatccaccagcttggattctccgatcccgataaaacgcatcactctagaagtaaatacgtgactctgttgcccacgtttttttagttgtggaattaattctcgatcaatcatcattatgcactcagctggcggacctggtaataacacatagcctgtgccatggtggctcaaataaaggtcacccacagcgaaaccgttatgattagtgaggctgattgcgttttggattttcaatgcctgtttcgcattattaggtgttaagtttttgccagtctttgcagcgtattcatcaattttcttctttgcgtccgtatccgtcactaatggctcttccaaatgtcgtgcgacgatttgcttcgtcaaatcatcttcagtaggacctagaccaccaattgttagtactaaatcactacggttttcagccattcttaggacactctcaagccgtttaggattatcccccaccactgtttgataataaacgttaaccccaatttcagccagtttttgagcgagataagccccgttagtattagcaatctggccaagcaataactccgtacctacagcaataatttcggcattcatccatgcattcctcctgtcgtttctagtaaaaaagggtcactctcatctaaagagtacacccttttctttttagtcgttaaatgaatctgcaaaaacgcttcggttcttaacgaaataatcaattcctgagtaaatcgtaaagaataagcaaacatagagcaaaattgtccccaatgggaaatgccagttagcaaacagcacattgttcaataataataaaataatactaaacatctgtgacgttgttttgatcttgccaggccaagctgcagccatgacccgaccgttattttcaacgataatcaagcgtaaccccgtcactgctaattcccggcaaacgataattgccacgacccaagccggtgccatgcccatttgaacaagcaaaacaaaggctgtcatgacaagcattttatctgctaacggatcagcaaatttaccgaagttagtcaccaaatgtcctcgacgagcgatttgaccatccaaaaagtcagtaattgaggcaacggcaaaaataatcgccgctacaatctgagtgaccggaattctcgtagacaaccagacaactgatccccagttcattggtaccgccagaataatcagaaagattggaatcagaataatccgaccaattgttaatttattaggtaagttcacggtgttccctccaaatacgtctttctcaagaaaaggcaagccagtcagcttacctttttttgattacttaaattgtacggtgatattttgaacctgagatgtcgttgttgacgatgcggaactagcggtaccggcagtcgaacctgtcgtcgaagatgcattcgttgacgaagcagtggttgctgaactcgtagccgttgagattggtaatgttttaccaccaatcgtaatcttagtctccggtgcattgcctaaattcaacgttacagaagttgcagttgcactcaccttaacgctttgggtcttggcagcagtcaccgtgccctggaaggcagaagtccctgcagaagtaacggatacccacgcattatttgacgttttgatcttaatcgttttgtcttttggcgcgttcttcatcgtataagtcgtcgcatttcctgaagtcgaaaccttactgaaactggcttttgagaccttcttagaagatgagttggtcttcttgctggaagccttagctgaagagctagacttagcagcactgccagaaaccgaaactgaactgctatccacgttttgagctttattgctggactgcgaacttctagtcgtcgccaaccaaattccaatcagcactgcgacaaccacaataacggcagcaacaatcgggacttgacgcttaatcttagccgctcgatcatccactttacgttgtgcagaacgagtagatggattgtcttcattaacccgatccacgtattcctgtgttttcgtacttggtagctgatcactatattcatcaagcaactcgttcccgtctaaaccaacggtctgagcgtactgcttaataaatgcacgaacgtagaaatcacctggtaaatctgagaaattaccgtcttcaattgcaatcaggtaccgcttttgaatttttgtcgtctgctgaaggtcatccagggtataacccttagcgatccgggcgtcacgtaaagtttcgccaattgacttagtattttcactcataaatttttctccacctataacctataaagtcttattatttcagtcttagtatagcatacgtcagaccatgatttaacgatgaattcaagtctgacaactttttaagcctttcttaatgacccgaaacgatttcttgaacactgatactagccgtccgaataaattgttgcatcgtcgaaataacatcgctcatggtcagtgccttaaccacaccaacttcatcaaataaatttgcctcaccatacagccgatcatcaaattgatttgcgattgcttctagtgaattaaacgatgataacgtgctaccgatagcctcccgctgaacggcttcaaaccggtcaccagcagctgctagcttatcgtcagcatgctgcaaaatatcacttaatgcattctcaaaggcagcaggatcatccgcttcacccgccataatcacgtggtgggcaccacgctgcagttcaatattataaccaaaactgtcatctataatgccctgatcatacaatgacaagaagtctggcgcggtttcacctaataggagcgtaaagcctaatgataatgcgtcctcgtacttaagccgctcaatgcctactggcagcttgtccatgccacggattccaatagtgactttaggccgttcaaccggcatcactaattgtttatgttcaataatttggtccgaaaatggtggcagaatgcgcctaataggcgctggttcagcaaactgtttagctgtctgattactcttgatccatgctaacgtttctgatggttctaatcggccaactacgaacaaactcatgttgctaggatgatagaacgtctgatgagctaaataaaggtcatcaggagtgattttagcaatagattcaatcgttccggcaatatcatcagctaatggctgattaggataaaggttagcaattgttccaaaataagcccgagaattaggatcatcctcatacatttgaatctcttggccaatgatgcccttttctttattaaccgtcttatccgtaaaataaggatcctgaacaaaatcaagtagcgtttctagattttctttcaaatgatgcgtggcagaaaacaaataactcgtatgggtgaaactggtaaacgcattggaactgccaccaaagtgcgcaaacgtatcaaacgcgtcgtgatcagctttctcaaacattttgtgctcaagaaaatgtgcaattcctgcaggctgcgtcactggttctgtcccatttagtggtacaaacgactggtcgattgacccataatctgtggtcatcaccgcataagttttgtgaaaacctgctttaggtaataaataaacgcgtaaaccattatctaacgtttctgaatagagcgtctcgcctaaatccgaataatgtcgctgtttcacttggcgtcctctcccttcaaaaaataagttgcctgaagatgaacttgtttagcaatcatcgctacgtcttccttagtcacttgcttaattcgtttaacccattcagctgcactgacgctgctatgaagcagctgatccagcatcacttgattgaccaaggcgcgctgagaatccaaacgcgattccctgccattaatcaaactagcaacaacttgattaaaaacttcatcactaaactgtccgttagcgatggcatcaagttgctgagcaataatcgtcttcactgcagcttcattagactggtcaattcccgtttgcacaagcagtgtaccggtaaaaccatcaaatcggctagaggcgtagtaagctaagctattcttctcccgaacgttcttaaataacattgaaatcggcgttccaccaaataagccgttgaacaccaaggctttataaaaatcagcgtcacggtaataaaccggcagtttgtatgccatattcagctttgattgctgcaaaggctggccttcagtcttcgatacgatttcggtctcaggacgacgataaatcaattcagatgtctgaacttgccgatctttaagctgccagtttgttaaggcagcaactaaatcagcttccgaaacatcacctgcaactgtgatctgaacctggttagtcgctagtaagtgctgataaatcgcataaagattgtgtgcagtaataccgttaatcgtttctgcatcaccataaagactagtggcaaaaaaaggctcatttttaaaataaagctgactgagttgctgttcagcatagtactgcttgtcgtcatttaacgactttaaataagccagtaaattttgtttctgacgagcaaacgttactgtttcgaaggcatcatcgttaatcaatggccgatagataacactgtgtaagaagtttaccatctcattaagcagcgattcaccgccgataaaatggtcattaataatagtacttgaaaagcgcaacccttcctgcaacccataacgaaaaacattcacgccgtagcttgcaccatacatcatggaaagtttctgcgctaatgaagtttgcgttgggtagtcagcactgctggtttccagtagctgagctaataaaattcggttggatagctcccgtacgttgccaggcgcgataaaatcaaccgtcatactaatcgttttgaattgggtcgttggaatgacgtttaaccaaacgccctttgctaattgctttggcaaatttagccctcctttggatattaccaaaccatattagatgatttacaactaaaacaccacccttttgaattgaaaaataaaataaattaacaaaaaatttcggtgaatttaacagtggttaactttcacgacacaacttgccttttaaccaacttctttgctattcttaatgttaaattaagcctgtaggaggaattatattataatgaaagtcgtgaagttcggaggaagttccttagctaactccactcaagtcagcaaagtcgttcacattattaaagccgataatcagcgtcgtttcgtgatcgtctcagcaccaggtaaacgttttgctggtgatatcaaagtgactgatctcctgattcaatacgccaacgctactttaaaaggtgaacctagtgacactattactgggcaaataatcgcgcgttatgaagaaattgccaccgccttcaacattccccaagcagcgttcgaccagatcaaaacaactatcttgaacttaccccatcaagaatatcaagatgatggttacctaatggcagcctttaaagctcatggtgaaaaaatgaacgccatgctgattgctcaagtactgaaagcttccggaattaatgccaagtttctggaccccaaagatgccggtttagtcgttaccgattcgccagatgacgctgaaattatccccagtagctatgaacgtatcagcgaatggtcagatagcaagctagtccgtgttattcccggcttttttggatacaacgatcagggtcagatttgcaccttttcccgtggcggttctgacattactggcgccatcattgctcgcggcgttcatgcgaaacgttacgaaaacttcactgacgtcgatgccatttacgccgctaatccacaggttgtccaccatccgattgccattcacaatatgacgttccgagaaatgcgggaactttcctacgctgggttttcagtttttcacgatgaagcattgattccagccattcaaggagatattcaagtggttgtcaaaaacaccaaccatcccagtgaacgtggcacgtcaattacctctcacaagcgggtcaatccagcttatccagtatcaggaattgccagctcaccaaatttttgcggtatttatatccgaaagtatatgttagataaaaagcgcttttcacaaaaaatactcaaactgctggcagaatacgatctttcgtacgaacatatgccttcagggatcgatgatttaacggtcatcatgcgacaagatcagctaacgcctgaactggaagacactttaattcgtgaactggtcatcgctttacggccagacgagattcatatttctcacaactatgctttactgatggtggttggtgaaggaatggcaaaccggactggaatcatgtcaaaagcaactgatgccttggcacgtcaaaacgttaagttaatcatggtgaaccagggtgcttctgaaatttcaatgatgtttggcattaaacaagatgaggctaaagttgccatcaaggctttgtacgacactttcttcccagatttataaacaacaaaaaatcgcccagtacttcgtaaagtaccggacgatttttagtttgcgtttatttattatttaacaatggtgaatcagcactattaccaaaccacttatggttgattttagctaacgtaccgtttttagctaagattttcagcccacgattgatcttgttacgcatagttgtatccgttttacgcatcccaacaccgaactgctctttaggaaatgaaccgttggtgattttatagtctttcggattactttcgtgattaatgtagtagcccgcgtacgtagaatcaatgatcattccttgaattcgattagcgttcaaatcaatgaatgcgtttgtaaatgagtcatataggacgggggagttacccttaatccggttcttcagcatcttagggtattgactgatatcctgagcacccgatgaaccagcttgagcacccaatgtcttaccctgcatatctgcaaaggaattgatgtgattctttctcagggaaactaaggtttgatcattttgcaggtacgtatcactgaaggcgactttcttttcacgttgaggtgtcttagaatagccgttccaaataagatcaatggtcccgttattcaattcagtggcattcatcgaccagtcgattgactggaaactgaccttgataccataaagtttgaacacagcccgagctaagtcaacatcataaccaaccagcttgccactcttttgccggaagcccatgggcacgaaagtatcatccaaaccaaccgttacgaaaccacgtttttgtatccggtcccagttatccacgtggttggctcgcttaccaacactgaccccgctgcaaccagacagtagtgagacggtgcagaccagcatgatcagacaaagccaaattttcttcatgctttttttcatgctttattcccccccactaagctttaattggttcaacacgaacaatttgatcagcaatgttttcggcaaattgcatatcatgagtaacaacgatttgcgtcatgttatcctttttcaaaccaagaataatattttcaaccgtttgccgtaaatcaggatccaacgcgctggtaggttcatcatagcaaaggatcttaggattcatcgctaacgccctcacaatagcaactcgttgcttttgaccaccggataactggtaaggatataagctttccttgccggtcaagttaagttgatcaatcagctcttgtgcccgcttctcagcttccgttttcgactgttttaacactaattgcggtgctaaggtaatgttatctaaaaccgttaaattaggaaagagctgaaagtcttggaaaacaacaccgataacgttgtcattatcgcggttattggctggatcaaacgtctttccgtccaaaataaatgatcctgaattggtcttttccaacccactaatacaacgtaacagggtggttttaccagctcctgaaggtcctacgatagcggtaatctgatcatccggcacctgcatgttgaaattatctaaaatggtgcggccaccgaattgttttttaatatttttaagttctagcatatccgtttcccctctctagcttatcgccatgcctggtagtgctgttcaactttacgtaaaacaaaggtggcaacagcagtcatcagtaggtagatcacaccgactaagactaatggtaataacgtaacatctctagcagtcgcaacgttgccggcacggagcagatcgcccaatccaataacgtaaaccagtgatgaatccttgatcaaattaatcgtttcattcccaattgaaggaacaacaatcttgatcacttgtggaataacgatcttgcgaagtgtttgtccacgggtcaaacgcagcacccgcgcactttcatactggccttgatcaatagcttgaaaaccaccacggaagatttcagcgaagtaggctgtgtaattcaaaatgaaagcgaacaacgcagcgtcataacgttgaaagatgaccccaatgatcggcagcccataaaaaacgaaaattaattgcagtaacagtggcgtgcctcgcattagccaaacgtaaaatttcaagatccaacgaagtggtgcaatccttgacgttaaccctaaactagctagaatccctaatggaattgaagcaattaatgtccagaagaaaattttgatggtcatccaggcaccactcagtaacgatggtaatatttcagatacataatgcataatgactcccccttcttaattaaaaaagccctcttgaactaatcaatagtccaagagggcgacaatatcgcggttccacctctaatttgattactgtttacacagcaatcctcacaaagtttattaatgaaattaaaaagtcctcttagcaattaagctaagaggacgataatttcgcggttccacctctgattcgctgactgttcacacagccaacctcagtaagtttatataataaacttcagcgataacgagcttaccggagctcccctacttcgttcagagagtcaactcccagatgtgattcaccaagcttagttacccggttctcacctgcgcgggttctctgattaactaaacttaactactagtctgatcaacgtttgttttattagattagttctcattatatcttaaatatattccttgtcaactctcattgagtaaattgcaccgcgaagtctactttgaactgttagccacgggaaaaccagtgactaatttttgaccaaaaactcgttttcggttgttgaattttcatcaatggtaccgtctcaccctccaaacggcgagcgatatcacgataaccgcgaccggccggattctcagattcgagaacaatgggctcaccccggttagaggtagcaatcacttcatcatcatccagcacgattcccaatagcggaacacccaggtgatgcgtaatttcatcaacatccattgcttcgccatcagccatcatatgcccgcgaatgcggttaataatcaagtgtgactcttccttcaacgggttcttctctaatagaccaaccacgcgatcagcatcacgcaccgctgaaatctctggcgtcgtgacaatgattgcggcatccgcgccagcaattgcgttaagaaagccctgttcaattccggcaggacaatcaattaggacataatcaaattctttcttcaattcatccacaatcgccttggcctgatcttctgtaagcgcggttttgtccgtgttctgtgcagctggcagtagatataacaaatcatcaaaacgcttgtctttaattaaggcctgtgctaactttgcacgcccttccacaacgtcgacgatatcaaaaataatgcgattatctaaaccaagtacaacgtccaagtttctaagtccaatatctaaatctactaagcaaactcgcttacccattaacgcaagggcggtgccaatattggcactggaagttgttttgccgacaccccctttaccagaggtgattacaattgattttcccatcttcgttagcctcccattcggtgataaatctttggattaatcgtttttaaatcgcttaactggccgtattccaatacgtgtagatcgttgacgtatgcaacagtctgactgccctttgaaggctgatcagtctccacaatgctgatttgttcaccaatgcgaatctgctgtgcgtgttgcaaatcaccaatcaccactttgtcttcaccactgggatagccggcttgcaaaatgcctaaaaccgttcccatgacgtagatattacccgtggttagcaatcggccaccttcattgattaatcccagatacaaaacatcgcccttcatctccagcgtctgcccattacgaatggtctgagttgccagatgaacgttgtcctgctcttttaaatgaatggcatcttcaatggtgatgacgtcaggaatcaccttatgaatctgaaaatgatcaaactcactaaaaatttgttccaactgttggttctgctcagcagtcaataatctttgattgctgagtacgtcaaaactaatttgattggtggcattggaatcggcagctaaattatcaagaagttccctaagcttctccttgatttctttaaaactagcagcctgatccaacacaagttgataaccatcctgattgccacgtaacactacagcttgcatacttccgacccctttttaattcctcaaacgattgaataaccattgaactggaaaatatagtatgacgtaagcagccaaattataagctaacgttggtgctaacgaatcaaccatcatatccgtgaacgatgcagaagtcatatgaaccactaaattaccgaaataactgagactgcaaaccacggtgatgtcgataaaataaaccagtaaaccacttaaaaagttaattggaaaagctttataacacgctctcgtcaaggcaaccacaattggaaatacaaatataaagatgccccaaacacccgtgtaataaacatcaaataggccaccggcaatggccgcccaaatacccagcggaatctgaatttgatcttcaaagaaaacagcaaatactaaccacagtacaaccaaatagctgctcatcgcatatggttcactaaataattgccgtggaaatgctgcccctaaaatcccgtctaagtagaaaaacaggaacaacccaatcggaaagccgtaacgtaatttagttactcgtaccataattgcctccttaattggttgtttgtgcttgtcgaacggctacagtgacaacatttaattcagaaaggtcagtggctggtttaatcgaaattttagctgccaaaccgtaattatccgttccggtacttgcaacagtacccacaaacaagccagacggcatcacaccgccaagaccactagttgaaactttgtcgcccttttcaatctttgtcttggacgtcacattgcccatctcaataaggttcttatcacgattatagcctgaaataatgccatgaacactttgaccattcttattcgtaatcgtcactgcaaaacggttagcagattcgctgctgtttgaaagcagttcgactttactattcgtccggttaacctcagagattcgaccaacaataccagaacctgacagcactggcatgtttttcttgattccagccgcactacccttgtcaataatcacttgattctgccatgcagatggtgtccgcgcaatgacgtttgcattaactggtgtgtaatctgttaaggagtggtttaacttaagttcttgctttaactttttgttttcttgactaatcgcttgatcatgaactttagtctgtgccagttcttggacctgactctttagccgttgattttcctgataagtattcatcagatcagaaaaacccgtgaccgatccctttaggccactaacaggccaggcaacgactcggtttactaaacccacgacatcgttaccaaactgttgaaccataggtggtgtcgaacgcttgttacgaatggcaacagaaacactcattaacccaaaactgacaattagacaaataatcacaatcaccaatcgtcggtttgaaaagaatttatgcatgattgtcctccagtgattggagagtgagccaatatatggactcgttctctttttacattaaatattaaaaagtgcgacatttttctgaatacctgtaagtaaataattccgtatgttctgaatatgaacatacggaattatttgcttacacggctggaggtgttcctaattgctagatactaataataccgtattcaacgattatccagaaccaatgcctcactcccgaatgctatttctttttcataacgtcgatacttttaagtgattcaccagtaccgatagcgacgcaatcaagcgggtcgttagcaataaacactggtaccttagtcgcatctgcgatgacatctggtaagttatgcaataaagcaccaccaccagtgagaacaatcccatgatcgataacatcggctgcgatttcaggcgaagtctcttcaagtgtttcctttaccgcattaataatttcttcaactgattcgtgaatagcttctgcgatgtcaacagctgaaacatcgatcgtcttaggtagaccagtaatgaggtcacgtcctctaatagaagcaccatcgtcagccttaacagcttcttttgaagcagaaccaatatcccacttcaactgttcagcggtccgttcaccaatcagtaaattgaaatgttgacggacataagccacgattgcttcatctaatttatcgccagccatccgaattgaacggcttgacacgataccaccaagtgaaatggtagcaacgtcagtagtcccgccaccaatatcaacaaccatactaccagttggatccataacgggaagtcccgcaccaatagctgcagcaaatggttcttcaagtacgtatgcatcacgcgcaccagcgacccgggtagcgtcaataacggcccgcttttcaacttcagtaacaccgctaggcacacaaaccatgacgtaaggcttgccgtttgagctgcctaacgtcttttgaatgtaatacttcatcattgcaacggttgtatcataatcagcgataacgccgtctttcattggccgaatggcaacgatacttgctggtgtccgtccaatcattgctcttgcatcttcaccgactgagacaatctcgccggtcttcgaattcttggcaacaactgaaggttcacgcaagacgataccttttccgtctacgtaaacgatcgtgttagctgtcccaagatcgataccaatgtttttagttcctaatccgaacaatctgtttcatcccttcatttagccacaaccacttgtttgattgcttgttaatttgctaggtgttattataccatacctcaaaaatttaataactactcgccgattaaaagcataaccaattaaggggcaatctggcaagcattaatttgttatttaaaagaaattaaatattacatatataacaaccctaaatcagggctgtttaaagaacgcacgaacgtcagaaatgaagtatagcgaccccgtgatcaaaaataaatcttcagccgacatccgctgagagatggtcccaattgctaactgccagttgtctataacctcgatgcgctggtcatcttgatactgagcagctaactcttcgggatccgtaactgcacgacttcccggcccctgaaaggtcgttaaaacaatgtgcagattaggtaccgtgcgcaacgtagccaacatcttgtcatgctgcttatcagcaagcacgccaaacagaatatagatctcattatcgtgaaaacgctgctttaataaagccgtcagctcttctacggctggttcattatgggcgccatcaataacgaccagaggatcctgattaatgggttcaaagcggccagcccagaccgttttagctaacgaagaaacagcctccgagcggctaacagcttgttttttctgggcttgatacagaataaacgcggttaaagcgcagctcgcattgtccacctgataatcgcccagcatactaatttttagtcctttaaacaagtagtcgccaaagtgatagtcgaacttttcctgccaacctgcttccgatttaatcttaacggtgatttcttgccccagccgatatagtgggctcttatttgcagtagccgttttttcaaccacttgcattgccgactgtggtagtcgtccagccacaactggcacatcaggtttaataatgccggccttttgtgcagctattttcggcaaggtattccctaacagcttcatatggtcgaacccaatcgtagtaatcaccgaaacggcaggtgtaaatacgttggttgaatctagtaagccgccaatgccgacctcaatcacggcaacgtcaacttgcgttttaaagtagagaaacatcattgcggtaataatttcaaattcggtggggccgccttctgggtaatttgcatctaattcggcaacgatcggctgaacctgattgactaagctaatcaaggtcgcatccgaaatgggttctccatcgactgagattcgttcgttgaaacgaactaaaaacggcgacgtaaacgtacctaccgtgtatccttgcgacatcagcaagtctcgcaaataagccaccgtggaccctttgccattcgtaccagccacgtgaatagcagagatgttcttctgaggatcaccaagtaactccaaaaatttccgcatccgattcaaatggtcactttttttaaatttcgttctgccatgaataaaatttaacgcttcatcgtaattcttcaccatgcctcatcaatccccacttttctcgtttaaaaaagggacggaatcaatatcgatcccgcccctttgattctagattttattataacatgtgaaccaattactgttcagcccttaaagcagctaaacgatcttgggttgcctttaacttagattcgttatcagcttgcttttgacgttcgctttcaaccacatcatcgggtgcgttggcaacgaaacgctcgttacttaacttcttctttgcgcgttcgacttcggcttcgaacttcttaatttccttgttcaaccgagctgcttcttcgttcagatcaaccagttcagccaatggcacataaatttcggcatcagtgatgatcccagtcatggcaagcttaggtgctttaacgtcggcaccgattgtcaattcctttgggtgaacaaaacggtcaatgtaatcacggttagtttcaaacacgttggccaattcgtgattatccgtcttgatcagcacgtcgatttctgatgacatcggcgcattagcttcagcacgaatattacgaacagctttgattaattcaatcaagttagccatctgtgattcagcttgggcattctcgaattcatcatgcacgactgggtacttagcagtgaccaatgatttaccatcgtgtggcatggtcaaccaaattttttcagtcacaaatggcatgattgggtgtaacaaacgtaaggtttgatccaaaacgtaagctaaaatattacgagtattcgccttagctttttcatcgtcacccgttaagatttccttactcatttcgatgtaccagtcacagaagtcattccaaatgaaatcataaagtgcacgaccagcttcaccaaagttgaacttatcaaactgctcagtgacttgtgccaccgtcttgttcaaacggcttaagatccaacggtcagctaaatcccattcaccttcgtcaggcagttccggtttgctcatttcgccaagattcatgatgacatatcggctagcattccagattttgttgataaagttccaagcggcatccatcttagtgtaagtaaaccgaatatcttgaccaggtgtagaaccgttagacaggaaccaacgtaaggcatcggcaccgtacttgtcgataacatccattgggtcaatcccattacctaacgacttactcatcttacgtccctgttcgtcacgaatcaaaccgtgaagcaacacgtgcttaaacggtcgacggccagtaaattcaagggactggaaaatcatccgtgatacccagaagaagatgatatcataccctgttaccagagtgttggttgggaaatagcgcttgtaatctggtgcgtctgtatcaggccagcccatggttgagaatggccacaaagcactggagaaccaggtatccaaaacatccttgtcttgttcccagttttcgatgtccttcggtggctgctcgtcaacgtagatttcaccagtcttcttgttgtaccaagctggaatctgatggccccaccaaagctgacgggaaataacccagtcatgaacgttttccatccagtgagtaaacgtcccttcaaaccgttctgggacgaaatcaactttatcgtcacccttttgattcttcaaagcttgttctgctaatggtttcatcttaacgaaccactgagttgataaccgggcttcaacttgaaccccagtccgttctgaatgaccaacggagtggacgattggttcaatggaaatcatcaaaccctgatcttgaaggtctttgaccattgcttctcgagcttcaaaacgggtcaaaccttcatatttgcccgcattttcgttcatggtggcatcttcattcatggtgttgattcgttccaagttatgacggttacctaccaaaaagtcattggggtcgtgagctggtgtgattttaacggcaccagttccaaactctggatcggcatgttgatcagcaatgatcggaatttcgcggttagcaagtggcaaaataaccttcttgccaatgacatccttataccgttcatcactagcgttaacggcaacagcagtatcacccatcatcgtttcgggacgagtagtcgcaatttcgatgtagtccttgccgttaagcttagttttaccatccgcaaatttatatttaacgtggtaaaaggcacccttatcgtccttatgaataacctcgatatcagacaaagcagtccgcgcttggggatcccagttgattatgtattccccacggtagatcaggcctttacgatagagctgtacgaaaaccttcttaacggcatcggatagtcctttatccaaggtaaaccgttcacgggaataatccaatgacaggccaagtttgccccactgtgtcttaatggtgctggcaaattcatctttccattcccaaactttatcgacgaacttctcacggcctaaatcgtatcggctgatgccctgcttgcgcagcttagcttcaaccttggcctgagttgcgataccagcatgatccattcctggcaaccatagcgtatcgtaaccctgcatccgtttttgacgaatgagcatatcttgtaacgtcgtatcccaagcatggcctaaatgtaatttaccggtaacatttggcggcggaataacgattgaatatggttttgcttttttgtctccactaggcttgaaaagcccttctgacaaccactcgtcgtaacgtccggcctcaacggcttgcggatcgtacttcggtggcatttctgtcgacttatctgtcatctgatctctccctttctaattcgattgctatgtaagaaaaaaagcacctcatcctataaaaataggacgaaatgcttttcgcggtaccacctaaattgggctattaaacccctcttaataacaatcgttaacggatgtcactccggtcagacttactatatgttcggtctgacagctcgcaagctaccctcaaccaatcgttcgaaaagtctttcagccatggactttctctctgcgcgaaactttttgactgactctcttgctcattgcttatactcgatatgatagccatttttaggctactcgtcaactctagatgttaatttttctaaagcatttaacgctgcaatataatctggttcatgagcgacgtccgaaacaatttcctcgtaagtgatcttaccatcagcatcaacgactaggatggcacgggtcaagacacccatattaggtaaatataagttagacgcgtagccaaacgataactcttcgtcagaaagaatctgcaggttaataacaccctctgccgcacaccaattcttttgctgtgcaatcgtattgtttgaaatcgtcacaaaggttgcatctggatagtggtcagcctgctgattaaacttatgcgtttgggtactgcagacaggcgtttgcagatccggcacgattgacagcatgagtggcttaccaatcagctgtgccatcttaaccttctcaccatcctgattgaacaacttaaacttcggtaattggtcgccaacttgtggtggattaccttccaattcaacttcttcaccattaaatttaaccttcatcaattaaacactccttttgggtgcaactatagcttaaatttacagcgtcaggtctaaaattgcaagcagatttcaagccattattacaaaacaaaaagagacggccatttacccgctgttacaaaatttacacgagtcaaacgaccttctcttcagttaaacctattaaagtaattcagcaaaaacatcttcgctttgattcataaagttttcacccggatgaatcacagtaacttcaatgccatcgagggcttcttgcattaagccgtccacatcgatcagtttttcaaaattacgcgttttttccaagtcaggacgggtcttaggtgctggcggtgtaaaaatcgtacagcagtcttcaaacggtaaaattgataaatcataagtgtcaattttttcggcaatctttatgatctcggtcttatccattgaaactaagggccgaagtacaggtaaattagtgacatcattaatggccatcatgctttcaagcgtttgcgaagccacttgtccaagcgattctccggtgaagacgcctttatcaccacgggctaatgtaatggccgccgcaatccgcagcatcatccggcgctgaatggtcatcaaataaccttctggcaccttttctttaatcgtttcctgtactttcgtaaagggcacttgaataaagttaatgctgccggcataaccagcaacctttgaagtcagctctttggccttagccaaggcttgttcactggtatatggcggactaaagaaatgcaccatatcaagcttaacgccccgcttcataccaagataggctgctaccggcgaatcaattccgccagaaagcatcatggttgctttaccaccagtaccgacaggcaagccaccagcaccagggatggtttcgctacttagaaaaataccgttcaaacggacttccactcgtaacgtgatatcaggatttttcattttaaccttgattcccggaacgttacgtaaaatatgaccacccagtttatcgttgatctggttagtgtcatattcaaattggtgatcctgacggcgagtattgatcttaaaagtcacgccaggttcatactgtgcttgaatcatttgaagggcagtttctttgacggcttcaaaatctttttccagtttgatcactggtgaaaaattttcgataccgaaaacacccttcaaacgttcaataactgctgttgagtcgttgccatttagcgcaacgtgcaatcggtcatactgcgcacggatatctaaaccttcaaagtcatgaaggctatgacggacatttcgaccaagttgacggataaaatctttccggttcttccccttagtcgaaagttcgccataacgcaccataatttcagaatattgcatatggttctccttttcgtttaagtcttatgctgataaaattttaaatttatcgtatagctggtcaaaaaccttgttgaactcatcggcttctgccaacgtattatgatcatctagtgaaatccgaatggcgctggtagaaagtttttcgggaatgtgcatcgcagtcaaagtgcttgatgctaaatgcttcttagaactgcaagcacttgtcgttgaaatgtagataccttgctcctcaaaggcatgcacaatggtctcaccacggacaccctgaatggcaaaacacagaatgtgaggtgcaaaaccatcattatcttcagaaaaggtagtcactaacgggaattttttaacgtggtcaaaaatccgttgcttgatttcagcttccttagcaactttctgcttctcatccgttaacaataaccgtaaagccttcgccatggcagcaatcgctggcaggttttcggtaccgctacgcaagttacgttcctgaccgccgccagtaagcagtggtgcaatcttgcgacctcgacgagcgtaaataaaaccgattcctcgaggagcatggaacttgtgcccagaaaagctgacaaaatccacccgatcattcatgatcagatcttgaatagccttaccgattccttgaacggcatcgatatgaaaatgaatcttcgggtaatctttcaaaacttcagctgcttcttttaacggctgaatcgtcccaatttcgttattaacagccatgatggaaaccaaaattgtcgttggccgaatggcagctttcaaatcatcaattgagattcggccgtgttcatctacgggtaaataagtgacttcaaaccccaactgcttaagctgttccattgaattatgaatggcgggatgttcaacagccgttgtaatcagatggttaccaaactgccttttttcaatggcggtcccctttacaacccagttgtcgccttcggtaccgccactagtgaacagaatctcactttgagatgcaccgagtaaatcagcaatctgtttgcgggactgttccagtaagttgaaagcttcttcaccaaactgatgtaaactggaaggattaccccaaatcttttcactgactttatcgtaagtagaaacgacttcgggatcggccttcgttgttgcactattatcaaaataaatcatgtatgatctgcctctttgcgttttagattggttcgactccaatcaaatagactggggttgattatataggatatgaaggggggaagcaagtcaaaggtgtgaaagtgggcgtttagagagcgaagtgtaagggactgactgcataaatcctggtcttggatttgtgtggtcagccccttacatgcagctctctgcccgctgcagcccgattcggcaataggcaataaaaaagcaccaccatcccaaaagaatgagcagtgctttattaagcttatgccttatccgaaacctcgctagtttcttccttcgccaccggatttttagtcttatagtatcggtcttctaaccgtttataagagcccggctctacttcatctaagacagttgcaatcgtctcgagactcttagggtaatcgtaatcctcgtcaaacaagcgctgtgcttcttgactagcggttgcaacctcttcatgggtcattcgatagcgattagcatactgaatcaattgttcggctagctgggcactatcaatcaaatcgttggtcttttcagttaaaatatccaaatcagactgaatcataatcaactgtttagtaatgtcttccatattgatttgaacctgattcatatcgtcagtcagcttatcgatttcatcactgacaacctggtaataatccaagtaacttttggccactccgggtagattcaggttttcaacttcacgacgaatactgtgcaatttaaattcaaactgctgtaaattctggttagcctgttcttcttctttagccaagccagcgacagaatcattgatctcctgttgctgtttttcaatttgagttaaatcatggatttgccgcgtttggtgggcttcaacttccgtgtagacagcatcattactatgaatgttttccatatctctttgatacgcagtttcaatgttacgaagctgttcggtaaactcccgagtggtttctaattcatggtgatccaacgtatagttgtgattcaaccgctccaattctttcatcaataaactattctgattttgagcatgactgataaacttagatagataatcaaggtttggcgtcaccttggtcttggctaccatttctttttgcatcaaatcataaaagtgatcgattttggtggatagcgcagtatcggcttgtttaaccgcatcaatatttaattttgccagttgcgttttgctctgattgatttcagccggtaacgcagctatttgatcccttaagtcagcaacgggaaatttataaccttgcgctgacagctcactttcgccctgcgtcaattctttaacttgagttggaaattcggtctcaaggttagtcactaacggtggaatggcttttaacatttcatctaagtggtcagtatcagtttgaagctgttccaataatttggcagcctcttgatgatcgcccttgctggtcacttctcggaaatgatcgttgtcatcctccaactttcctaactgcgtttcaaggccatcaatagcatcaccatacataaagtttttcgccaacaacgtttttcgtaaggactgataacgtgcttccagtgtctttacggcctgtttatgctgtgcatcgatctttttgagttcggaaacctgatcttgtacttgtttaatggcctgttgcgcaacttccagtgaagcagtcgctttttttgcttcttgttgagccgccatcacatggtactgcttagcgctattaatcgcgtcattaacttgctgtttgagtcttggcagccggttttccttcaaatcaccaaaatccgtggcaagctgttccacgtctttcaacgtcttacccgttaaactcatggcacgaacttggtcaaccgaatcacttaactcatcaattgtcagttcttctcttttttgatcgattcccttcaaccgtctgatcagatactgctggtaaattaatataccggcataaatgacaattgccaggataatgactcctattaatatcctaaacatctaatccccatccttcgttaccaaaatacattttatatgtatattagatagataatgtttgatttttaatcaaatacccattaaaatctataccagcttaaattatagcataccttgtgaaaaggcttcacctgaatttcaagtttcacaaactaaaacgtaagaggtaatcaaaatgacagaaacaaagactacggtttcaatgatgaaccagcagctagatgcacttttatacaatgaaacgaatttgattgccaatctatcaaatgcttcagctttattgaaccagaccatgtctggcctgaactgggctggcttttatctctatcagcctgaagaagatgagcttctgctcggtccgttccagggtaacgttgcctgcgtacacattaaaaacggcaatggcgtctgtggtacagcactaaaaacccaacagcctcagttggtagaagacgttcaccaatttccaggtcacattgcctgtgattcggctagcaacagtgaagtcgttattcctcttactaagaacggcgttaaaatcggtgtgatggatctagattcacctaaactcggccgttttacagaagatgatcaagcggaacttgaacaatttgctgctattctgttgaaacatattgacattaagtagtcattggagatacactggtgtttgtgtaaaataatgcagcggtgagcggtaagctcgtcaacagatcactgccaaaaggtggttgggtaagtaacctgcggctgcacagggtgaaaaccgcaaagggatctgcacgaatatcaaactcacgtcaaattattttactccaactaaaatttttggaggaactatctatgtctcgttatacaggaccaagctggcgtgtttcacgtcgtcttggcgtttcactttcaggtactggtaaagaattagcacgtcgtccattcgcacccggcgaacacggccaaggtcgtcgttcaaagctttctgaatatggtactcaattacgtgaaaagcaaaagctgcgtttcacttacggtttgactgaacgtcaattccacaacttattcgttcgcgcaggtaagattcgcgaaggtaagcatggtgttaacttcatgatcttactggaacgtcgtttagacaacgtggtttaccgtttaggtttggcaactactcgtcgtcaagctcgtcaattggttaaccatggtcacatcactgttgatggcaagcgccttgacatcccttcatacgaagttaaacctggtcaagtgatcagcgttcgtgaaaagtcaaaggatatgcaaatcatcaaggatgccgttgaagccgttgttggtcgtcctcaatacgttgagttcgatgctgacaagcttgaaggtaaacttgttcgtttaccacaacgtgaagaattggatgcagacctcgatgaatctcttatcgttgaatactacaaccgttaataagcgttgtttaactaaagaaaagcaatttgcgcttcatgtgcaaattgctttttttatattcttctactgaatcaactgactaaaaaacggccgcagttcgaacactgttttaagcacctcttgctggatttgcttttcatgatcaaaaatggaatctccacgaaaccactgacgaccaactaaaaaatcagcttgtttaacctggttataataaattaactgttgttccaatcccccacttgagatttgactgtaggctttagccatatgattagggctaatatcgtagtgatcactcaacttagccagttcaggcaacatatcagccaatcgctgaatcatttgtgctcgttccttagcctctgctaaactcgccagccaaacgaacagccgatcgtcccagaaaccaatcatcagatgcggattcattttatagccacgtttattcgtactgaacgcaacccacgtattcatcggtgggttcttatggcggcgtaaatgcttagccacgtgtgcatagattggtgtttgaaagtctaacgtttcaatcacttgcggtgctagtagttcaaatttaggatcgatttctgcccgaatgccagccattcgcccagctaaggtttgatcatcaaaaacctgaaaatcagaatcattaaacaatgtctctccaccccattctttacggtatctgcgttcacatagaacatgttacaatagtcatactattaatgaaagttggtgttacgcaatgcctgacaaagatcaaatgacgtctcacttggataacgccatgtatggcccaccaaaattgcatcccgatgaacagcggacttacttgggaacgttccgtgaacgtgtctccttactcatgtccattgaacagctgcaaaacggtaaatacttagccgcttttcaagctgaactagttgctcatcctgactaccaagtgatctttaacggccacaccggcatgtcagctttaaaaccctatcttcaagttgctggtcagcttcagcgtgcattcacgatcgttcaagacgatttttatggagcgaagcccacggattccggcttagttgtgatttcaaagaaagcaatcaatgccttcccgattaaagttgaagacaaagcggccgatccagacacagcacagccagttgctaataatgagcattcaacgttttggagcaaaatgaaaaaacatctcggcctttaaattatttgaaagaagtctaattatgccacaacctttagcttaccgcatgcgaccacagcggatcgaagacgtggtcggacagcagcacttagttggcccaggtaaaatcatttcccgaatggtcaaagcaaaaatgctgtcgtcaatgattttatacggaccgcctggcaccggcaaaaccagtattgccagtgccattgctggctcaaccaaatacgcttttcgaaaactgaacgccgccacggatactaaaaaggatctccaaatcgttgctgaagaagctaagatgagcggtaccgtcattcttttactggacgaaattcaccgactagacaaaacaaagcaggattttttactacctcatttagaaaacggtcgcatcgtactgatcggtgcaacgaccgaaaatccatacatcagtattaatccggcaattcgcagccggacacagatttttgaagttaaaccgttgatgccggccgacattcgcacagcgattgaccgtgcccttaccgataaggaaaacggcctgggtaatcaaaaaattgatttggctccagaggctgaaagtcttttgaccaccgcaactaatggtgacttaagaagcgccctaaacggtctagaattagcagctaagtccacggactcaaccgatggtgtcattcacctcaccttgccgatcattgaagaatgcctgcaaaaaaaggcttttagtcatgataaaaacggtgacgcacactatgatgtcatttctgcctttcaaaaatcaatccggggaagcgataccgatgctgctttacactacttagcccggttagtcactgctggtgatctcccaaccattgctcgtcgcttaaccgttattgcttacgaagacattggcttagccaatccgccagcggctgcccgcgtcgttgaagcagttactgctgcacaacgattgggattcccagaagctcgaattccccttgccgatgctgtaattgaattatgcttatcacccaagtcaaactctggtatgatggccattgacgctgccatgtctgatattagctcaggtcattatggtgatattccagcgcatttaaaggactcacactataagggtgcagctgatcttggacatggtgttgattacaagtacccacacagttttacaaacgactgggtcaaacagcaatacctacccgataaaattaaaaatgcacagtattatgaaccaaaaactaacggcaaatttgaaactgctttggcacagcagtatgaacgcctgagaaaagctcagcgatcttaaaaacaatcaaaatggcaaaatgagctaaaatatgctagtatatatataagttctagggtgtgcgcgttgtccacatacgtgtttgccgaacaactaatgttacattgggacatgggataactcttccggattgcaggcctttacacttggtagcatgaacgcagatatacccgtcccacctgcttttatcagcgggccaaaacctatcggacaaattaacggcactattagatcttcaaagtggcaacactttggggctggcttgcaccttgtaagtcagctttttttattttataacaataaatggcgtaaagccttggaggttccccgtggttattaatattttgatgattctgtacgtattactcaccttttttattggctggttctttctcactcacacgcaccgaccattcctcgttttccatcctgaggagaatccaaacttatcaggaattgttaagtttggtggctggtcgttaatcgttgttggtgtcattgctgcagtggcaaccatcatgcaaaacgacgtgtttatttccatgacactattgattggtgtgcttgatatcctagccattcaattaatgctagttcacttcttcccgaaaattaaatgaaaacggtttacatttctctttttatttaccgaaaaataacgtaaaatagaggtaacaagtagagagaggtgagtcatcatgttacaacaatacaaacacatcttagttccagttgatggttcttacgaagccgagttagcattcgaaaaagctgtggctgttgccaaacgaaacgattctgacctgcatctggttcacgttgtggatacccgggcatttcaaaacatttctagcttcgatacaacgatggttgaagaagtaaccgatactgccaagaaaaccttggacaagtatattcaacaagcaaaagatgccggcgttagcagcgttgactactcgattgaatacggtgcaccaaagaccattatcgcccgtgatatgcctaagaaactgggcattgatctcatcatgatcggtgccactggcctaaacgcagtggagcggttattgattggttctgtcaccgaatacgttacccgtacagccgtttgcgatgttctggttgttcgtacagatttggaaaataagccagctaaacaacccgctaaaaaagcagagaaataagtttaattatcacaaaagaggccactcaatatttgagtggcctctttttctgtcttgtttcgtatttaaatgagtatgtcaaatttcctcagaaatttcatcgtgccgatagcaatctgccaaatgatcattcacaataccagaagcttgcagtagcgaataacaggttttagggccaatgcgtttaaaccctaaatgccgcagcgtctgtgacaattccgacacgaaccactcaacatcaagtttttcagctggttgcaagtgatgatctaatggcatgccattaactagttgccagagcgtttcgctcaagctccagtccaattcatgcaaactattaagtactcgcgcattttcaataacagcatcaattttctgacgattacgaatgattcgatcatcatgatacagatcttgcagctgaacgggtgtgagctgtgctaatttatccggctcaaactgctcaaaggccattctcaacgcctctcggtatttcaaaatcaaatgccaagttaatcctgcctgaaaaatctccaaagataggttttcaaacagctgacgctcatcatggacgggaacaccccactctaaatcatggtaaattaacagttgtggactcttttcagcccacggacatctcgttgtcatctgatcagctgctactgataacttataaaaagttatagattattcttgcttctccctatcctgcctcgcatgaaactcactaatacagttgatatgatagtccacaagcgttaattcccggctagccaccggtacatgctttgaaacctatgttagtaggctagttcaaagttttcagtatccctgacgtttaaggccgcgttaatatctcgatttgcagtataactacatttaggacattgataggttcgctcacttagctttaaatcaacttttttatagccacattgatggcataatttagaagttggttcaaaccggtcagttaagtgtaccggaatgcctagttgctggcatttagaaactaacttgattctaaagttataaaagccttggtaactaactgctttagctaaatgccgatttttcatcatacctctaacattcaagtcctctaaggctacccactgcggtttggttctcactacagtagcgataatcttattttgataatctacctgaatgttggttaatcgttgatacaagcgttgcactttcagctgagttttagctagatttaaatcagtagcagatttcccttctttctgttttctagctttcagtgcttgatactgacgggacaactttctttgtagccgtcgcagacgttttctgatgcgtcttatccaactacttttattctgattgtgatacagagtaccatcgtttagaacggcaaactcttttagaccaagatcaatgccaatgggatcaccggtcagtgctaactttggtagttcggcctgttccaccaaacaggtcaggtaataccgaccagctttgaatttgatccggccttgtttgataacaaagtgttctgagtctgtcggaatgtagccaaactctttcaaacgtacccagccaagcttgggtaacttaatacggtgacgctgacaagcaataatctgtgttttactgtttttaacaaagtagtaactgccttgaccccgtttaaaagatcgccaattgggaaaaccactctgtttcttgaaaaatcgcttcatagccgaatccgcatcaataaaagcttgtttgaccgatttggcatataaatctttaatccacctgtcatcaggattactctcaagatactcatggttaaaccacttgctgaactcataagcgcccatgtagtgataaccgcactcataacgctgccggttgatatccaaaaacaagttataggcccaacgactgccaccaatatgacaatcaatctgccaagcttgtttttcagtcggcttaatctcgactttataggtgagtaacatcagttgttccgccttattgaatttaatcaccaaggtgaggtgtccctcatattatacgggatagatttatcccaaaaagccttttaatgaaattcatataattcactacatagaagctattagctaatacggaaaatttaacgcctaactttaaccttgtgatatcttttaccagacttataagcatacgcaataggatagaagcaccactttacaaagattgatatccttttacagcaaaacagttactgttcattcctccttatagagctaaatacgcaaaatcagcagaactggttcaccacgttttcaacgattgcccagttaaactgcttaagcggctgccggttcacttgctggagctgtgtcatctgattggtaatctgaccgtccacgccaaggactcgcatgatttgcatatcagcaatcttatcaggtgtccaaacaaatactggtgccccaatagaatgcgcctgcctgatcatggtcgtattaaggccgattgcctgaagagaatagaagtccgccggtaggtttttaatcgacatcacgtttaaggggacgatgtagccgacaatcaaattaggattaagttgtttcagctttagaactgcctgataactcatggtgtgcacaaaatcgtgactgcttattaattgctcaccatattgtgtatcaaagcgttgaatcatgtctgcactgtcctgtggtgtcactttgatttcaacgatcaaacgttgattaactttttttgccgccttcaaataactggctaagctcacaattgtagtggtcttaccgtttttttccgcatgatgctttttgagctgctctaaggtcaaattctgaatatcggtcactttcgcacccgtgtcagttttcaaattcacatcttggccatgtgacaccacaaactgcccgtctttggtttcttgaacgtcaatctccacaaaactcggcttgtgcttaacggtgttttcaaatgcgtctaatgaattaggaacaccgttgttgccgataacaccgcgatgtgcgatcgtcagacttggagacgcagccactgaaccaaaatggaaggcttgaaacccaaaaaggatcaccagcagcataactagccccgttggaaaccaagccatactgtgtaaatgttcatcatcgtcagaaaaatccggctgaaacttaggttgggcaatagattcccaaatgatggcaagtaaaaagacgctcagccctatcagcgaaaaagcaaccagtaccactagtgcaagtaagctggtaccattaccaatgccattagaaagctgattacttaaaacacgcaaccccgaaacgactaggtgattaatgataaacatgggcaaccaaatggcaactaagggacgcaaaaaccagactaatcggtgccagccacttatcggaaccagttctggcttaaccgtcacccttaagtaactgagcaactgaagaaagacatatagtaaaacggcatacaggaccactaagatgaccacaactacccgtcgttgcatgacgacgatgtcaacccacttaagaggtaacatcactaggttcagtactggtgctgtaaaacccgcatcaccaaagggcagccataaaacagctaataaaatcactaatgccactaattgcagccatcgcttagacaacctacgccacgctgtcagcatcagtaaatcagtttgattcaaaatcgttttattggtagtaaacgcagttaaaatgagattcaattcaaaaattaatccagacagaaagccaataatcaaaatcactttaatggcaacgaggcctggatttaacattagaatatgcagcgtcattaagagtgctaacaataaaagccagccaagattaactgcgcgtacttttaataattgataacttgtttgaaataaacgtcgataataattgattggtttcaccctttcacccactaagccagaaaatcgatcaccgaacgcaagtattgcatgattgcatcgctaaagtcgtgtctgacaatcattgattcaatcaggcgaccacgattataaattcgattccagcctgactgactctcttgctgctggatgatgaccagttcctgccgccaatgtttaagctgctttaaaaagtagtcagcatataactgattcttatttgttaatcgggcaaaataacctgctaaacgctggggttccccaaaaattaaagcaccatccagtgttttgtatcgttcaatgataatcgccatcagaaaaagtttgtcagctcgcgtcagccgttctcgctcggacaactcatctaataaattaccaacgtgcgtaaaggcgtgcgcccagccgttggttttaatgaacccgcgagtatcggcttcaagtatcatatacaacgccaactggttaaccacttgattaaccagctcctggtccaaaaagtggtaacctgcccgatcggcatacaatagaaccgaaagcagcagtactgcaaacgctcgttggtaaatagcatcattttcaggttcaagaatgtgggcaaaaagaaccgtgtcgctggtcaggtatcgaacaatcatcgtcatttgctgattggatagtaaatgttgctgaatcagatcattgaataagaaataaatgcctttgtcccgaacacttggatctgaagacccaatgtgccgtactaactgaaggacttgctggtcgctgaccgtggccaatgattctgcttttagttgatcattcagctgagtcaataaatctcgaatcccgtcattatcatcaggtaactgtactgcagttgcaaccggttcacgtttcactgatgtcactaaggactcaagtcgcgtacccagtgactgaaacagttctcccgcattaacctgttgacgaatctcatttagctgttcacgtatgtcatctatctgattgttggcttccacttttctcgctccgatctttgatcatgttcttattttagcacgtttatgaccggtgagaaaatggggactgcttatcttggcacgcggaagcgtaaggttaatcgatagctaatcagtagcatcacgataatatatactgcaccagagatcatgggtgcaaacgcaacgaagtgaccagtatcagctgactgattccccataccaacgatgaacagtaggaaatcaccaagccaagtcaactttaaactcgtttgatcattcaacatgactagcactacaagtaagacaaaaagtaacactggcatcccaataatactgatccgttgaacgcgccgattgaataagcctaaacacgatccgatcaccattcctgttaccataatgcaggcaataaacagcatcgtaatgattaacaccgataccgtattggcagctgctgaatcaaagtagtgcccataaagaacgctaaacgtcatcaccggattcttcttcgtattaataaattgacggtaaaatacaccatacagcagattaatgacctcacccaccactaaaataacggtcaacgcatacaatttactgaagaaataagttttccggcccagtccattttgaataaataacttgaagccgtcatagctgataccaccaaacacaaataagtagaagcccagaattaacgctggcaaaaactgaggtaagtagtcattgatatcataaatgttgattcgacccagaaccagagaaatggcaaaaggtaaaatcacaaccacggcaatcgaccaaaggtaaacccagccgaaggatttaaagtaatttttgagttgatacgaaaaagctgctttaattttcaacggtgactacctcctgattagtcaaatagatgaataaacgctgtaaatcaatgtggctaatggatatggtatccggtattggccgatcaccgtccagctcaccgtaaacgtattgcaccctcaagttgcctaacgcttcgtggccaatgacatttaagccagctgtgtatgcctcaacgtctgcagctggaccagttatggcaaaacccttatccagcacattttcagtggtgtcatcaacgataatttggtgattctgcaatacccaaacacgttcaattaagttgctgacttcttctattaagtgggtcgaaataacaaaacttcgtggccgtttagcataactatctagtaacgcattataaaataggcgtcgatgattcgcatccagacctaacgttggctcatccaaaaaaacgtaatcaacatctaccgccaaggcgataatcagtttcatgattgaccgagagccagtagataatttattgaagcgggtatcggtatttaattcaaactgttccgccaatgtttgtgccaatgtcatatccatccctcgatagagctgtgttgttaatttaaaaatctccttaactcgcatccgtgatggataaagattagcttcactcatcagataaattcggttaagcacgtcatcgttatcagtcaccgtttgaccgccaatggtgacttctccgccgcttaacggaatgcggttagtaataatgttaaataacgtactctttcccgcaccgtttcttcccagtaatccatagatggtctcgggttcgattgtgagatcaatattgttaagaacttgctgcttagcaaaatctttactgacttggttaattttaattggcttaggtttagccatttttgaaccccctctttatcatttcaagaatggttgtttctggcaaagtcagttttttagcctctttcaccaggttaaccacgtaatcttcgtaaaattcgttctgccgtttttctcgaattttagcgtgagcaccagttgccacaaacatccctaggccacgtcttttttccaaaaaaccatcgctaaccaaaatgttcatccctttaagaaccgtggcagggttgatgtgaaactgtttagatacctcagtcgtcgaaggaacttgagtaccctcttcaaagctgtttgtaaaaatcgcctcttcaatttgttgagcaacctgaagatacagtggttcagtactattaaagtcaaactgcatgatccaccatccaatccttcctttcaccgttaactatttatcaatagtgagctttggtaatacaatatgctcgtaaagttgcacggttataatgtaataaatcatatacaagacaaagaaaattgtaaatggtaaccaaatttgatagtagggattgagcatcaacaccctgaacatttgaaggccaaacataacatggacgaccccaacgattgctggtagaacaaataaaaccagaatctctcgagcaattgaaccccgtaattgtgatggccgagcaccgattttattcaacatctcatagcgcttcttatccgttgccgcaccgctgagaatcttaaacatgagacaactggcaagcatcgccaaaaaagcaatgcctaagaagaagcccataaattcaagtccaccaaacagggccgtactaagaacaaatgtactgtaggatcctggaattgtctccaccgatggattacccatgctagccacaattcgtttcagtcctgccttgtcagcctgcagatttttaactctgaacagcgttaattgctgtgtacgcaccggtagtttattaaaacttgctgctgaaacaagtcgaattgatttttgaggcgcattcggttgcagttccatcaactgttcgggatgaccctttaactgagcgctggtaagactacgatatgtcggtgatgctaaccgatttttttgctttgcattcaacggtgatttaaaaccagtaaactgcaacgggcttttttttaattggtcagcacgataataaatgaccttgttcgcttctttttgctgataagtcacctttgtgtccaaagttaacttattaatgagttgattggtttgtcgagatggatttttgattgccatggtataggcactactggcggttgataaggccgttacttgccgctgcatcccaatacctaccgtgattgcccccaatgacagcgcaattaggattgaaaccactgataaaatcttggtgtaattatgaatccgaaagctaagctgcgataacgtaaaatttcttaatccgtggttcgcccaatccgaacgcttaaacaataggatcagccaaacaaaaattgcgttgaataaaaagtacgttcctaacacaactgtaactaaaccaatcgggatggtgctcaaagcaaatttttcaatgtgactcatggcatagtagccaaccatcagtaaaccagcacccactactacttgtaaaaactgactgacaggttttagtacgggcttgttcggttgactatcaccttttaacaattgcagtacagcggttttggttaaagcaaaacggttgatcacaccagcaattaaaaataggactaagtacaacacgatggtggtgaccactgctggtagataaaaagcgctaaaatgttgcaatttagtgccaatcatccgactcattagaaaaggtccgaccgatgcggtgagaccccagcctactaatacaccgattacgctagcaatcgtaccaattgtcattgtctccaataaaattaactggccaattttagcttgtttcgcgccaagcattatgaataagccgtaatcatgacgccgcatactcatcaagaaagaattcgcgtaaaaaacgtaaaccagcgtaataattgttagcaagatagcaccaaataaaaaaatgaagttagcacccgtaatctgttgtgcattagctttaataaacgccttattagttgctagtgattcaaacatataaaagatagcactggacatgattagaccgaaaaacagcacaacatagtcttttagccgactcttaataccggcaaatgcgagtttatttaacattctgcgtctccccctaatcgaacgtgccaagtgtatcaagaatggcttgatagaattgctgacgcgtttgagtgcctcttcttatttcttgaccaattttgccatctttaatgaacaatattcgttgacaataactggcagaaaaaggatcgtgggtcaccagcaaaatgggaacctgccgttcatgattgatagtgaccagcatttcaagcaaatcccgagcactgttggaatccaaggcacctgtcggctcatcaccaaagagtatggcaggatgagaaactaatgcacgtgctgcggccactcgctgcttttgcccaccagaaatttctgtgggatatttctctaaaattccctcaatgttcaattgttctgcaacgcgttgcacttcaggttgcgcttttttgcgcccaatattctgtaatgagagtggtaacgcaatattttcgtagttggttaaattctccaataaattaaaatcttggaaaataaagccaacctgtttggctcggaaatcagcaatttggttgcccttcaaattagtcaagacttgctgattgatctctacttcacctgaagttggttcatctaacgtcgctagaatattaagtagggttgttttacctgagcctgaggcccccatgatgccaacaaactcatccttagtgacatcaaagctaatcccttttaatgcttcgtactgtttttcattcgctttaccataggttttgtgcaagtctcttactgagacaactggggtatctgtcatgattctcctccgttattagatagtcgtgttcgcctttgttatttggttagttacttatgtagctaactataaaggtaataccgctacttgtcaattaaggatttgaatttaactataaaatccccctcaccttgcctaaacgcttaaaaagggacagcccccggccgtataacaggaagaaccctaccatccaagtttggggtgtcttacttttatcttgcctaaacgtgcaaaaagggacagcccccggccgtataacaggaagaaccctaccacccaagttcggggtgatttccttttatcttgcctaaacgcgtaaaaagggacagcccccggccgtataacaggaagaaccctaccacccaagttcggggtgatagggttcttcctgttatactctgggggctaaacgtccctttttacgctctcttatttataactcttagctggtaatacggcacccttatagtggttgtagatccacttctgcgtgctctttgattgcaatgccttcatcaatttcttgatagccggcttattttggtcacccttccggacagccacaatgttgacatatggagatgatgacttttcagttgcaattgcttgcttcaatgggttaagacctgcttgaacagcgtagttagcgttgatgaagtccacgtcaccttcaccgttcttgtagatacttggcatcaattttggttcgtaactgtgcttaaacttcaagtgacgagggtttgatgtaatatctgagaagttggcagtcgtaatatcgatacccttcttaaccttgatcaaaccagcgtcctgcaagatagttaagatacggccatagtcaggggtgttggaacttgctaaaatcgttgcgccatccttaacatcctttaagttcttaactttctttgaatatgctgaaataggttccaagtgaacgccaccggcactttgcaaggttccatggttagccttgttccatgtatttaagaatggggtgtgttggaagtagttggcatccagttccttacttgctaaagccttgttaggcattacgtagtcttggaacactttgatctttaagttaacgccttcctttttcagttgaggctgaacgtgctttaagatttgtgcatgaggtacaggtgaagcaccaactgtaatcgtggtggtctttggcttacttgaactatttccacaagccgccagcaataccgttgttgctgcaatacctaagatacctagaatccgtttcgaagtcttcataaacaattcctcccaaaatgtagaataaattatctttataaggtccgcttatcaatgcgacgaaccaggaaatccccaataaattgaaatgcaaagacgataaccacaatgatgaccgttgccacaagaacgatggtattgttatttgcctgaaaaccatcgatgtaagccaagtttcctaaaccgccggcaccgatagcaccagccattgcggtgtagccaataagtgaaatagtggtaaccgtcgcacctgataccaaggctggcatgctctccggcaacaataccttataaacaatctgccagctgctagcacccattgcttcagccgcttcaatcacgccacggtcaatttcgtggaaagctaattcaaccatccgtgcgtaaaacggtgcggctgaaacaatcagcgatggcaatgccgcggaaggtccgatgatggttcccaccaagttcttggttattggcagtaacagcatgatcaaaatgataaacggaattgaacgaaacacgttaaccaagaatgaaaccacaccgttaagcagcttaacccagacattttcacttgccgttgtttcaaataatagcaaacctaataaaacacccaagattgcaacgacaatcattgaaaccaccgtcatccaaacggtctcccaggtcgcaccgcccatgttggcccaatcaacggtcttaaatgcaaaatacgatccattagtcacggtgaatcacctccgtttccacacgcattttcttcagtagattcaacgcaccgtctaaactctctttatcaccggtaatctgtaaataaagtgacccaatggaaccttcctgtgtttgatgaatactaccttcaatgatgctaacttgaacctttggaaactgatgaatcatttcagatacaattggcaatttagcctgatcaccatgaaagaccagttgaacaatggtaccgtcaggataactcttaattaagtcttccacgatactgttagtatccgttaaagctgggtcgacttcttcactaacgaaacgtttagtaatttcttgctttggattacggaaaacgttaaaaacggttccctgttcaacgacccgaccatcatccatgacggccacatgatcacaaattttacgaattgcgtgcatttcatgagtgatcaatacaatactcaaattcatttttttattaatttgaagcagcaagtccaaaacttcatcggtggtctgagggtccaaggcactagtagcttcatcagaaatcagaatttctggatcattggctaacgccctggcaaccccgacacgttgcttttgaccacctgataattcggacggatatgaatgttcacggccagtcaagccaactaagtcaactaaatgctgcgccttttcctgacgttctttacgtgatacaccagcaacttcaaggggaaacataatattttgaatcaccgttcgtgaccaaagtaagttgaaatgttggaaaatcatgccgatcttttgacgtttctttcttaactcgctcccagaaagcgccgtgattttatcgccattaatatcaatttcgccgctagttggtgtttcaagtccgtttaacatccgtgttaaggtactcttaccagcaccggaataaccaacaatgccgtaaatttcaccgtcatcaatgtttaaattcacatcggaaacggccgtcaaatcaccatcttttgtggtgaatgtttttgtcacgtttttaaattcaatcactgcggttacctcctttttcaaataaaaagcttcgcccttacttaaactgattagttcaagtaagggcgaagcttatcgcgtaccaccttatattcgttactgtctcacaacagcaacctcaacgagtccgaagactcaacgggatagtggccgttaaccagttacagctcactaatgctcaccgcaacctctttatacaaaaccatcttcagcgtaatgtaacgatcccttttcatcaactgggactctctaggcgtttacgttacgcttactcattttgcagatctcttattcaattgaatcaatgacaaaagtatagctatctcgatgagagctgtcaaggagaaatatcattatattctcagaatctaatcaaaagtacaattaattttctttaatatcaactagccaagcatcggcttcttcttcactgtttaagctatcaaaatcgttagccaactgtgggttcacagcaacgacttcaccgcttacaggactgtcaatatctgaaactgctttttcagcttcaacactgattaatgttttgcccttggaaactttttcgccaacacttggtaggtgagcaaacttaatggtgcctagctcgtcttgaccagctttcgttaacccaagacgtgttttaccatccattaattttgtccagaaataagttgcttcttcactcatactttcacctcataccaatttttttggctttgattttattcaaagtcctcgttacgactaaacatgtaactcttattatgataccgcattgacataattaagccaatacctatcatgttcccaatcagcgctgacccaccttgactaacaaatggtaagggaataccagtcagtggtagcaagccaatattcatcccaatgttttcaaaggtatggaataaaatcatcataataacaccggtggaaatataggcgtaaaacacgtttttagtgtcaaacgttacccgaatcatttggtaaatcaacatgaaatagagcaaaatcaaaattaagctaccaataaacccgtagttctcaccaataactgagaaaatcatatcggattcacgcactggcacatagaccttagaaacgttgaatcccgttccaaaaataccacccgaaccaatcgccttcatactttgccataattgataaccctgatcagaagtattgctagctggattcagccaagtatcgattcgtgaaaattgatacgatgcaaaccctaaatgttccaatattgttcgcccagtagtcgtggcaaccaaagctagtgcaccgccaccgacgcctgccaacccaattgctactggtacgatgattcgccaagtaatccctgcaacaagtgcaacacctgccacaatagcaaagaataccagcatggtcccaaaatcgttttgaagacgaagcaatacggccactggtaacaaccaagcaaccattttgcctaacagtaaccaatctgaatgggtcgtatgctcataatatttatgattatgatcactagcaactcggcctaacatcaagataaaagctggtttcatgacttcagacggctgaaaagtcagcggtccaatagcaaaccaagatttagcacccgttgaagcagcgtaggaccgactgtaaaacaccagcacagctgctagtaagaatatgcctaaccagtaggctaacggcgctactttccataattgttcagaatcaaattgcatgatgataacgacagcaaccgtcccgattgcataccaaaccacctgcgacaccataacggtggtcacattagtcgcactggaatcgtgaacggccgccacataaatcgaagctaagccgatcaatgccagcatcagcacgcaaaaaataacgccatagtcgattcgcgattctgaatcttcttcgcgacgttcattcattgcatcatatcctcctctcacacacgcgttttattatagacggcttctcagccgttctgataaaaattggttatccttaaccgtttttttaggtctaggatgctgtagcgagaaattaatgatgtaaattataggtctgaatcaagtattcaatggcttcatcttgcgtcttaactttaaccggtcgatttgagccgatttgagcttcgaaagagccgttttccagtggcattatcgtgccaatcacttcatcgttaatggataactgtaaaccatccacacctttgattgtcacatcatcgattgcgacgccgactggttgtttcttttttgacatgagaagctccttttacaattttattttaaattcatctcttttagataggccatctcagcctgcttatttcgctttaaactgaaatgatcaggtactgggtcatagccaccatgcacaagtgggttgcagcgcaaaatacgcgctaaccccattaatgtccccttaatcgcaccatgtttctgcagggcttttagcatataagctgaacaggttggtgaataacgacaagaaggcggaaataacggtgatataaagcgctgataaccgcgcacaagcatcatcagtaaccttttcataagtgactcctatctacgaccatgtttcttcgtcgttgctgcattcatatgttcaagtaaaataccggcacctttagccacattatccagtgggttttccgaaataaccactggtacctttaactgttcaatcatcagtttatcaacaccgtgcagcaaagcaccaccaccggtaagcatgatgccacgatcaatgatatcagcagctaattctggtggtacgatttcaagaacttctttagcagcgttgacgatctgaaccatcacgctattgatagcaggataaatatccttagaggtaatttcgattgagcgtggcataccagaaactgcatcgcgaccacgaacctccaaagattcgttgtggtcttcgtccggataagcagaaccgatcttgattttaatggattcggcagtccgttcaccaacttgaaggttatgttgcgtcttcaaaaagttgataatgttgacgttcaattcatcaccggcaattcgaattgacttgctggccacaatatcgccaagtgataagaccgcaatatcactggtcccaccgccaatatcaataaccatattgccttgcggtttaaaaatatccatgcctgcaccaacagcagcaactttaggttcttcttccaaataaactttgccaccgccggatttttcagcagcctgaatgattgctcgacgttcaatttcagtaatattggtaggtgcacagatcataatattgggctttgccaaaaatcccttaacacttaatttactaataaaatatgacagcatgctttcagtaacatcaaagtctgaaatcacaccatcttttaaaggccggattgcccgaatattacttggggtacgtcccaccattcggtaggcttcagagcccactgctaacacttgatttgactttgtgtcaaccgccacaacggaaggctcgttcaacacgattcccttacccactgcgtaaatcaaaacgttggcggtaccaaggtcaataccaatatcttttgccatcctatcaaattcctcctgaacttattgtttcaaccgttaattatagcatacccatactaagatggggtaagcgaaaaaagttcggaacagactcgccgttccgaactctctgcttgacgttaatccttagttttagactttaaaacaacctcttcttgctcgggtactttaacccgttcaatttcagcacctaaagcgcgtaactttaaatggaaattgtagtaaccacgatcaaggtactttaggttagtcacttgcgtatagccgttagcaactaagcctgccaatactaatgcagcggcagctctcaaatcagttgcagcaacttgtgcgccattaaaattggttgggccatacaaagcaactgtccgcccctcaactttgaactttgcattcatgcggcgaagttcctccaagtgcatgaaccggttttcaaacactgtttccgttaacgtacttgtcccattagcagataactgcagtaccgtcatttgtggttgcatatccgttgggaatcccggatgcggtaacgttttaacgttggttggttttaaactttcaggtccaatcacccgaacgccatcgtcttcgatcaaaaccgtcacacccatttcctctaatttggaaatcagtggtttattatgctcagcaatggcattcttaactaaaacgtttccgtgagtcaatgctgccgccaccataaaagtaccggcttcgattcgatcttgcacaacgtaatgttcagttccgtgcatgctcttaacgccttcgacccggatggtttcagttccggcaccacgcaccttagcacccatcttatttaaaacattagcaaggtcaacaatttctggttcgcgagcgacgttttcaatggtagtcgttccctcagccaatgtggccgccatcataatattttgagtcgcaccaacgctcggaaaatcaaggtaaatattagccccaactaaccgatccgcagtggcttcaatgtaaccatcgtgctgatcaatacttgcgccaagggcttcgaaacccttgagatgcagatcaacaggtcgagacccaattgcacagccaccaggcattgcaaccttggcgtgaccgtagcgagccaataacggacccatcaccacgatcgacgcacgcatctttgaaacgtactcaaaaggtgcctgtgttgacagctttttggctgcatttaaacgcacagtattagttgattcatcaaagttcacgtccaagtttaaaaacttaaggacgttattcatggtatacacatcggacagaatcggaacgttcgttaataccatatcgtcgtgttcagctaagattgacgctgccaaaattggcaaaacggcattctttgctccttcaatatgtacagttccagataattcgcggccaccatgtacaataatcttttccaaaggaattccctccacaagttgcattatttaacgagaaaaattaaatttctaacattatctataaagttcaagaaaaattcgctgcaggtatagcctactgttaccgacagcagaacgatcagtacctttgcttgactcgggtatagccgcataaaattttcaatgtgtagtttttgaatactccaaaaggccacaaaaataaaaacaaaatgactgagtagcgtcattaatgcctgagcaccgattgttcgcatggttcactttcctttctgcgttacccctaaaatatagcatatttcatgcacgctgtcccctattctattgcatttgtaatattacgttttacaaagcaaactttttacaaaaccttgaaatattcatttatattattttcttatagataccataattaattattaaatgaatgtgggataaaagtcacgtttttaccacgatttcttaagctcagagtttcacattaagttgtacacgattcatttattttaagaatttttatatattcaaattggaatagtaaatcacctattatacgcataaaatacatattctttgtgaagtctgatttatagcattaaagtcccgataaatcagcaattgtaagcgttattttcacggaatattcgtgatatttcacaatatttttaaatcatggtaatctctagtcgttaagttaaatatttcattcacggagatgattattttgatcaaagaagttcacatgccaaaactaagtcctaagtccgacgagtactttttcggtaagtgggataaacaacctggtgataccgtaaaaactggtgacgtcctttttgaagttgaaactgaaaaggccattagtcaagttgaaagccaagaagatggcatcttaaaagcccaagaagtcgctactggtgattctactaaagttggcgatttagtcgccactattgaagttgcaaagtagcataggaggaaatactaatgaagacagaacatgaaacaaccgcaccagcaaaaccaggctggttaaaggttacttatgatcaaaaaaaagttgataaaatgactgacctgctctccgggttgaaactaaacaccgtttgtgccgaagcaaattgcccaaacttaggtgaatgcttcggtagtggttcagcttcattcatcatcttaggccctaactgtacgcgtgcttgccgcttttgcgacattccccatggtcatccaaaggacgttgacctgttggaacctctaagagtagcgcaagccactaagaaactcggtttgactcacgtggttgttactagtgttgaccgggacgatttacccgatttaggtgctgatcaatttgttagaacgatcaaagccattaaagaactgaaccctgatacttctattgaagtcctcacacctgatttccaaggtcgcgaagactgcttggataaggtcattgctgctggtcctgacgtttttaaccacaatatggaaaccgttcgtagcatcacacctaaggttcgtaaccgtgcgacttacgatacttctctccacgttctcaagtacgttaaagagcacgcacctaagaccatgtacgtcaaaactggtattatgttaggccttggtgaaactgacgaagaggtctatcaattgatggatgatttacgtgccattgacgtggacttcttgacgattggccagtacgttcaaccaggtcccaagaactacactttgcgtgaatgggtaccaatgaaacgctatcaagaatactacaaacaagctatgaaacgcggcttcaaatttgttgctagttcaccacttgttcgtagctcatacaaagccaaagaagaactggaagcagtggaaaatcaatgatttacttacctgtagacagcctagatgttcgtcacaactttgctttggaatactatttaatgactgaaaaacgtccttctgagccagttttactgttgtggtctactacaccaactgtcatgttaggtaagtaccaaaccgctgaaaatgagcttaatcggccctttatcgatgctcatcatatcgctgcagtcagacgactgtcaggtggcggcaccatttataccgatcaaggaggctgccaattcacactgatcacgcctgacaaagatactgccattgatttttcatcaggtcttagccttattactggagcattaaatcaaatcggcattaaagcgcaaaatgacagtcgtaacgacttagtggttgatggtcgtaaagtatctggcagtgcacaatatatgattaacggttttcgcttgcaccatggtagcttgctgtttgacgccaatatggactggatggctcaggcgcttcaagttgatccagttaaaaagcaagctaaacacattaactcggttcatcaacgaaccgtaaacctcattgagcagaagccaaattggactgctcaaggatttaagcgaaaactcgaaaaggcgttgctcaacatcaccggtgcacagattggctaccttacagcagctgaaaaaaaccatcttcaaaaaattgctgggcaacgttttagtgaaacagcggtatggcgaagtgataaccgcaaatttgaccacgttcacaaacgctatttaaccggtatcggtgttgtttcagtcgccttcaacttagatcaagaacagcatttttcagcgattcatctttctggtgatttcttcagtaacatcaatctgcagcagtttgaacgatcattaattggcaaagcctatcaacaacgggttgtaacccccattattgaacatcagctgcagcaatcccctattaagggactccagcctgaacagctgactgagctattattttaatatgattgtggaatatttttaccagaaattgattaaggagactgacccccaaacgatgccgagttatgaccattcgctggagacgacccatttaattattcctgtgtcttaaatataaaccattagaaaaaaattaaatgaattattagttatataaaaagggtagtagattgccaaatacatgacaatctactaccctttttatacatttctactaacaaatcaaaaagacgctactctcaaatgagaatagcgtcctcgcttgcaattttacttgccagcaacgttaattcgattgatcgcccgccgaagtgcaacttctgcacgtgcaagttcatctttgtcgtgagcttcctgcgctttttgaatccgagcctcagcccgtttcttagcgttttgagcacgatcaacatcgatttcatcttgtttttctgcagagtcagcgacaatggttgcaacattgtcagagaattcaatgaaaccaccattaacggcaatttcgtccttctgatcactgtttgcagattgaatacgtgcttcatcaaatgctaacgaagcaatcacaggaacgtggttggccatgataccaagttcaccaagttgggtcttaacgaccagcatcttgacttgctcgttatcatagacgttaccatcgggggttacgatactaacggttaaaactgattgtccatcagccaattagaacccctccttacttgctcaggttagcctgcatcttcttggcgttttcaacaacgtcttcaattgggccacagttacggaaagcatcttctggaagatcatcatacttaccttccaagatttccttaaagcctttaacggtgtcggaaaccggaacatacttacctggtaacccagtaaattgttcagcaacagagaaactttgtgacaagaagaattggatccgacgagcacggccgacgatggtctgttcttcgtctgacaattcatccatcccaagaattgagatgatgtcttgaagttcacggtaacgttgcaaaacatgttgaacttcagtagccacttcgtagtgttcttgaccaacaacttgtggatcaagcgcagtagaagtagaagccaacgggtcaacggctgggtagataccttgttgcgtcaatgaacgttccaggttggtggtagcgtccaaatgggcgaaagtcgttgctggagcagggtcggtataatcatcggcaggaacataaaccgcttgaatagaggtaattgaccccttcttcgtactagtaatacgttcttgcaactgacccatttcagtagccaacgtaggttggtaaccaacggctgaaggaatccggccaagtaaggctgaaacttccatcccggcttgggtaaaccggaagatgttatcaataaataacagcacatcttgacccttaacatcacggaagtattccgcaatcgttaagccagtcaaagcaacccgcatacgggcaccaggtggctcgttcatttgaccatacaccatggccgtcttctcgagaacgcccgagcctttcatttcgtagtacatatcgttaccttcacgggtacgttcaccgacacctgtgaagacagaaataccattatgaccttgtgcaatgttgtggattaattcttgaatcagaacggttttaccaacaccggcaccaccgaacaaaccaattttaccaccacgaacataaggtgctaataaatcaataactttaatcccagtttccagaatttctgaagttgggtttaattcatcgtacttaggtgcgtcacggtgaattggccgtctttcagcatctggaccgaattcgggaccgccatcaattggatccccgaggacgttaaatactcgaccaagtgtgtcatcgccgactggaacggtaattgaagaaccagtgttttcaacttccattccacgacgaagaccatcagtaccatccatggcaatggttctcattactccgtcccctaattcaagggtaacttcggtaacaaggaaactgccatcatcttttttgatgtgaagcgcggtattgatatctgggagtgtgtcatccaacgggaattcaacgtcgacaactggtccgataacttgaacaactttaccagaactcattattcgttaattcctcccgtcattaattattcaatgcctcttgcccaccagtaatttcagtaatttcagtcgtaattgctgcttggcgagcacgattatatcgcaattcaagatcggcaatgaggtcgtcagcattatctgaagccgacttcatggcattagaacttgatgcgtgttcagccgttttagcatccaagattgctccgaaaacgaggctttctgaatactgtggtaaaacaactttcaatacttctttttcagaaggctccatatcgtaagctgcagataaggtttctgcttgagtatctccggctgcatcaccactcagcgtttcgctgtctactggcaacattttttcgccacggaaccgagcaactagccggttaacgaaatggttgtagcaaacatagagttcactgaaaacgccactatcatacattgaggttacggtcttgacaatttctctaacttcattaaaagtcggtacatcactgacaccacgatattcgtaggccacgttttcaccgcgcttcttgtagaagtcagcaccagttccgccaactgcaagaatcaaatggtcattgtcgccactatggctctgaatgaactcatttgtctcacggagaacgttactgttataactgccgaccataccccgatcagaagtaatgaccaagtatgctgtcttacctgactgcttagaatcgctcgaggaatcatccaatagatgagattttgccagatgcatcacaacagctttgactttgctaacgtagtcttgataacctacagccgctttttgaatctggttcagcttagaagtctgaaccatctgcatcgccgaagtgatctgacgtgtattctttgttgaagcaatgcgatgttggacatcgctcattgattcagccatcagctctcactatccttcctcaagtttatttgttcgctacagtttcagcgtcatcgtcactggctggttggaatgtttgtgcaaattctgaaacggctgcttccatcttatcgttgtctggcaagttaccagtcttggcaattgtgtcaagtaggtcagcatgtgaggcatcgaagaaatcgaagaggccactttcaaatttagcaatatcatccaactcaatcttatcaagatagccgtgagtcaaggcgtacaagatcaagacttgcttctcaactggaagtggagaatgcaatggttgcttcagaacttcaacagttcgagcaccacgattcaacttagcttgggtagcttcatccaaatcagaaccaaattgagcaaatgattccaattcatgatatgaagcaaggtccaaacgaagtgtcccagcaaccttcttcatcgctttgatttgagcatcaccaccaacacgagaaaccgaagtcccggcatcgatagctggtcgaatacctgaatagaatgaatcactatccaagaagatttgaccatcagtgatggaaataacgttggttggaatgtaagcggaaatgtccccagctttggtttcaacgatcggcatcgccgtcattgaaccaccgccaagatcatcactcaacttagcagcccgttcgagcaaacgtgagtgggtgtagaaaatatccccaggataagcttcacgacctggtggccgacgaagaatcaaggaaagttcacgataagcatcagcttgttttgaaaggtcatcatagatgatcaaaacatgcttgccgttaaacatgaactcttcacccatcgctgcaccggcatatggtgcgatgtagagcaatggagcaggttctgaaggaccggcagtaacaacgattgtgtagtccatagcaccgaacttacgtaaggtttctacttgactacgaacagttgattccttttgaccgatcgcaacataaatacaaatcatattctggtctttttggttaatgatcgtatcaataccaactgtagtcttaccagttttacggtcaccaatgatcaattcacgttgaccacgaccaattggaactaatgagtcaatggctttcataccagtttgaagtggttcgaaaactgacttacgttccataacgcctggtgcctttcgttcgataggacgggtcttatcagttttgatttcgcccttaccatcaacgggttgacctaatgagttaacgacacggccaatcatagcgtccccaacaggaacttccatgatacgaccagtacgcttaactgtatcgccttcagtgatctttgtgaaatcaccaaggacaacgataccaacatcgttactttcaaggttttggaccatgccataaaccccgctatcgaattcgagcaactcaccagccaacgcgttttcaagtccgtgagctctggcgataccatcaccaacataggtaacagtacctgtttcttcaacagagatctcgtcttggtagtttgctaattgttgtttgattagagcactgatttcctcagctttaatgctcatataggtttcacccctttataaagatctcttattctaataatgtttgacgtagacggcgaatcttggtcttgatggaaccatcaagaatggtaccagaagactgaataattacgccgccgataatagatgtatcaactttgcttgtcaaaacaacttgtttagcgccgacccgtttggcatagcctgatttaattgcatcaagctgtgtatcattaagggcgaccgccgtagtgacatctgcataaaccgtttgattatgttcatcatacaatttttcgaactggtcaatgatttctaccattgcgtccatccgatcgtaatcataaaccattttaaccaaattatggatcgtgccttcagtactatctaacaacggcttgactaaggcttcccgcttagctagcgctaaactactatccgttaatgcactgcccaactgcgggttgtcttggaagactttacgaagctgtttgagctcttcgtaagcagcgtccaactggtcgttgctcgcaagcagttcaaacagcgcttttgagtagcgcttggctaccgttaccttatcaagactcatgttacttccccaacccttcgatataagaatcaatcaatgccttttgatcatcagcgtttaattctttttgaatgatcttggaagcaatctcaatagataggtcagccacatcattacgtacactagacaatgcatcttgacgctcttgctcgatgtctttcttagcgttgtccttcaatgcttgtgcatcggtttgggcctgagctaaaataccatcgcgttgttgttgcccttgcttcttagcagaatcaacaattccggtagcctcttgacgagagttagccagtgcgtcttgacgttgttttgcaagtttagctgcatcatcacgtgacttttcagctgaatcaatatcgttagaaatcttatcagcacgatcttgcatcatttgattgataggcttccaagcaacgagcttgatcaaccacatcaaaatgatgaaacaaatcgcatagaaaagcatgtctccgactgcaagactacttgctacggctaaatgtgaaaacatctattgacacctccttcttgttaaaaattaaatttaacgtgttgtaaaacattacttgttcataacaagcaaggccacaacgaaggcaatgataggcatggcttcaaccaacccaacaccaatgaacatgtttgtccgtaattgaccagataattctggttggcgtgacataccttctagcatcttagaaataacgataccatcaccgacaccaccaccgatggctgcaccggccatggcaatacctgctgcaatagctcccataatctgtagttcctccttaaaatgatgtagatatattagatgaatattgtaagtcgtttactccgcaacttcaagcttcatttgagaatcaattaatccccaatttcgagcttcttggaaatgtaaacggccgaaagtgttacaaacacgtacgcttgaatggcaccaaggaaagcagagaacgcttgccataccaattccagtggaactgccacgatcatcgttgcaatcccgtgtgaaaatgccaagcctccgataatcttcagtaacatttcaccagagaaaataacaccgaagatacgtagacctagtgtcaagaagttcgtgaattcctcaaagatactgattggtaaccagaaaacgaacggttgcaagtaacctgagaagtgtttcttccaaccaaacttcattacaccggcaaactgcgcaatcattaaggttgctaacgagaatgtcatggtaacgattggatcagaagttggacttctaacaaagtccttcccaccaacagcaatttgtaagaacaaaccaagttggttagaaatgaacaggaataaaaacaaggtgaacccataaaggccgaatgcgcccgcttcatttccagggatagaacccttcaaaattccatttgtaaaatcaattaaccattcaaggatgttttgtcccttacctggcttcattgtaatatgccgtgaaagggcaaatacaaacaaaaaaacgagtacaaacgcaattaaccccgaataaatattggcggcattgaacgtaagtcccccgaattgaaaggttgcaactgaagatggatctcccacagagtatcacctcttttcaaactaggctaacgttagaagttccgaaaaacctcgctcactagccaataagtcaaatttcaaatcttcgaacgtagtactttaatgaaaaatcttcattacaaatacaaacaaaataataccaccgttcatatgaaaatacaaagctattcggaaaaaataacgaataaaaaaagccaattaatttgaatcatccagtatttatcggacaaattcgtattaattgactattatcgtactcatatgaatttacttagtgccaaatagccgatcaccagcatcacctaagccaggaacaatgtacccgtcctcgttaaggtgatcatctaaggcagcagtatagatatcaacgtctgggtgggctttccgaagtgcctttacgccctctggagctgctactaagcagacaaacttaatgttgctggcaccccgcttcttcaaagcatcgatggccatgattgaagaaccacccgttgccagcatcggatcaacaacgaaaatttgacgttggtcaatatcagcaggtagcttcacaaaatattcgtgtggttccagcgtcttctcgtcacgatacatcccaatatggccaattttggcagcaggaattaacttcataatgccatcaaccatgccaataccagcacgtaaaatgggtacgatggcaaccttcttaccagctaaagttttaaccgttgtttttgcaattggggtctcgatttcaacatcttttaatggcatatcccgtgcaacatcatacgccattaacatggtgatctcatcaacgacctctcgaaagaccttcgtcccgcaattcttatcccgaataatcgtcagtttatgctgaatcagtggatgatccataacctgaaacttgcccatgtgtttgacactcctttagtatttctttcaattgtaccatgcaaaggaacctctgaagataaaaatatcaaaagagtcttaagaaaacgacctgtttttcaaatggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctttattaaaatatcattggacctcgctcccatgtgtgaatatggatggcaaaataaaactttgatctgataatcctgttctaaggctgataattggcaaactctttaccatgatcaacaaatggatttttacttgggaccgaagccccataaacttgccaaaggcggtgtttagagccttaggccgttctataggggctttgatggcccatagaagtcgggtcttacgttctaccgaatgtaaccagacatgatgtgactcacttcgaatagaaagccccgtatctacttcccaatgaccaaaaagtaaccgttgattaacagtgtttggccgttgtcgatggagtccacacttgtaaatttcccacgattttcgctcacatcgggctgggcggacattaccgattgggtagatcagtcaatttgaaggggagccagcacgattaagccaaatataaattgacgcagtgctcaagttataagcggccgcaatggttttctggtgaccaggttaatcgtaaggtattgggtaattaaagtcgctaatgctgccgtcagcatcgaacgaccgacagcaaattccgccttttgcgatctgcatcttgctgagctaattctggatataaggtttaacccggtccaactcatagctaatcgtagctttggcgacgcctaagtgcagctcagccattacttggtaagatttattcccctcattgaccagttgtgctagtgcgcaacgttgaaaacgtgataaagtagatgtacccaaagtaatcactccctatattggttggaattagctactaccattgtaagtgattgctttgggctttttaatttctgttcggattaattatagaatttgccattgtgtaaaacataatgcaaacagctcgatcatcagccaagagttaatgaccgttaatcgagctgctcatattaaatatggaacgtttaattaatcaaatttaataggtgctacgtacgcgtcaatcggatgagcatccgtcaacgcacggacatcttgacgcacttgctgcaggacggtctcatcatcatggttctcaatggcagtaacgatcagtctagcaacttgcttagcatcagcttctttgaaacctctcgtagtgatggcaggtgtccccaaacgaataccagaagtcttgaatggactaagcttttcgttaggaatcgcttctttgttagtagtgatcatcacactatccagcaactcttgtgtttgcttgccgtttaagtcagtttgactcacgtctaaagtcatcaagtggttatcggtcccaccagagaccactcgcactttgtctgcttcattaaatacggccgccattgcttgggcgtttttaataatctgagccgcataatctttaaactctggctgcaaatcttccagcaaggccactgccttacccgcaatcacatgttcaagcggaccgccctgagtaccaggaaaaacagcagagttgatttgcttagcgtacttctcctgtgacagaatcagtccgccacggggaccacgcaacgtcttgtgagttgttgtagtgaccacgtcggcaatgccaactggtgacggatgcaagccagcagcaaccaacccagcaatgtgagccatatcaaccataaggtaggccccaacttcatccgcaatcgcacggaaagcctgccaatcaattacccgactgtaggcagaagcaccggcaacaatcatcttaggtttaacttttaaggctaagtcacggatcatatcgtaatccaacaattcggtatccggattcaagccatagctgtatgcttcataaagcttcccgctgaagttaactttagcaccatgactcaaatggccaccagcatctaaccccatacctaagatcgtgtcaccaggctttaaaaaggcagcgtacgtggcttggtttgcctgggagcctgaatgtggttgaacgttagcatattcggcatggaacagttccttagcacgttcgatggcgaggttttcgacgacatcaatatattcatttccaccgtagtaccgctttgacgggtaaccttctgagtacttgttcgtcagtacggaaccttgggctgcacgaactgccggggaaacaatgttttcggacgcaattaactcaatattatgctgttgacgatcctgttcttgactaatagcttgccataacttcgggtcttgttcttgataattcaacacaatcagctccttggcatttaatatgcctaagtttaacaaattcagcgctaaaaagaaagggtctagaccttaaaatacaaacaaaaataaacggttaagtaacatccatccgtaaaacacgaacatcacttaaccgtttagtttcattattcactagaaaactagttttatttcttaaagtgcataccgccagccgacttatccagtcgattcatatacgctgcacctaacccagtattgtcaaagccctcggtaaaaatcacttttacttcagattctaggtcaaaatgacgtaacccagcaaataacaagtgagtagcgctttgaatatccttacctaaagaatacgtttcaacgttttgaggtactgatagctgagccagtacctcatccgtggccatgagtccaatcgcttcattttgctttgaagcccaatccatagctgctttaaaatcagctggatgatcaacaatttcaacctgagcactaggcgcataatgcttatacttcatacctggcgctttgggaatttcgttagcaccaacgtgatgatggtcagcttttacgtcaccaataacttgttccagttcagcaaccgtcacggcacccggccgtaaaatggtcggcgtatcagtggacatatcgatgatggttgattccacaccgacttgagttgggccgtcgtcaacgatgccagcaattttaccgttcaaatcatggtacacatgcttagccaacgttggactcggtttaccagaagtattagccgatggccccacgattggaatcccagccgttgcaatcaatttaagtgtcacttgattctcaggcattcgaaaggcagccgtatcaagaccgcctgtcaccgtctttgacagcgttcctggcttaagcggcaaaacaatggtcaatgaacctggccagaacttagccattaactgtttaacttcatcggtcagtggctgtgcgtaacgttctaccatttcaatcgacgacaccgtgacgatcagtggattatcactgggacgcccctttgccgcataaacgttgctggctgcttgttcgttggtggcatctgcgcccaagccgtagaccgtttcagttggaaatgcgactaattcaccttgtttcaatagcttagctgccgcttcaacttcatctggtttaaaaattttagtttccataattttgaattttgctcctattcttgttaaagaatgatgcgtctatttaaactgaattcgaaccatgcgatcatgaccagccatgtcctgacgtacagtgacagttgcatcagggaaccgctgctcaaaaatctgtctaactgcttggccctgctgaaaaccaatttcgagaaatacttgttttgtagtcacgacaccctgtctaagttgatcagctaaacgttcatagatagctaggccttgatgatcagcaaacagtgccattgctggctcactggctagcacatctgcatccatttccgcctcttcatcatgtgatatatacggcggattgctcacaattacatcaaagcgggaacccgcaacgggcgttagtaggtctccctgaaccgtgtttattgaagcgtttaactgcttagcattctcctgggcaaccttcagtgcttcctcggataaatccgaaagtgtcacctgccaatcagaacaccgcaacttcagcgtaatcccaatggcaccactcccagtaccgacatccaaaactgataactgcggttgctgattggctgacaacacccactccaccaattcctcggtttcttgtcgcggaatcaaaaccgcttcgttaacgataaaactttcaccatagaatggcgctgtcccaataatgtattggggcggtattccaccaacatattggttgatagcttcaacatagcggttatccagagttataggcatgggctgacggtatttaatgagcagatgagtctgatctaaatgactgagttcttgcagcaaataagtcgccgccgactcatctaaccgtttttctttaagaaacaaagaagcccacttgagggcctcatagtaagtgcgattactcattaagctgttccatcttttgagtttgatcgtacagaatcaaagcatcaatgatatcatctaaatcgccattcataattttatcgagtttgttcaacgttaagccgattcgatgatcagtcacccggttttgaggatagttataagtcctgattcgttctgaacgatcccctgtccccacagctgacttacgtttctcgtcatacgcactttcttcttgttcgtgatagtagttataaacacgagcacgcaaaattttcattgctttagcacggttttgctgttgtgaacgttcatcttgcatcgcaaccacgataccagttggtaagtgggtcattcgcacggcagaactggtcttgttaatatgttgcccaccagcaccagatgaacggtaaacatcggttcgaatatcttttggatcaatatcgatatcaacgtcttcagcttctggcataacaccaacagtagccgttgaagtatgcagccgaccagctgactcggtaacaggaacccgttgtacccggtgagcaccactctcgtacttcagcttggagtaaaccttatcaccactgatcagcataacgatttccttaaaaccaccgacttcagtttcgttcttatcgacgacttcaaccttccacccctgcttttcagcgtagcgtgaatacatatcaaaaagatcagcagcaaataaactggcttcgtcaccaccagctgcaccgtgaatttccatcacaatgttcttatcgtcgttaggatctttaggcaacagcaaaattcgaatctgatcttccagcttctctttttgagcttccaagtctttgagttcatctttgaccatactgttcatatcgtcatcaagtttttcatgaagcatttcattatcttcattgatctgactagtgattttttggtatttccggtaagcttcaaccgtttctctcaagtcagcttcttctttagataattccataaaacgccgggtatcagcaataatctcaggatcactgatcagttcgttgagttcatcgtaacgatcaaccagcgcctgtaatctatcaaacatttggtccattttaactctcctattcttcgcctaacatatccattggtggattatagtagtgtcttctgcagacgggataatatgattcgttgccaccgatttgaatctgttcgccttcgtaaaccggtttattatcatgaaaacgcagattcatcgtggcttttttagcgcagaaccagcagattgttttcatttcttcgagtttatcggcatacagtaacaaatatttggagccttcaaacagctcattgcggaaatcgtttttcaacccaaaagccatcacaggaatcttaagctcatccacgatcttggccagctcaaacacgtgagccttagttaaaaattgagcttcatcaatcaacacgcaattagctttagagttgatcttctcaaccatcttgaagatatcatcatcatgaaaaatcggcaccgcctcacgctctaatccaatgcggcttgatactaaccccacacctgaacgattgtccgtcccgctagtcataataataactggcttattctgttcttcataattatgtgctaccttcaaaatttcaatggttttaccactgttcatagcgccgtacttaaaaaataactgtgccaatagtctcagtctccactcttcgcaaatttctcatctattatagcggatttagcgttaaaattcaccctctccccatggatattccaaagtgaaatcgtttttttgattaaatcagcattggttcaccgcttatttgccggaaacatggtagaatatatgcttagtgaaattgaaaaatatagtttctgctgtcactaaatgtgaccaagcaggacaaggagcgagaataatgactttacgaagtaacgtagctgccttcgctggcagatcctcatattggttcctgcatacatttatgaagggtggcagttcactgcctggcaaaatcaccacaaaaatcgacccagagattctcaagcatctgggacaaaactacgacgtcatcgtcattactgggacaaacggtaaaacgttgacaaccgctttaacggttcgcgttttaaaacaaaaatacagtaatattttaaccaatcctacaggttccaacatggaacaaggtattgtgacaacttttctccgggcacctaaagttaagggtgcacgaccaatcgccgtactggaagttgacgaagccaacgttatcaaggtgactaggtacatcaagcctaaggcgttcgtcttcaccaacattttccgtgatcaaatggaccgctacggtgaaatttacaccacctatcaaaaaatcattgacggtgttgcgttagcacctgaagcaacgattattgctaacggtgatgcgccaatcttccactcaaaaaacttaccgaatccgattctctattacggtttcaagaaccaagaggaaaaagacattaaagccaagccaaatacggacggcgttttatgtcctaactgccaacatatcttacactatcgctatctgacttacagtaatttgggtaaatacttctgtcccaactgtggttttgaacgtcctgagcttaaatttgcggtcactcaaattgctgacctcacacccactagttctgaattcgaagttgatggtcacgcgatgaaaattgaaattggtggtctgtataatatttataatgcactggcagcttacgcagttggtcgttttctcggcgtcacacccgaacaaattgatactgcattcagtgaagataaaaaagtctttggccgccaagaagtcattgatttagacggtaagcaagttaccttgattttagtcaagaacccagtgggactcaaccaagtgttggatatgattgcaacggataaaaaaccattttcgtttgtcggcctgttaaacgctaattatgctgacggtatcgacaccagttggatctgggacggcaactttgaaaagctgccacaattaaacattccggcttacatcactgggggcgagcggtacaaagacatcaccttccgcttaaaggttgctggcgttcccgatgatatccatcaagtagtgccagaactaaaggacgttgtggaaaaaattaagactttaccaaccgagcacgtttatgttttggcaacttacacagctgtgttacaattacggaaattattagccgatcagggctatatcaaggagggtatgggagcatgacctatgaattaaatgtggctcacctttatggcgacctgatgaatacttatggtgatgttggcaatatcttagctttaaactactatgctaaacaaatggacgtcaagttgaacgtgaacgttgtcagtttagatcaagactttgatgctgatcaatacgacttagcctttttcggtggcggtcaggatttcgaacaagtgattgtttcaaaagatattcagactaaaaaacgggcgttaaccgattttattgaagatggcggcccagtgctggccatttgcggtggcttccaactgttaggccactactatgttgatgctaagggagataaaatccccggtattggtgcgcttgatcactacaccctgtcacaggataatcaccgattcattggtgacatcgtgattaaaaacgaggaaactggtgaaacttaccacggctttgaaaatcatcaaggtcgaactttcttaggcaaggatgaacgaccattaggcaacgtcatcgaaggcaaaggtaataacggcgaagatggcactgaaggtgcgatttacaagaacgttttctgttcctacttccacggaccaattttgacccgcaacggtaatctagctaaacggctgctggtggcagcactcaagcgcagctaccctgatgccgatttgagtcagcaagaagccctgccaattgcagcaactttttaacattaataaaacccatttaaaaaacatcatgattgatcagccagcacgctgaaatcatgatgttttttgtttccacattccataattgaactatttactttatagttacaagactgcttttctcgcttaaataggtgttaataatggcgtttctacgcgccaagaacgcttcgttaggtgccttaggatgaacgcgattagataagaacaccatcccttgatgggtttgtaaatctaacaccaagcaagttccagtatagccgctatgccagatgcaacggtgcggtgtcggtagttttgcgtctaaaagtgcccagccaaatgatcgccattggtgatgcaaaggtgtctgatcatttaataattcagctttttgtccagtggttattggtaaattgctatttcccagcatcgccttttcaaagataatcaaatcgtttaacgtgctaaaaagccctgccgaaccacaatgggatttcaacacaaacgctttaggatcatggactacaccacgaataaggctgcgggtaggcgatagttcagttggcacacactgcattgggtcagcaggctgaaaagtactgtcattcatgcctaatggctgcaaaacattctcagtaattagcgtttgaatgggcttgcctaaaaggacttcagcaatccaccccagaaaaatgaagttgatatccgaatacaccattttttgttcaaaattctcgcccacatgcatccccaataaagcctcatgcagctcgtttgcactaagtttatttcggtgcgggatatagcccgttattcctgaagtgtgggtcagcaaatgcctaaccgttactcgagtatcctgccaagctggcaggtaatcatgaaccctatccgttagcgcaagctttccagtagcaatcaactgtaaaatcacgttcacggtacccactaccttcgtcagagacgccaaatcatacagttgattaggctttaagggctcatagcttgggactaaggcctcagcaccgtataagcctgtttgcacgtgccggtcatcaataaaggcgtaactcacacccggaaccgttccgtcattaactaactcggttattgcttgaaccgttttctcatacatttaaattccagactcccttacacacttttctctagaataacataaggccagcaacttcctcaaaattgggaaagcgactggcctcatctttactaaatcgattaaaattaaagttcgactttttgaatccaaccttcgggcgcttctacgtccccaaactgaatcccagttaacgtatcataaagtttttgggtgactggaccaacttcagtttcgctgtaaaagacgtgaagttgacctttatactcgataccgccaattggcgcaataacggctgctgtacccatggcaccagcttccgtaaagcgatcaaggtcgtcaatataaacgtcgccttctaccggcttcattccgagattatgctccgccaaataaagtaaggaatacttcgtgatacttggcaggattgaatctgatttaggggtaacaaattcattgttcttagtaatcccaaagaagtttgctgacccagcctcttcaatcttagtgtgcgttgctggatcgaggtaaatcacgtcggagaaacctgctttatgagcctcgtctccgggtagcaagctaccaccgtagttaccaccaaccttactctgaccagtgccgtgaggagcagcccgatcataatacgaagtcgtgaagttagtaggtttgaccccacccttgtaataggcaccaacaggcatcgcaaagaccgtaaacaagtactctggtgcagggtgaaccccaacattgggaccgacaccaatcatcaatggccgcaagtacagcgtaccacccgtcccatacggtggaacgtagtcagcatttgcttttacgactgattttaccgctgcaataaacttatcctctggaaatggcggcattaacaagcgttcacagctcttttgcatccgggcagcattgcgatccggcctaaataactgaatatcgccgtttttagtccgataagctttaagcccttcaaaatcagcttgaccgtaatgtaatcccgttgagccttcgctgatatgtaacgttgcatcttcagtgagttcaccgtcgtcccattcgccgtcttgatagtgcgctaaaaatcgatacggcagatccatataattaaagcctaaattttgccaatcaatttctgatggtgctggtgcttttgccacttaaaccactccttagcagatcttattaaaaatacatgagcattgttctttgattttaatagattgtaggctgattcattcagggtgtcaagcacgctagccattccacgataacttcctaatctcttgcgacaaactcccaccatctgctacaatgtcaatgcgacaaaacgcatacagagggaaaagaggttaattacttggcaagtaattctgattcaatttataacgtactcacttttgttcagcgccatccagaccgcgtgatcttcaacccgcgggagtacgctaatacggtgactgttggcattcctgatagtgtaaaggtctctaatcctgaaatttattttccgagtgaccatctaagtgtcaatctcttagcagactcattcgttggtgaatatggtgacctgcttaatcatttctatgaattaacgaaacaatcaaaacctgactttcgtgaagtttgggtcacaactagccatttaaaacatcagaatttatatctattagacctttcctttgaataatgagtatgctcccaaactcggtagattccagaatttaacgcaaataaacccattccggcaaattttgtcggaatgggtttatttgcgttaatagccttgtggcataacgctcatttttgtcaatttcagcatctctatcacgtaccgcacctttaattagaaaaagcgttgataagccagctccctagtagtacgacaacgatgatcgcgaaaataccaatgaatgacgatgcgaacgctaaaatcaaaccgccgataatcaaaattcctaaaattcgaaacaaccagccaaaaaggccaagaaaaatccgaaggccaaagaaaataatgaggcctaatacaatcatcgttatcattcaacccacttccttcctaatttcctaatgacttggcaatacccttgaaatttctgtgatatcaatgttaacttccgtgatgctgctgccaagactggattagctgcttggacatcactggtgtatttttaacaatgttttgcgcaacgggtgacgcctggtactgagactgaatccactcatttgggaagagcagtaaaatattaagcaccaaaaaaatgagtagataacgtacaataaagttcaatgcagcaccaatcaacgcattaactgaatgaatcagcggtaaacgtgtaatgaggttaagatcccgtccaatacgacgaatgacggaataagcaaaactaaacaacacgaagaaaacaacacctgagagcattcttggcaccggaacggttaccgaattagaagaggtaaacgcgtggaataaaaagttagccaatgtctgactgaaaatagttgcaacaacccacgcaacaatgtaagccagtaatgagatcactacggctacgaaacctctctggtaacccgaaattaaaccaagagctaatataataatgatgccccaagtaaaaatcatagcaacccccacttgtcaaaattctgtatagactactttagcaaaaacacgggaaaaataacccaatattgtcagaaaaaaataaaaaattaaacaatttcatttcttattatctgaatatagaaaaacgatgacatttgtatttccggcatctatttagtgccaatgagacacatttaaaacaacaaaaaaccgttatcgttgagatatgaatgtcaacaataacggatgaaataagattgggtatactgggctcgaaccagtaacttacggattcagagtccgctgccttaccaatttggcgaatacccaataactatctgacaagataatagtttagcggtttttgaaattattgtcaaccagaaatgagtaaattacagataaaatgcatgattaataatctctaacgaatattctatcagatacattgacttttaccttgaaatcgtgtaaattaatatattgtgttaagacatttaaataggtgtcattcataaccttgcccgctggtcaaattggttaagacgtcgccctctcaaggcggagttacgggttcgatccccgtgcgggtgatttctggaacaacatagagaaatgagcaagcttcaaaatgccgttaaactggcattttgaagcttttttctttgccttagttccctctgaaagacatagaaacacaaatagttttgcatttattttgcactttcagaaattattgccaaaataatgcaaaatctcatttggttgatagctagtatttatatttttaaatgtataataataaaaccactttaaaaaaataggtttaacccaatttcaataattgagtcaaacctatttttaaatcacactttaaagtcgtttgttaagcttttcgcccagttcttcaaaacctggtttcccaagtaatgcgaacatattagtcttgtaagcttctactccgggttggttgaatgggttgatcccattaaggtaacctgagatggctacagctacttcaaagaagtaaatcaggtagcctaacgtatattctgactgatcaggaatatgaacactcatgttaggaacgttgccatcagtatgggctaacgtcacaccttggaaggctttggtgtttgcaaagtgcatagtctcaccttcaaggtacttcaagccatcaagattttcgtcttctttaggaatatcgatatcatggttgggcttgtcaacgaagacaacagtttccatcaagttacgaagaccttcttgaatgtactggcctaatgaatgcaaatcagttgagaagttagcagatgaaggatagattcctttctcgctcttaccttctgattcacccatgagttgcttccaccattcggcaaagtactgcatattaggttcgtaattttctagaagctcagtagtgaatcctttccggtacaaaatgttccgataagccgcatattgataagcttcgttattgttaagatcggtatcagtgtacgtatccatggcatcggcagcacccatcataagttgatcgatatctgcaccagatgcagcaattggtaataatcccacggcagtcaggactgaataacgacccccaacaccgtctggaataacgaaggtctcgtaaccagcagcatcggcttcttgcttcaaggcaccacgttttttatcagttgtagcgtagatccgagcgtttgccccgtcttcaccatactttttaactaatagttccttaaaaatccggaaagcgattgaaggttcagtagtagttcctgatttagaaatgacattaactgagaagtcacgatcgccaatcagcttaatgaggtcatgaacgtacgatggactcagcgagttcccagcaaataagatctgtggtgtttcacgctgtgcatccggtaaatagttgtaaaacgtttcatggagaaaatcaatggccatctttgcacccaaatacgatccgccaatcccaattacaactaataccttcgaatcagactgaatcttctttgcagccgccttgattcgagcaaattcttctttgtcataatccttaggtagggttaaccaatcacgaaaatcactacctgcgccagaacccgttcttaattcttcgtctgcagcgttaactaacgcttgcatttcacccaattcattgtcgtgaacaaacttatcgagttttgaagcgtcaaaggaaatgtgtgccatctaactgtacctcacttttattttgataaaccccattataaacgattccgtcgaaaaaataaatggactataccacaatttaattattttaacagtccaagtataacactaccgacaataactaagattgatccaatcgtaatatacaacatttcgcgacccgttttcttttcaccaagcagcaaaatactcccgaaggtggaaatgatgataccactttgtgccaacgaatagctaattgctaaaccaaccgctggaattgacatgaacataaagaagttaccaattccccatactaaaccagtgccaatgttctttaccattggtttaccaaacggtttgttacgtgccgcaaaaagaagtgcaccgatcaccataccgatcgattgaggaagaaaaacagcttttgagtttacaccagatgaattgacgatcacagtatacaacgtataaccgatagttgaaaaaattaaggctcgtaccccagcaccggcgttgtatcccgttctagagacgttagcgcgatcacgtaaagaggtaaagacaatcccaatgatcaaaacgaccattgcggttgtccctaaaactaacattctggtagtcgtccattcgtggaacaaaaggacaccggccaaagttgtacaaacaagctgcatcccggtcgaaactggtacagtaaccgagataccgatggctttcattgattgaaactgttgaaattgtccaactgcccaaaacaggccagaagcaattcctaccaaccaaacaaaaccagttaaatgggggtggaaatagaagacgctaaaaatcccaaataggagggcacctaccgtcattcctagggtttgctggtatgaggtaccaccaagcttaccactaattaatccaatgctcccccaacaaatcgcggggattaaagctaaaagtattgccatgaaattcactccgttctctctttcatactctaaaacgtttttgaaagcgctttattctcttttcatctacactagtttactagaattttgtcaaaaaaaaaaggattttttacgaaatccttcattcttaatcattttctaaatagaagttcatttattcaaccgactttttatcgggaaaaataacggtaaacgttgtcccttgtttgggtttactcgtcacttcaatcttgccatcgtgaagtaatactaattggtgaacaatagccagacctaaaccagactcaccatatttcgtattcgttcgtgacggatcagccttgtaaaaccgttcccagatatttgctaattgttttttggtcattccaataccagtatcactgattttaaagatggtttcttggtaaccccgttgtgccagaacaacgatttgaccattctcagtaaactgaatggcattctgagtgatattgaacataatttggacaaaccggtcgtaatcggcgtacacctcaatatcagtgccaccttgaatactaattgtatcgtttttagcggccgctttttgagacaactgttctgccaaccgatttaacgtgtcgattgcgttgaattgctgtttgttcaaaataatttgattatttcgaattttttcataatccagattctcattaactaaacgaatcagccgtttcgtttcatttcgcattaaatcaatactttcagacttactttcttcgggaattgcatcgtacgctagtccctctaacagcccattaatcgtagtaagtggcgtacgcatttcgtgtgccgcatccgccataaattccttacgacgctgctcctggcgctgaatttccgcctttgactcctgcagcgaacgagccatattattgaaatcgttagctaaatcatccacttcatcccgatttttacttggtacctgcacatcataattaccgttagcaatctgattagttgcccttcgtagccgatcaattcgtaacgttaaataacgggcaatcaagaaggctaatagcattgccaccaaactcgccactaacagcgctcttgttagattagcattgattttagcaatattagaattaatgttcgaaacataggcccctactttgactactgctaccagatgttttcgattgtggttatcagtatagaagtagggttttaaaatatccgtcattgccggctcagctcgaccgctagtagcgtgagtctgttgatctgtaaccttttgaacaatttttccctgctgtaacttttgccaatctgaatgcttaatttttgaaatataaacattatccgggaaaatggcagtattatcgcgattataaactgtaaaatgcacggactgattacgtagcagcacctcactatttaataatgattctgaatcaaaattcacgtgagaaggattatctggtgaaactcgaactgattgttcgactaagctgttcgcatatttttccagactcgtccaagtattttgatagacgtattcctttgtcattctgctaaaggatacaccaagaagaactaatacgatggcaatcatcgatagcaaagcaagtaactgctggtaaaccagtttcatgactcgtcagcccctgtatcgtcgaacttataaccaacaccccaaacggtttgaataatttgaggtccaactttttcgattttttgccgcagctttttaatatgggcatcgaccgttcgctcatcgccataatattcgtagtcccaaaccaactgtaaaagctgctcccgggaaaatacttgacgtggtttttgtgccaatgtcttgagtaaatcaaattctttaggcgttaaatcgttaatctgcttaccgtttaaataagcttctcgggtcttgctattcaattggaatttgccagtatcaatgtcaaatttttcttcttccttaactactgaggcggatactggttcatgatcagtcatcttaccgccaatctttgcccgccgatccaaagccttaatcctagcaatcaacgtaatcggactaaagggcttagtcacataatcatcagctcccatttccaatcctaaaacctgatcgctttccgaatcacgagccgtcagcataatgatgggaactgtgggcgaagtcttacggatttctgcactaacctgcataccatccattttaggcaagttaagatccagtgtaatcatatcccagtcgtcagaatcctcattaaacatctggacagcttgctcaccatcatacgcaaagtgagcatcccagccctcttttttaaaaaacatttgcatcatttcagatacagatttattgtcttcaatcattaatattttcatcatagatcctccgtaattaagtgattgcttatactgaaattgatgcggtaaaaccgttctgattatcaagtatataaatgatcctatttatttttccatacaccatcaatggcatatccaagatatagaaatctgttatttattacaaccgttcttattatactcgaagtgtgtcattcatcacaaatctaatataagaatgtgctacaatcaaaataatagagtaacaggaaaggtgcattgattcatgacaaaagcaatcgtcttttttgacctagatggtacattactgaataataaaacccagttagatcctgaagtcattaacgccgtgacacagctaaaagccgacgatattttgccggttattgcaacgggccgtaatatttttgaaattaaaaacgtgcttcagcaaactcaaattgatacgttggtttcagcaaacggcgcttttatcgtactaaatggtaagccggttgatgttaccgatattccgcgagatgtcattaaacgattggcagtgctggttaaaaatcacgacgatgcttatgcaactctgaataatcagactgatcgtatcaaccgaatgaatgaaaatgtcaaaaaagtctaccattatattaatagtccaattccaattattgatcctactttctggcaactttatccagtgcaaatgatgctgatcattgccaccaatgaaaacgatcaggattacctggacagtttcaaagatgaactcaccttcttcagacaaacaccatacagtattgacgttgtcggaccgggagtttcgaaaaaagcgggtattcaaactttactctctcgcccagaatttaagggtgtgcccacctatgcatttggtgatggtaacaacgatttgccaatgtttgatgccgttgatcacgccgtggcgatggggaatggccttgcacccgttaaagatgcggctgagttcgtgactaccgaaaacattgaccatggcatcgtcaatggcctcaaacattttaaactactttagtctgtacaatcaaaataactcaaaaacaccatgagttccctaaaaatggactcatggtgtttttgttgatctgaaatatgcctacttgctaataggtaaagttgtgattaaatcaagtttcttgcgtaaacgtattgcatgagtgaacgtgtttcggtgaattcatcctcatcatgcaggacaacggtgatcagtcgatcatgaccagatttttgacccgttccgacgaaacaatacccagctaatgcggtgtaacccgtcttcaatccgtctacctttaaagctgaatcatagtacttccgtccgggtaggagattattgtagttgtaacagagttgaccggcaactgtcagactaccacgactgctgtcagtcaaaactgctggatagtcagtaatcaaatgtttggcaatcaatgcaacgtctttagcagaaaccatgttggcatcaccaccactgactgaataaccataactgcgcagtgcagattgttccataccattggcagaaacataggtggcattgcccaaattccacttcttggcctgagcgttcatcattgaaataaacttggtgttataagatggtgttgaaccaccggcaacccactgacccaaagcaattgcggcgttgtttgaagattcaatcaacgctgcttggtagagttgcttaacagtgtagctattctgagtgaatttgaaaccgccatagacgcttgaggtccccattcgcttaagaccggaatatgaggtcgttaccttagaattccatgtagaaccagtattagctaccttttgttcaactaagtacagcgtcattaattttgaaacgcttgcgatagctcttggcgtgttagcattcttagaccacagaactttgtctgttttagcatccatcgcaacggctgctttagcatatttaagggttagtggtgccttccccttagctaaatagctatgccatacatagccagaaacggtaccagcaccgtttttaacggcgtagtaaatggccttggtcgatccatgtttcagagtcactttcttagttgcgtaccaagttgtgtttgggtaactgctcaagttagctaactttttagtgtggctgagattgtaaacagcccccttactcgaagcacgatgataggctgttttagtcatattagagctgctaaccacactgtaggtagctgcagaagcggctgcaggttttaatgacataaaactaaacatacttaacagtgcaacaactgtgattaaaataattcgcgaaaaacgatttgatgaagttattgtcatgatttcctccctttctctttacttccaagttagcatgataaatatccgctgacaacgatatctgctgaattgtaactaaactgtgcggttgtagtcaccggattgtaacggccttgacattaatcatgaaaaaagttgatttatactgtaaaattacgtgttgacaaatacgttgaaactcattagtctgagtcataggtactaatgaagcccgtcattgtttgacgggccttggttggtttacagaaaagtttcttatttcaggtaagaagggataacatgtcaaagtttccaacgtataattcacaacagtgggctgaagcccgggacgctgtgatgcaggagtatcaagatttcgttgaggatttgagaactcaaggggtagattacaccatcaaaaatgcccgtaagttgctgatttttcaggatttgattgctgaatggcaacatcatttaccaaccgttatttcggatctggaagaaaacacatttgctctgtcagtgtttgacgagcttaagaaacataaaaaatgttcattattggaacgtgcctatagtgatatgtcaacttggtccaactttaatccacaggcattgacactctggctagaattatcagaggatgaagccattacggagttttaatcacggaaactgcagtcgtttagctttctaagtcccatataatatgctaaactatagattgtagtttttatggggatgttaaggattcgacaggtataggtcgaactcagactgcgtttcgtagcgagggtctacgtaaaaaacctcacctaatttttaactgcaaataacagttcaaaatctcttgcattagctgcctaataagcgctaagtaaggatccgcctaatctcgcccatgggtttgatacgggtcttaaatgaagtgggcttacgctgccggctcccatctgaagtcgtcagaagagatcaatcaggttagctgttcatgtttggccctgacaggcggcgaattgatcagtgaactttaaatagtctgaatataaacgtagaggtttgggtggcgatatgcttggacgcgggttcgactcccgccatctccattgtagaatttcagcaagtgctttaaggccttgtaaagcttggtagaacagcttttctatcaagcttttattttgctctcaattgctaaatggcattcacgtactatgtcaatttagaagtgctttcccaaaaatcggaatagcgcttattttctgttgcatatttggtattatgaggtctaaaagacaacctttttaaatttatattctagttaaggaatccatggaaatcctaattaatagcaacccacgtcatatttctgacgccactaatttctgctcctttgatgtccttattacgtcaatgctattattaccttaatcaatccttttacggaaaggagtgttgtcatgaaacaggtcttagttgaactattcgtactgttattaacgattttactgtttctaatcggcatgactcaatttcatcaaccgggtaaatcaagatcatccacgccccagaatattcattctgatgtatatttaagccagactatcattgaaaacgcctacaaaatgtattaaaagggaaacagttttgtatagtcttcgtatcaatattaaatttaatgaatttttctatggcttttaaccttctttctgtgtataatgatggcaacttaaaacaaggaagtgtttaaaaatgaaaacaatcaagattacagactttgaggaaccccattttgattttgaccatttacgcccaattactaagaaagatctgcaacaatttgacgcagcagaactcagttatattcaagctcaccactacgccatggatcttgtagacaatcatttaatttagcccaaaaacagccagataatctttcccatggattgattacctggctgtatttagtttaaagattaatcgttttctggatcatcaagatctcgttcaatatcaataccgtatagtttgttgactgcagcatcacgtggtgcttggtgaaccactaaaatcgtcgtcgcgcctttactgctaacgtagccagcaaaggtagtcacctcttcaactacgtaggccaaaccgtccgaatggataatgtattgcccagcaaccggcatggtttcgaaataaaccttgttcatgcgaatgtagtcatcaccatcgtgtaagaccaccataactttgtacaaactaatcgcttcctttttacccttattgctattaaaccacgattaaatacccgatggcaactagctgatctcatttaaaatttttacgatttaactacataataagcgggatgatgatcatcatcccgcttattgtaactatcccttattttgttgctagatatccgtttgattccgcgtgccgttctgctccccaaacagttcggtatgggaacgcaccatcgaccgaaagcgtgccatagtttcaggatcaacagccttgccttcttggttaacctgctcgactaaaactttctgcactacggggtggcctgaaaaatttatcacactcattagtgatacctccaaagcttcaggacctacaaaccaactcttacaacaagataattatagctcattacccatgattggtctagttatagcatcataattttccaaattaacaacgggttctattatcagttaaatgaccattgtatagagtatgattagtcaagtaaaatctaaatttgtcaaagttaaaaacttttaattaaaaatatcataattggtatagttgagccgacaacgttgcaattttgggttcaagcctctaaaatgatgaacaaaaggggtctttttcatggcagaaacaaaacattacattcacaaatacgaaacagaagcaatcaacaatgacggcgttaatggtgtcgcctacattcctaatggtttggcggtagcagtcagtcatccgttaaaagacgcccctggaaccaatcccgaacaattactagggttatctttaagcacttgtatgtcagctaccttggaagcaatcgaaaaggaaaacggtttgccacatctagctgaagtccacgtccatgttagcatggtcaagagtacggatggccttgattttttagttacggctcgaatccatattcctaacatttctcacgctcaagctgtagattttgttcaccaagctgaacaccgctgccccgtttctaaactattaagcaatagtgctaactacacgattgaagtcgttgatagttttgacgactaactaaaaagcaccatttgaaccgcaacctcaaaaacgctacagtccaaatgatgctttttgtatactattaattatcttttgaatcttttggctttttttccaaattggctgcttcgctaaaggcacgaataaactgcaacagatccattgcccgatcctcaccaaatatatcgatccagccattgaaccggtccgcagctgcctttgctaatatctcttcaatctgttgaccgcgcggggtcaagtgtaaaaactgcctacgataatccttgtcatcgcgttgctgatatatgtaatccagtttcaataaaactttaatctgacgagaaatagcgctgcgcgtcacccctcgtttatcagcgatgcgtgccaaggtaacgtgagattgtttagcgatatcatgcataatgaggtactgttcaaacgacaagttatacttcatccccggctctgatacaaatgaatcaagatatttaagtgacttcatatagacatcaatgtattcatctagtaattgtgttcgttccatatttttcaccctaacctatatagctttcctagcattagcttatcattatccacagtaaattaccacatgtaagcgataatactaggctcccaacacttaacgctgtgcagaatcgaatacgccataactgcttaccaaaacgtcacctcagtttaaccgataacaaaaagagtgtaaaattaagccaatatcaaaaagggggcaaagcttatcgatttagttgatcgaattcaccacgttgaactaggaaacctcgcaaaaatcatttcactctgcgaccagctatctctcaactatttcttgattggtggttctttattaggtgccattcgtcaccaaggatttatcccctgggatgacgatatggatattgggatgacccgtgctgactacgagaaatttgccaagtacgcgccagaaaaattaggccacgaccattattttctgcaaactgcctactcagatgatagctacggcttcagttatatgaaactgttagatcgatttacttatatagaagaaaagggcaacgtgaacaatgcgcgaaaaggcgtttttattgatatctttccattcgatcggattccggatgaatcttctcaaaggcgtagtcaatttgctagatttaagctgctagacagccgcatcattttaaaagcgggttacggattgattgaaaaccctttgcgtcggcataagccagatcccggacccgataaagttgaagatttaactcaattgaaacgtgaacgagaagacgtcatgcgcctgtatgatcatgatcagtttaacttctacaaaaacttagcttcgcagtacggatacgatcatgagattctttccggcactgaaattagtaacttaactaaggttccgttcgaatacctacaagttaatgtaccaacggcttacgactcaattttgacccgtatgtacggcgactatatgagcctaccgcctgaaaatcaacgaacagagaaacatatcagtaagttaatcatggacaaccaagtcttttattaaatttttattttggaggcgattactttggcaagccattactttggtacaatgattatctcagtacagggactagagcttcttattgttgatctaaaatcccttaaaacaattgagcgagtccacaaagagctgccggttggagacgatttataccggcatcaacccattaaatttgaattggtaaatcaaatggccacttcgttacggggctttttgcagttgttaaatgactaccagattgaagattatagactatggggcagcgaagccctttcaaaggcaattaacgctgacttcatcgccgaccaagttttcttaaaaactggtcttaagttaaactggctctcaattagtgaagaaacctactaccgtaaccaagcggttttagtcgacctacggcaaaagaaaatctcaaccagtcaggatttaacttacttaataggtattaattccggcaatacaacaataactgagttcaatcacttatcctttatctattccagttattattcactaggacccgttcggattgctgaagatctgcagagtttgcgtcaaagtgcaccaaattctgtggaagttctgagtgattatattgatagtaagctttcagattacaaacgtttactcccacaagaagctattgatggtccgagtgaactaattttactcagttcgatgcccttaagccaattaactgtggtaaacgatcgacagcacacgctaacggcggatcaattcgaaactattttcgatcacgtcatcgatgcctcagatcaatttttaatcgaggaatacggcgtaaaggaatcagaaattccgttgctgctacccgaactcttattggtccgtaaactgatgcacctcacaaaagccacttcattgcacttttcccgtaataccgtactagacggactggcgattaacgaggccgtccgtagtggctacagcaagtatgatttttctgaacaaaccattactgctgcttctaatatggcgaatcattaccgggtagaacctgtccatcgtgagctggttaccaagtttgccttgcacctttttgatcagttaaaaccgattcatcaactcacgacccgcgaccgcctattattgcaagttgcttcaattttacacgacgtcggtgcctatattgccgctcatgaacattacttacactcggactatatcattcgtcataccagtatcactggtctatccgttcacgagcgtcaaatcattgctgccatcgcccgttaccatagctctaccacccctagtgaagatctcagccactttcagcaactggatactggtgaacgattactggttgccaagctagcggcaatcctgcggctggcggatgccctggatgatgatcgacagcaaaagattagccgcatttcggtttcaattaaatccccagaactagtcatcacggtttatagtaatgaaaacttatcatttgaaaactgggaattttcatataagagtcagttttttgaggagacatttggcttgaaaccgagactaaagcaaaggagcgtgacttcaaaatgagtgataagaaaaattatagcaaccccgattattttaccaaccgggaattaagttggctcgattttaacgatcgtgtgcttgaggaatctcgggataaaggcaacccactccttgagcgattaaagttcctaagtattacccaaagtaaccttgatgaattctttatggtgcgagtggcttcactggctaagctagccgcggtcaactaccccaagcctgatgcttcaggtatgaccgcagaagaacaattacgagcagtaaacgttcgcgcacatgaaatgctggttaaacagtacacaacgttaaaccgctcactgattcccgcagttcagcaaattggtgtccacgttaaaaaagcaactaatttaacggctgaacaatttcagtttattaagagttatttccatgacgaactgtatccggtattgacgccaatggctgatgatagttccagacctttcccgttcattgccaacgacacactcaatctcgccatccaactgacaccccatgatggtgacggccggctttacgctaccctgcagattccagatgtctttccgcgggtagtccggctgcctggagaagaaaatgcgtttattttaattgaggaaatcatcaaaacctttgttggtcaacttttcgtcaattacaacgttaaggaaagcgtggttttccgtgttattcgtgacatggatttggacgttgctgaagaagatacctctgacttattaaaagatgttcagcaacaattaaaactacgggaacacggcaaagttatccgtctagaagtggaaaataccattagcaaaaaactgttaaaacgcttaaataaagaactggatacccccgacttcgctgtttacgaaacaagtggcccagttgatttaacctacttaagcaagctagttagtcaaatcatcaaccacgatgatctgaaatacgctaactttaccgcttatcagccaaaagaattagatcataaccatgatatttttgcggctattcggcaacatgactggcttatgcagcacccctatgacaagtttgacccagtagtggaattcatccgtcaatccgcaatcgaccccaatacgttggccatcaaaatgacgctttatcgcgtatccggtgattcaccaattatccgttatctaggtcgagctgctcaaaacggtaaacaagttaccgttctggttgaggtcaaagcacggtttgacgagcaaaacaacgtccactgggccagacagcttgaaaaaatgggctgtcacgttatttacggtctgattggactaaagacccactgcaaactgtctctggttgtccgacgtgaacaaggcggtattcgtcggtacatgcacatgggtaccggtaattataacgatgtcacggcacatttttacaccgatatgggacttttcactgtaaaccacgatatggggatcgatgccaccaacatctttaacatgctatctggctactccaagccaccctactttcaccagctgcatattagtcctgacggtatccgagaatttatttacgataagttaacacaggccggtgatgcggctaagaaaggcgccaatgtcaccgttcgtatgaaaatgaactcgctgtccgaccaaaaaatgattgagcacttatacaaagcttctcactgcggtgttcacattcagctgattattcgtggtatctgctgcctcagaactggcattccggatatcagtgaaaacattaccgtccactcaattgtcggtcgttttctggagcatagtcgtatctacagttttgatattgacggtcaaaggagcgtctatctttccagtgctgatttaatgacacgaaatttaaatcgtcgggttgaattacttttcccaatattacagcctgatttagccgaccatgttttacaaatctacgatacgatgtggcatgataacgttaaaacacgggtgatgcaaccagatggctcctacacgcatattgatcgtcgcggattagtaccgcttgaatcccaaacagcctttgcgcaagccgccacccagcatgtccagcaagatcaagctgaagcagcaaagaccgcaccaactgaatttcaacccatgttaagtcctgaaaaccaaccgaatcctttaaactacgatgatgggagtgaatcagactaatggaaaattttgcagtgattgacttaggatcaaactcagcgcgcatgacaattactcaaattgacgatgacggaacctattccacagtgaaacaaatgaaagaatacgtccgcctctctgaaaacatgggcgaaaaaaaagtcctgcagcccgaagcaattcagcgcacgatgaatgcgctacacgaattcaaagatgtctactcaaagctaaataacgtccatctcaaggcggttgccacggctgctacccgtcaggccagtaatcaaaaaaagtttctgaaacgcgttgaaactgagctggacatcaagttagatgttctcccgggtaccatggaagcttactatgactatcttggcgtaagcgaaacgttaccagcgactaacgctgttattttggataccggtggcgctagttcagaaattgttctcgttcaaaacggtgcaattagtcatctcatcagcatccctcttggcagtgtaaatttaacccagcagtacctctctactgatcaaatttctgcctcaagtctatttgaagtgatgaccttcgttaatgatgtctacagcagtatctggtggctgcgtaacggccttaatttacccgtcattggtctcggcggcagcaaccggacaatggccaagatcaatcgtcgctttaataatatcctcaactttgaagatatccacggttatcgactgagccgccattccgttgatgataccttctccaggatcgttagccaagacttagaaggccgaaaagcaatccctgggctcaataaagaccgagccgacatcattgttggcggattgattccattgaccttattgatgcgttatcttgattctgatcgcatcaccttttctaacagtggcttacgcgaaggtattttatttgaacacttaaaagaactacagttacacaacgtccatgaaaaagcagcgatgactctaaaccgtttcacaactgacgaagcgtgaaaaccgcaccaaaagtgatcgattcagaatgacgacaaaaaaatctggcaaccagttaagttaactgattgccagattttttattaggcttaaataatctcacccatcgatttaaaacgtactgccccggctgggctcgaaccagcgacctcttgattaacagtcaattattctaccactgaactacggggcaataaaaacgccatgagttatttataccataactttccacggcgtgcaatattttttacaaaatttatccaatatgattttcttttaacaccatattgacttcatgctgaatcttttcaggttttttccattcctcaaaatgatccattgcctcagttggcatttcataattttcgttgatatacttctcatacgcttcaacgtgaggagaatgtggaatattcaattgtaaaattcgcacttgtttaataaatccacgttcagccgctaattcagcacgaccattttgcaccatattactgatttccatatacttagtgccatccagacgggtaatttcttcgatgagtgtaaacgtttcgtgactcttcatcaataattgattcctctctccacttttaattgctatacgatatattctaacataatctcaaataccctgaaatcggtcaaaattagtgatgcctgtcctttggttcagtgcgtcaatattgcctaatcgtgcgctaaaactcagattccggaattttgtcacacgcgcatacaaaaagccactatctgagatagtggcggcataagagagaaagagaattgattagaaggtaattaattcataccttacaagaaatactataaatcataatgaaagcgctgtcaatcttttccaaatttattctccgtatttattaaaaaaagcttcaaccgtttcactggacggttgaagctctaagaaaaactaaatgtgagaaatgcccttttcgttcaaaaactagtcagggggtaaataaatggttagttatactataccacatattatgagagaaactcacattttttaactaaaaactcattttatttgtgtaaactacccgttttatctacatggctcgttggatgaactaacgttgtcggattggaaaccacttctgtcaacgaatgaccagaaagattcgtccagcacgtaaagactagcagcaacaaaacgaccagtgtaattaaccggctgctcaaggacattttttcactaataacggaaccataaaattccttcttaaccttggctggtacgttttgctcgtctggattctgcttctgccgttcctcgactacggacgcttgataagcatcaatatcgaattgcttctgggcttccttcatcttcaactggaattgtttcttttccttcttatttaaatctttaaaccacttaacaaattggcgataatccttcacgattgtttcagtatcaccgacttcttttaagttaccgtagtgaatccaagcaacccgatcacacagcatttcgatttgtttcaatgagtgactgacaaaaataatggttttgccttccgctttaaattcggaaattttgtccacacacttctgataaaaagtatcgtcaccaaccgaaagtgcttcatcaatgatcaaaatgtcgggattcacatgtacagcaattgagaaacctagccgagatttcatcccgcttgaataacttttaacgggttgataaaggaaatcaccaatatcagcaaagctgacaatatcatccattaagccatcaatttcttcgttggtgagcccctgcatcaaagcttttaaacgaatgttttcgagtcccgttaaattaccacgtaagcctgcaccaatcgcaattattgaagtatctccacgaacatccacgataccggttgtttggggaataataccagaaatgatgttggatagtgtcgatttacctgagccgttaacaccaattaagcccagcgtctcacctggcataattttgagggaaattcccataagtgaccaaaagtgtggtaccggtttacgattcagtgcaaaaaaagcgcgcagtttttccgactgagttttgaataaatcatactctttggtgacattttgcaccataattttataatcagttgccattttttaaattcttcctaacatcttttttcgatttataatgccataaacgccattatatcagagaacctaacccgtgtcttgctacctagttagtgattctttaaacctaaaatatcggtaatttgaatccagccagtgacagaaccactcttaacttggtaccaaatcgtctgatccttagtcacgattccgcgagccatcactttgacttttttgtttgccaactgcttggtccgaacaacctttgctttatcagttgccgttggcacaccattataaaacttgatcgtacccggctttaccgttgcggaaccttcgtaactcgcataatctacgccaggggtaatcctggtgctcgtatcagcatctgtactattagcagaagttcggtcaaaacgatcgtgcaagtcatagtccgcaatgattttgttcagcttgttagcatagtccttatcagtagcatagttttccgcaacaatgttagttgctgtcatgtatgaactagcgttttctcgccaagcgccttcataaaggaagggattccaagtcgtaccgccacgtaacactttagcataatcgtttaaagaagcctgcgctgaaggataaaccttgaaattagccagcgtattgtacattgagccactagcattagcttcgttagtcgacatcgttatcgaatgcccatcataattacccttaacaccgaagtaattatgagcatccatcgacagctgactggttccccaattactttcaagagccgcctgagccatcatgactgaaccataaagatgattctggcgacttacttttaataccggctgactcagtcgatcaataaaatcagtatgtgcatctgcctgcgcagtttccgtagataatacactgagtccgagtatcgataccagcataattgtcagttttttccagagcttcatcttaaaagtctcccatctaaaatactaaaccgttaatattatatcggtttctgaagaatgcacaagttaatatttgataataaattgaaaacttaaacttttaaaaaaggcccgtaccagaagcggtaccaggcccatttacatttcctatttggttatttcttcacggctaaggatgatacccagccattaattgaacccccatgaattcggtaccacgtggtcgtaatgccattttgaatatgagtggccttatcatcgattttcaccgattgattaaccagcgctttcgttgtggttaactgttttgcaatgtaagtagaattgaagacatgattgtaaactgggtaggcgcttccgactaacttaaccgtttttttatagctagaataagtcgtctttgggaaactaagtgcgcttgaataaacccaatactttttcgccgtggtttgtttactaaaccgaatgcgataccagttggttttggtactaaccttataaccacgcgcatctatccaaacgggtctgccctgccagcccccaacttttgaccagccgtaattagtagctttatatttgctaccctttacatgattgtaaactgcatagcttttatatttcgaacctaacgtcgctgtttgattgtcggcaccaaaataatattttaccgcgctagcgttactagtcggtttcttgcttggtactggtacgctatccaacgaataaaacttatacgtttgaatcagattaatcagtgaggcgccatagtttggcgcagtagcgtaagtccctgttaacgcattagccgctgccgcataggttggcgcattctctcgccaagttcccgcatagtaatttgcgttccaagcagtcccattacgcaaaagctgagcattatccgtcatggatgcagtggcatccggatattttttaaatgccgcctgggtgtaataaagctgaccattctcgttatactctgcagtactcatcgtcacggaagcaccgttataggcgcccttaataccgaagtaattattagcactagttgaaagctgactcgtcccccagccactttccaacgcagcctgtgccatcattacggatggatacaatttgtattgatcagcaacttttttaacaggcgatgacatatgattaataaaactgtccgtcgtcgtgcttgcttgcactctggtgtgcccagcaccagataaaccgcatacgactatgccaacggtgagtaaccccaccatccattgtttccgcatgtgtgcgtccccctcagatacaacaatttatccctattataattggaatagaagccgaaaacaagcacggtcagctatcctctgtaataaccgaggaagctgtgacaaaattcgatagattccagagttttggcgtgtaattagactgtatcaatatatagaattaaaggacagtgacaactaattatggctaataattaattgaaatacttaccaatatagatttatggcacagtatccttggtttcgttaggaacaaaaaagaagaccgacattactgccgctcttctctcttatgcttgcttcaattctctctaaattgaattagtattcttcacttaacttacttgccgccgcttcatcaatgataatcgtcacttgatgatgttgctgtagaaaactagctggaacatcggtggtaattgggccttcaatcattgctttcaccgcatccgctttttctggaccatatgcttccaaaagaatgtgcttactcgttaaaattgatgcaattcccattgagtaagcgtaacgtggcacttcatcttcattatcaaagaaacgtgcattggctttgatcgttgattcagtcagagctaccttgtgtgttccaagtgccggatcagtgccaggttcgttaaaaccgatgtgaccgttttgaccaagccctaaaatttgcaaatcaattgggttatccgcaatcacttgatcataacgcttcatctcggctgctgcatcgctgttcaagccattgggcacgtatgagtgtgcaaatggtttttggtcaaacaagtgcttttgcatgaagtaatgataactttgcggatgatcaggcgctaagccaacgtattcatccaagttaactgacgtcatttgactaaaatcaagatcactcttggtaagttcctcataagttgttactggtgtactcccagttgctaaaccaaacactttagcgccatcacggtaggcattttcaaaaacttcgaaacccttctgtccgccctcaatacgatctttaacgacaatcacattcatttttgcttttgttgattctgacatgattcgccactccttttgttggtatagcccaataataagtcatctagaccaatattgcaagaaaaatgaccaattctgtttaataacttactttccgactgctccgctgcctgtcaccacgcttattggcagctaatgtattttgctgcgttttaaactttttccaggtagcatcgcgcttctcagctgcttgcttattttgactacgcttcttagtgaatttcatttttatcgtccctctctctattgcgcgattgtaccacgctaagctttcagcgtctacgaaattgcttgaaagcgtcaaattatctgtttcacaaatagtctgctttcgccaataattctacaaaagcgctataatgaattcaaattccaaacaggaggcttatcatgcaacattacgccagtaagtcgctgaattcagcgaaacgctataagttattatctggaagtattattccacgtccaatcgcttgggtcaccacattaagcacaaaacccaaacagactttgaatatcgctcctttcagctttttttcagccatgtctagtgaactgcctctcatcacactgtctattggccgcaaacatgatcagctcaaagacactgctgctaatattttagataatcaagaagccgtcgtacatcttgtgagtcaatcactggctactgagatgaaccaaacagctgctagcttgccccggggccaaagtgaactcaaccttactcatctcgatcttacaccgagtaaaaccatttctgttcccgcgttgaccgcacccaaagtccggtttgaaactactctttatcagtacgtacccgtgactggcgacaacgcccaggtactcagcgacctttttatacttgaggtcacggacttttactttgccgacgacgtcttggatccaaagacttttcacgttaatgcaactcgtcttggccccttggcacggcttgccggttcaacttacgggacagtcgatgacttattcgaaatgaaacgtccattataattttgcattaaaaaacatcatcatcagttaacttggactgatgatgatgtttttggtttcactcaataattattcaacggtcacactcttagctaagttacgtggcttatcaacgtctaagcccttattaaggctcgtgtaataagcaattagctgcgttggtacgacactcagtaacggcgtcatcagctcatcaacgtctggtagaacaatgtcatcaccgggtttagctaagctttcagaaacaatggtcagaatatgagcaccccgagccatagtttcctgtaagtttgaacgggttaaaccagctgtcttctcttgagtaataatgccaatcactggtgtccccttttcaatcaaagcaatcgttccatgcttcaattcaccggaagcaaagccctcagcttgaacgtaggaaatttccttcaacttcaaagcggcttcaagtgacacgttctggtcaactccacgaccaatgtaaaaggcgtttggcgtattcaagaaagatgctttggctaactcttcgatcttattcttctcgtctacaagtgcctgaatgcctgttgcaaccagtcctaattggtgacggacgtcaaaccgttgtgcaacgatctgattatcagcctcacccaaggccttagcgagaattgcttcaagcgcaatctgtgcagtgtaagccttagtagatgccaccgcaatttctggacctgcatggagcaacaatgtataggttgcttcacgtgataaagtcgaattttgaacgttagtaatagtcaaactttcgtaaccacctgcgttaacgttaactaagacttcacgtgagtcagctgtctccccactttgtgacaagaaaatgaagaatggtttcttagacaaaataggctcttcataagcaaattcagatgaaacatgtacttccgtaggtgtttgagtcagactttcaaacaatcgtttaccaaccagaccagcatggtaactggtaccagcacccacgatataaatccgatcagcttgcttcattgaattcaataatttatcactgatcactggctcgccagtttcagataaataaacctgggctaaacgccgcatcacgtttggctgctcatcgatttctttcaacatgtagaatggataagtccccttatcagtttcgttggcatccatatcaacgtggaaagtcttccgttctaccggcttgccatctcgatcttcaattttaacttcgttaggcttaatggtcacaacttctccgtccattaactccaagaagtcgtgagtttcgcgcaacattgctaaagcatcagaacaaacaacgttgaaaccatcaccgacaccaatcagtaacgggctcttgttcttagcaacgtaaagcgtctctgggtcttcacgatccatcaacagaaaggcatacgaagaacctttgagtaagctcaacgctttggtaaaggcatcatgcgcattaagcccttcttctacagcaaatttatctaccaactgaaccatcacttcagtatcagtttgactagtaaagggaacgtcgcttagatagtcactcttaagttcctgaaagttgtcaatcacaccattatgaactaaatagaaacgatcatcttttgaaacttgtggatgagcattagcaacactcacaacaccatgggttgcccagcgagtatgtccaataccagttgtcccgtgaacttcagggccaacttcacgtcgtaaatcagcaattcgtcccttttctttcacgagaaaatccttaccactttggtcgtttacataaattcccgctgaatcgtaacctcgatattcaagcttttgtagaccatcaagtaagatttttactgcattatcactgcctgtaacaccgacaattccacacataagatttcatcctctaattttcataatattttaattggtatagactcaataaggtctcatatatctatgaacatgtatactttacagtcttttaaattggttgtcaatatttacgtttgaaatggtatagattgaaaacgcgtacttacgttggtaaagctaaaaaaagcggttttcaaacgctattgtttgaaaaccgcttttttgtttcatagaattactcgattccaacttcactcttaaccacttcgacgattcgattaacataaccatcgacagcttcttgagttggcgcctctgccatgactcgcaataatggttcagtcccactaggacgaactaaaacgcgaccatcgccagacatctctttttcaactgtatcaataatccctttgatagcaggattatctaaagctgctttcttatcagcaactttgacgttaatcagttgttggggataatcttgaacatcagctgcaagttcggacaattttttaccggtttccttcataatgtgtaagagttgtaaactggtcaacatgccatcgccagttgtgttaaagtccaagaaaacaatgtggccggattgttcaccaccaaggttgtagccgttagcaagcatttcttcaacgacgtaacgatccccaaccttagttttaacactggttagcccatgtgcttccatggctttgtacatccccaagttactcattacagtggtcacgatggtgtcctttttaagacggccatgttcagacatgtatttcccacaaatatacatgatcttgtcaccattgatcacattaccttcttcatcaaccgcaatgcaacggtcaccgtcgccatcaaaagccaacccaatggaaacacccttttcaaccacaaatttttgcagttgttcaggatgtgttgagcccacctgatcgttaatgttcaacccattaggcgtggttgcaatggtatcgaactcagcacccaaatcagcatataatcgcgaaactaagttgctggttgcaccattagctgaatcaaccgcgatgtgcatgccagtaagatcatcgtcaatcgtctgttccaaaaattgaatgtacttttgactgccttcttggtaatcttcaacagtccctaagcccttagcagctggtcttggtaaagtatctttctgttccagcagcttctcgatttcatcttccagatcatcagaaagcttgtagccatcagcaccaaagaatttaatcccgttatcttcaactggattgtgtgaagccgtcagcattacaccggcatccgcaccctgcgtacgcaccaagtaggccactgcaggcgtagtaatgacgccaagacgtaaaacttcaatcccaacagataagagaccggccacgattgcttcttccaacatctgccctgaaattcgtgtatcacgagcaactaacacttgtggttgctcacgttcagtagcgtgttctgtcaatacataaccgcctgctcgaccaagtcgaaaagccagttctggggttaactcctggttagcaataccacgtacaccatcagttccaaaatacttcatgtttaattttcctcatttccagattatcatttagattcagttgtaatcgttaccttaacgctagcaggatccgttcccgtaaccttgttagcttctgcatctaaactaattgtttttgttttttgatttttaacatcactgacatcaacgtctgcatcaaattctgatatagcctttaactccgactcagaaccaaagacctgaatggacttagtactgctttggaaactatattcctgattactattggcgtttttagctttaaatttcaggggtacctgcttcgaatggccccttgccgtgattggtaggttaacttgggtagtagcaggggtcaagatgacgttcactgtctggccattcttatccagtgcctcgataacggcctcactgttcacggactttttggtattttgagccaagttcaattgtgcaacaaccctactgattcgatcaatctcaccctcagcaccagtggctttaacactggtaacatcgctatttgcactaccggcaacgtaatttttagcaatccgcgtcttatcatactggacactaactggaaaacttaccgtttgtcgaggctgaatattaactttaatattagctggcgcaatttggtagctgatatcacggtttaagccgtcctgttttaacttaaccgaatgttcgccgggtttgagaccagtcaaattagcgaacaccctgaaattttgcgtattcgctgtagcggtaactaaagcggccgggccgcgtaaatgaacctttactttttctggataacccgtgacgaaatacttatccgaatccacgttcaatctcaattgaacggaaacggttttatgttccgtagccgttagggtcgtggaattagtccctcccgtattattcgtttgctgagttgagatacttttagaactatttacgtataaaaataagcagacagccaaaaataaggaaatcaaccgataagtccaacgactattgaaaattttcttcatcaccgattccctcccctaaagaactggataaacaggtcaaccagccagcttagtggatttttcggttgttcaggttcttgatccttgatcaattcgttgttcaaaaacttcaaataatcattttgatccatattacggagcaactcgttattcttagtaatcgaaacttcacccgtttcttctgaaataacgatggttaaagcatccgttacttcagaaataccaaccgcggcacggtgccgagttcctaattctttaggaatcaaattactgtcagacagcggcagataagccgctgcaacagccactttattattccgaataatgactgcaccatcatgcagaggcgtgttaggaataaaaatgttgatcagcaactcgccggtaatcttggcatccaattcgattcctgtttcgatatagtcttccagtccagtgtccatttgaatggtcattaaagcaccaattcgacgtttagacatatactgaatggctttatccagagcggcaatcatctgtttctcagcttcgtttacctgtcgattgcggacaaatacagaaccgcgaccgagatgttccaacccgcgtcgaatctctggttggaaaataataatcatggcaatgacaccccagttgatcacttggtccattaaccatgaaactgttccaaaccccacgtaaaccgcaatgatcttgactaagacaatcacgatgattccacgtaagagctgaacagctttggttcctcgcagcagcataatcagttcgtaaaaaacaaaccagacgacgagaatatcgaggaggtttacgatgttatgccacgtcaaaaagctactccaatcaagattcatttgataatttccctccaaaaatctattcaggtaacattatagcacgctgaccactattttttggaatcaccaacatatttctgatgtcagtaaatacgaaatttcaagatttttgtaaaccaactgaaatttcatgtcactgctcaagtaatctgttattatttgagtagtgatattttgaacagggagatgatctcttggcgggtcacgcacgctggcaaattcggattttcgtagtgctgtggctgttatttttgtggcagttcgcacatgagccttttacttttttaattttaaatactttcttgggctatttgcccatcgaaattagctttcatcttagtaaagaacggcctaaaagcgggctttttttctggttgatcgttcttttgtggttactcttctatccaaatgcaccctacttgttaaccgatctctttcacctttcacttctaaatccttatggcgttgatgggctactacagttaaatctgcatgtttggatttactttacctatcttttgatcagtgttttattctgtgttattcttggcttctggagtttaaactacgtcgccaacgtcatcgctcaacgatacctaaagggaaattcctggcttcagacgattttagttctgattctcactttcctgtcatccgttggtatttacgttggtcgatttatgcggattcataccgtttacctattcatctcaccagaactgattactgaccggttgctacatatgtggacgcctaccatgctcgtttttgttgggctgatgacactcattcagttaattgcttactggctagtatacttagcctatcatagccagatggccaatgaacaggcagccaaagaaatcacggctgtcaaagaggactccgaagaacagcaatcgcaaaaataaatcataccatttaaaaggggaatccagttaacgctgcaatgttaactggactccccttttaaactcctaaattcattaatcaagctcatcattaacggccatcatcaatacgttttcagagtagttaatgtactgccgaagcctccctgacatttgccaagtaatattacctgattcaagcagggactgaacgcctgtccgctcagcacctagagcaatcactctgagctgattaagctgtttagcgtattctgaccgtgaaactcgctggtctttacgcgcacgttcaacgcgattgcgataaaaaacaactaagtgataaatggcttgcttgtccaacgcttgtggatcaacctcatcatcacctagatattttgaaagtgctttgatcgccgatttcgcactttcgcggtcaatcagtagccattcattactagtagccttattttgtgattggtgaacggctgacctaatccattgtgaggtcctgtgaagaaaagatgaccaacttcttaaaggcgcaaaatccaaatgacgattaggatgattaattcgttgaacagcacgtttgatcgttcgactagcggaatggtatgcctgcgatgaaatctgatggtgggcatacagcctatctaatgctgattgttcgcccttcaagcccacttgccgcaaagtaacttcatcatcaacgacctgttttctatcttcatcatcacgcgtttttaactctagcctgcgaataataaactgataatctaaaattaaatcataagcagcacgctgattttcaatgcgacgatgttcttcaatagcattaattgccaaccgcataatgtatattctggcctctgcctcactcagtaaatgaggctcattagactgttgttgatcggtctcattttcatcaagctcatcatccaactcatcactaaaactggctcgtgtctgaagcggcactggattatctggtgccactaacggtaaagtgaccaccgcagctaccaaactaataataatcacgccagcagccacaaataacactaacgaccgctgtggaaacgcctgtccagaagccgtaaccagtggtagtgacagcacacctgccatagtaacggcaccccgaacgcccgacaaaccagctaaaagggccacccttaaactgggccgtctcggtttactgattccttggtacaagtaaatccaaatcactcgaatcagcaataaaatcagccacgcaccaaacgaataaccaactgcttggaacgtattgaagtgaacatcattgataatcttagtcgttgcaagcggcagctcatcacctagaatcaaaaacacaattccgtttagaagatagacaataatatcccaagtcttctcgctaactagtttaagttctggtgagtcttctacgagtcgattcccctgggtgtgggaaaccacaccagcagttaccacggcaatcacccctgaggcatggaggatttcttcagtgatcacgtacaccacaaagggcgtcatcaactgtaaaaccgtattaaaaataacatcgttaatgccttgctgtctcaacagattccgtaaaaattcgatcatcagcatgagaacaaagccggccaagaagccaagaatactgatatacaaaaaatcgccaaccgcatgactgaacgaaaagacgcccgtaacagtcgctgctaccgcgtatttaaacgcaatcagccctgaagcatcgttgaccaaactttcaccactaaccaggtgtaggattctatctggcagtttcactcgctttgaaatcgattgaacggctacggggtcagtaggcgacagaattgccgctagtgcaaaactaaccgaaagcgacaatcgcggaatcattaaataaataaagtaaccgcccaccacggtcgtcaagaacacaagcaagatggaattagcaaagatggggccccgcagctgccagagttcccgtttaggaaagcgtcgtccatcattaaacagcaacggagcaataaagagtagcaaaaaccaatcagtgtctagcggaatctcgatttcccaaaatagcgccatcactaatcccagagcaatttgaattaaactcaccggaatgaaggttagatagtggctgatgacgttggagatcaaaactaacacaactaataaaataaccgcttcaactatcagcaactagcttccccctctcgttaaatctaaaccggatcctctccaattattcgtacctcggtctccaattgaacccccgcctgggttaaaacggtaccttgaacgtgttgaatcactgccaggtaatcggaagccgtggcatggtcaacgttcacaataaaccctgcatgtttggttgaaacttgcgcaccgccaaactgataaccttgaagacctgcgtcatgaatcaatttaccagcaaaataaccggttggccgcttaaagacactgccgcatgatggtaaatccaacggttgtttagccgctctacgggcgtttaaatcatccattttagcctgaatctcagtagcattacctgactgcagtttaaaggtcgctgtgatgacaatatcgccttcgtcttgcacccggctgtgtcggtagccaaaatctaactcatctcgctgaatcgttttcagcgttgcttgcggcgtcagcaccgtgactgagtcagcaaccatactgatttcgccaccgtacgcaccggcgttcataaagacggccccaccaacacttccgggaattccggcagcaaactcaagtcccgtcaggcttgcacgctgagcaactttggtaacttcaatcagagaagcacccgattcagccaaaatttcattgtccttcacttcaacgtgattcatgctggtcaaaatcatcaccaaaccacgaataccgccgtctttaacaattaaattactggcattgccaatcaccgtaatcggtaatccctgcttgttggcatagatcactaattcttggacttcagccaaacttactggaaatgccaagaaatcagccttgcctcccgttttggtattcgtatagtttgataatggttcgttttgcatcaacttcacctttggaaaagttgtaatgatgtctgccgtcatgatttaagttcctttcgctactcaaatatttcataaaataatatattcatataataccatgcctgttaccgcaaacgaaaggttagtggcacaaacaaggtctgtcactttattttcgacaacattttaatcaaatgcttatcgtctaaagcaacccaaaaatgataaactaaagttgaatgatttcatcaagaaaggatgtctccgccttgaaatttattagttggaacgttaacggtcttcgagccgttgttaagcacgactttatgactgcatttaacgatttagacgcagattttttctgtgttcaagaaactaaaatgcagcctgatcagctcaagttggatttacccggttatcatcaatactttaactccgccgatcgtaaaggttactcaggtacggccatcttcacgaagcatcagccaatcaatgtcacttacgatatcggtactgatgagtttgatcatgaaggtcgtgtaatcaccttagagtattcagatttttacttagtaacctgctatacaccaaattcgggaacgggtctcaaacgattggactttcgaatgggttgggaaaatgcttttcaagattacattgatcaactgaacacgcaaaagcctgtcattctgtgcggtgatttaaacgttgctcacgaagaaattgatattaaaaatccgaaaacaaaccataaaaacgctggctttactgatcaggaacgagaggcctttacccgttttctcgcacgtggctataccgacactttccgttacttttacccggatgtcaccaaccgttattcttggtggagctaccgatttaatgcccgtgatcgcaatgccggatggcgtatcgactattttgtcaccagtaacgccatccaatcaaaactggaatctgctgacattaaggacactattttcggctctgatcattgccccatctccttgacaaccactgggcttcacgtataatttgtatgacttgaaaggggtggcccatttgaactttgttgcaatggatttcgaaaccgccaacggtaaacgctattctgcctgttcactagcattaacgattgttcgtaataatcaggtagctgatgagttttatacgctgatcaaacctgacaccgattttttctggcgcaacatccaaattcacggcattcacgaatcagacgttgctgatgcgcctgactttccaacgatttggccgcatattcaatccttatttacaccagagcagttggtgatcgcccataatgcccagtttgataatagcgtcttgcgtcaaactttgaatcactatggcatgacttcaccggcctacctaacattggatacggtgaaaaccagccggcaatttttaccaacgcttgaaaatcacaaactcaatacggttgctgatgcattaggtatttcacttgaacaccaccataatgctctagacgacagtttggcttgtgctaatattttgttgactgaaacaaaaactttcggccaggatgccattaaaccgttcattaaaatggcttaatctgtaataataacaacaaaaataagctgatttaccaaaacctggtaattcagcttatttttgttatctatttaacagctaactgcatctcagaagcctcaacaacttccccagtggaggtcgtgacctgggtcgttcgaaccatctgaaagccaatatcttcatacagttttacggcgtgtttatttcgtagctgcaccgttaaactgatgacttgaaaactactgcttaaagctgcccaatcaagggcggtcagcatgagttccctgccgattccgtgatgccaatattgcttgaggactgccaccccaatctcaccagtcgaagaatcggcagtcggtaaaattgtcaccagccccaccagttcatcatctcgtacagctagtaagataacctgttgtgttgacatgctgatctgtttgatttgttcgctttcagtggctgaatcaacgtcatcactactatcttcaaaagtagtcgattcagttttaagaatcgtaagtagctttaaaactgcttcagcatccgttgccactgccttacgaataactaattccggctcttttgccatgttatttctcctgtaactttgagaccatcgtttcaaaccgctgcccatgaggatcaaaaatcagttcacgttgattctcaccctcatcatctagtcgtttgaacgcgatccgtaagtaatcatctggcagttcatctgccacaaatttcgaccattccacaacgctgacaccatcgccattgaagtattcatccagtccaagttcatcaccactaccatcttccagtcgatacacatccatatggtaaagtggcaaacggccgtcctgatattcccgaataatggtaaaagttggcgacttaacgtttcgtttgatgcctaatccagctgctaatcctttagtaaatgtagttttccccgcacctaaatcaccatccagtaaaataatatccttcggcgctaagagtggtgcaattttttgaccaattgccatcgtctcttctggtgttgaaactttaactgtaaatgccataatatctccttaaatcaaaaggagccggggcaataatgctgccgacagctccaaaattttgtcaattttaaaatttattcaacagcctgagccgcagtaataatcgttactttatagacatcttcttcgttgcaaccacgtgacaagtcagatactggcgcattcataccttgtaacagtgggccaagtgcttcataaccgcctaaacgctgagcaatcttgtaaccaatattgccagcttcaagttctgggaaaataaagacgttagcgtgaccagcaacttttgaaccaggtgctttgctagcagcaacttctggtactaccgcagcatcgaattgaagttcaccatcgattggaacatctggtgcctgttcttgtgctaatttagttgcttcttgaactttagtgacttgatcagccttagcggaacccttggttgagaagcttaacatggcaaccttaggatcaatgccatactttctagcagtttcagcactttgaacggctacctcagccatcccagcggcgtctaagtcaatgttgatggcactgtcagcaaacattaagcgttcttcaccctttaagaggataaagtaaccgctaatacgtttaacaccgggcttggtcttaataatctgcaatgcgggacgaatcgtatcaccagttgggtgatcagcgccagaaaccatggcatctgcttcaccaaggtaaaccatcatcgtgccccaatagttagaatcttcaagcatcttagctgcttgttctggggtattcttacccttccgacgttcaaccagcgcatccagcatcttcttcttctcatcttcagaagcattctttggatctgctaatttaacaccagttaagtcaatccctttttcactggcagttgctttgatcttatcaacgttaccaagtaggaccggctgtagtaatttctctgaagctagtcggctggctgcaccaataattctaacatcctcgccttcaggtaagacaaccgtcttattcaaaccactaatcttttgctttaaactatcaaaaagttccacaatatagacctccagattttgaaattccaactagtcaattctctcttgacgcctcatgctgcggcgtcggctcctcagcagtaacgtgctcaggcaactgccagtcaattggtgtttctcccagtgattcaagtgcgatgttggtcttagaaaacggctttgaaccaaagaaacctcgattagctgacaaaggacttggatgagctgattgaatgacaatgtttgctttagtatcaatcagactgatcttacttttcgccgctctaccccatagaataaagactacgggtgtaggcctctcggatagcttatgaatagcagcatccgtcaattgttcccaaccttttcccttgtgagaaaacgcttgaccattacgaacggtcaagactgagttcagtaacaaaacaccctgtttcgcccatttttcaagataaccatgattgactggcttaatgcctaagtcagactccagttccttgtaaatatttctcaggctaggcggaatctgaaccccaggcagaaccgaaaagctcaatccatgagcttgattaggctcatgatagggatcctgacccagaataacgaccttcacctttgaaaaaggggtccactggaaagcttcaaaaatatgaaacatgtccggatggatattttgtgtttgatactcatgaacaagaaaagtacgcaaattttggtaatatgcctttttaaattcgggctccaaaactggccaccaatcattgtgaataaacggtttcattcccaacacctcaacgttcattctatcatagattttcacgaattattagtcataaccactaaaatcgtctgaacagttttctttgagtgcttttagtagtcattggaattgttacacaacccttgtaatcagtaaattctaaaattgatagtccatcagactcaatttagccactatccatgttagaatgaatggtaaatatgtaaatacaactactgatttacgacaaaatgattggagggcttccatgcgcacactgtatattcgtcaagacagtttatctgctaagggggccagtgttgttcgagacgctgatcgacgttccatttatcttttaattggcaaatggggaagacaccaagacgcgctttcactgtaccaaattagcggtgatttactagctgaacttcggcaaacttcactagggctactgccccattttgatatttactatcaaggtaataaagttggtgcaatttccaaacgactaggcttctttaacgaaatgatttacattagtaatctacattggatcattgttggtaattttgtcactggtaattataaaatttatcatggcacctcaataattatgacatctcatagcgatggtgagcttcgaggaatgcaaattgtttctcagcaattagaacccatttgtatctgtattgcagccacattagatcactgggctagtggccatagtcaactcaaaaatccagctcaagcttggcacgcctcgcttaaacgccaaatgggattacgtggtaatcgggcttggcactatgctaatcatcaagttgatcacaaaatgactcattaatcaatttatcggttaaaattataattgtactttgcctcaaatcttcaacatatcaagctagaaaaaagaggctgtgacttaagtcgtaaatcatagctttcaaaaaaggtttatcgaagaaatcaaaatttgatttctcgataaacctttttttctgaataaaatcgggattttatcccctgattttaacagtttttgccatattaaggccataagacgataccggttccttagtaacctcgctaaacctcggaccaactcttttgaaccctaaataagcctcattctaccgaagacttgttctacatctaatttacgccgggcatacatttgtgccgtcgttccgggtaacccggtcccgctgctgagtcttttaaaatatcccctcacgtgattttactgatatatcgggtttgtccagacgcgctcagggctgctgaataacctggtgatcccgtcgaatttttctgcccgatagatttgaaatcacgcgtgatacccatcttgtcagtgcgctagaataacgctggaagttaactaacgccccgttgatcaatataatcgtcgtcatcagcgctgtaattccagttcatgattttacgatcatcagactgccactgacggcttgttcttttaacatcgttccgtacggaatgatgtgtgcgtctggctcatagttattcttcattgtacggtaattagcttctgaaccataaccagcatcagccacacatattctctcgccaacgtgtggtttgctgaaggtactcagaaatggataaacgtcttcgtatcggttgtcgtggaataaaccgaaacctaatacgaattgatattggtggcgatttgtaagttataggctggcttcaactgaccattcaaacattggatcttctttgacgcgcatgaggtgctatctatgttcggttttgagtagctattgcggtcaccaaagttttcaattgatgctgatgttcaatcattagtgcctttgcgtgagtgagctgcgcttgatcttcttgatttttcgacgatccgctttagctggattgggcgataattgggagagtgtttgatctccttatcccgttaacgagccgatcctcaagtcgagtaacacctcatccacattccagaggttttaattcgtcccctcgggaacgaaagctgccaccgtaggcgtgcttaatatcagccaagatcttttggattgcttcacgaattcatctgtcaaagcggcgtattttacgccagacaaaaactatactattggcatcagcaaaatcttggtaccatccataaaggtcaactcgtcaattaagtttgacgaacgcaagtagtcaacccactggtcttaacccatcatgaatcaaagtttctaactcatcggaaatccggaagcgacaaattgtccgactgtgggcatcgttcctgggtcagccagcggtcgtgtaagtcttccaccgcaaaggtttcgattcggcgtactaaagacccgcgagttgtaggcgaagaaccagcttcatcactggcccccaaatcatttctcgaggacgaccaaaggtagtgctccttaattgatgggactcaccagttcataatatagttaagcaggattatcttttgaacgatatagtcggtagtagaggtaaaattgtttgatccatgtgtataatttgtcatgttggattgtcctttcgaggattatttttgagtatcgggtgtgaccggtactctttttttctgtcattatatcaaaaaagcaggtagttaaaaatccttggatttttaactacctgcttttgaattaagggacttatgtcacagcctcttttgcttatattttggaacctaaccgatttgttccacactgtgtcttaataatgtttcatcactcgagcaatttgacggtcttgttcacgccgtttaagggtctcacgtttatcatactcgtgcttcccttttgccacgccaagtaaaacttttgcgacaccgtttttaaggtaaatgcgtaagggaacaattgtgatccccttatcttgcgtctcaccttgcaacttagcaatttctttcttgtgcagcaacaatttacgattacgtaacggatcatggttaaatcggtttccctgagtgtactcactgatatgaatattcatcagccaagcttccccattacgtacctgagcaaacccgtcagtcaaattaacacgtttagcccggatagatttaatttcggtcccagttaaaacgagaccagcttcataggtattgaggatcgtgtaatcatgccgagcttttttattttgtgccatgacatttttgtcagttggtgtttttttctttgccaacagtcctcacctcacttttaaattttaatgacttggtttgtggttctgacgattcccagattgggtctggtttcgggtatgatgaacgttactatttcggccaccattccgattgccactttggttattccgattatggttaccgccgttttgagaacggtgatggtcatttggccgaccgttgccatgattccggttaccaccataattagaatggtgctcccgtttcggtagtaagtcagatgtcggtgcagctgaaggatcaactagcgcaaagtcgatctggctttgttctttatcaacgttgacaaccttaactttaaccgcttggccaatccgataagtacggtgagtcttacggccaactaatgccaaatacttctcaacgtattcgtagtaatcatccgtcaaacgactaatatgaatcaagccttcaaccgtgttaggtaattcaatgaacatcccaaacttcataacagagctgactgttgcatcgaactcttcgccaagatgatcagccatgtattcggctttcttcatggaatcagtatcacgttctgcatcgattgctcgacgttccatttctgatgagtgaacaccaatttcctcaagcaaatcagcatagcgctccttgctcttagaattaataccgttttcttcatagaagtgaatcaagcggtgaaccatggtgtcgggataacgacgaatcggtgacgtaaagtgggtatagtacttcgcagccagaccaaagtgacctagagactggtctgtatacttagcctgctttaaacttctcagcatcataacggacacaacggcctcttctggcttaccagcaactgactttaaaacgttttggagcatctttggccgtaaatgatcaggatcaccctttacattgataccaaaggcagttaagaattcgaagaaactcttcacacgttcaccatctggtgtttcgtggacccggtagataaacggtgctttagctttgttatagtgttcagcaacagtctcattggcagccaacatgaatgattcaatcatcttttcggctaagccacgaacccgcagcttaatatcgatggcatgaccagtttcgtccacgataatttctgcttcgtgatcatcaaaatcaatggcaccacgacgcttacgttgcttgtataaaatcttatgcagttcgcccatggtttcaaacattggcaccaagcgttcatagcgttcacgagtggcgtcatcgtgagcttccaaaattttgttaacatcggtataagtcatccgtgcagctgatttcatcacactaggatgaatccgatgattaacgacatttccttctggatcaatttccatttcacaactcatacatagccgtaaaacgccttcgttcagagaacaaatgccgtttgatagccgtcgaggtaacattggaattacccgatcagtcaaatagacactggtcccacgcttgtaagcttcttggtccaatagagaaccttctttaacgtagtgggaaacgtccgcgatgtgcacacctaagtgataattaccattatccatcttccagacggtaacagcgtcatccaagtcctttgatgattcgccatcaattgtaactaagtcttgatccgtaatgtcttcgcgaccagccatttcagcttccgtaacgtgatccggaatggcatcggcttcctgtaaaacgtcttcaggaaattccgatgggatatcatgtgcatacacgatctgtaagatatcgattccaggatcatccacactaccaataacttttttagcaatcccaaccattgctaacggatggtcagcattgggatattctgtaatctcagccgtaaccacttcaccaggggttggcttcaaaccagtgtctaccacataaaacttgtagcgagacaactttttgtctgtcagccgaacttgaccgtagtagcccttatcgtcatcggtctgagtaaaagctcctaccacgtgtgtataatggtgcacgtcaataccagtgaccttgccttctggtccacgatcagaatgcgggtcagcagcacgaacaatttccatatccacttcgtcaccgtttagcgccagcattgtattatccggtgcaatataagcatcaggcaattcgtcatcgtacgcaacgaacccaaagcccttatcattggcatgaaagaccccattaagcgtccgcgccttttcattcaattgaaattcgccttcacttgtaaccacggcgatttgttcacgttccagacgtgcaaactcttgaacaatcagcttaaaggccgctgatccatgataaccaagagcatcggaaacatcctctacccggaaccgttttgtgggatttgctcgaagtaaatccgtaatctgttgctttaaattattatcttccacgatttattcctcattaattttaatttgttgtgcttagttaaaaatctgttttaagtatgctgttaaatcctgttctagttgatgatgggctttatttaccgtaatcacgtgtcccgcatcttggtaatagtgaaaactgacctgactattaattagcgcatcttttaattcatacactttttgtgaatcaatcaattcgtcttgaccaccttgagccacaaaagttgcctgtgagattttatttaaatcaccagcaaccatacccgcaaactgattaatttgtgtcagctgcaccggtaaatgaaccgtcagccagtttaatcgttgttgctgcgtttcatcatcgagcttcatgtacttataggttgcttgagctaaccgaataaactctggcgtaagatgattcttctgtgaagtgataattggtgaactaaatgatccgccacccaatagtgtcgcatcttcttccaaagcgcgcatagcaaaaacaccacccagcgacaagccgaaaatacaaatcttctcgtattttctatccctcaaaaattgaattgcctgctgtgtatcatgccaccaagcgtcgggtgagccttcagtcaaaatatcagttggctcacccgtgccatgaccagtaaacatcggcccaagtactgtatacccttgtttttgaaggaaatgaccaatcagccgtacatcgttggagttactagcgtaggcgtgtaaaagaatcactgcttgtgaaccgccttcaaagaagaaaggtttaggtaactgaatcattatccattcacctccatcagtgtaaaaaagtcaaaaatccccctgtggtcatcacaggaggatctattgctagtgtgaagaaagataggctaatgctaacgccagcgcaaagaagataactcccaaaacgacagttgctttttgcatgaatgcttcaaagccccgagccttttgatgggaaaataaatctgtaccgccaccacttaaggcagacattgcatcgtcttgcttagcgggctgcattaacaccgcaattataataagtacactatcgatcatcagtaatgttaatagtagattatacaagaaattgcctcctattgctactttgtctccgacaatacctctatacaatttatcataaaaattgatagattactaccctatggcttaaattatggttgtagacatgtgagaactggctattcccccgtaagatgcttcattctttgccgaatattggaaagtgttttttgcgggacatttaataacaatgtatcccccaaatgaatcactgtatcaccgtgtggaacaataaccctctcaccacgtttgatttcaactaacaaagtaccgtccggccagtcaatatcacgaatttgtttcccatccataatagcattctcaaagactgggaattccaactgcgttactggtagtgaagaaccatggtgagccttttgcaatgaactttcaagcatagcagcatatacgggagttccgcccagtacatcaaccgtcaaataggcaagtaatgaaacaactgctaaaggcattaaatgatgtagcgttcccaccatttcagtgatcagcaaaatcgaggtaaacggtgctttactaataccggcaaaatagccagccatggcagtaatcgtaaaaataggcactaagttaggactagccagatgccatgccacaaggacttgaccgaataacgcacctaacactgcacctaacgttaagataggtagaaaaataccgccgggcagtcctgtcccataagcaatcattgaatagacgaacctgacaacaaaaacgattaacaaaaccactataccaggtgcactacccccaattgaaataatcagctgattgccgccacctaaaatctgtggcaagaataggccaactgggatcagcaaaataaaagcaatcaaactattatattcatctggcaaccactttaatttatgataccaagatcctaccctcaaaactacaagttgataaagccgaccaaaaagccctaataacacacccagtacaattaaccagccatactgtgctaatggcaatgcgtgcacataatcaatatgtagaacaggcgttaatccaaaaaagaaagtcgagacaaagttggcagcaattgcgctggcaagcgctgtgatccaaaccattgtcgaaaaattatgataaacttcctccaagataaataacgaactagcaatgggggcattaaaagcagcagagaggcctgctgctgccccgctagcaattaaaattcgccgtttattgcctgaaattttccgagtagcagcaaaaccctgcccaacggttgctcccaactgaattgacggcccttcacgaccaagaaacaaaccactgccaatggccaatacaccaccaacaaactttttccatagcacgggccaccacttatactcaacttcacccatcaattgaccttcaacctgaggaataccagaacccttaatttctggtgtttcctttagccagcgaccaatgattaaggtcaacactacgctaataatcagccaaatactaagtaaccaaagattatgattagcttgacggaaaaaccattgtaccagtagtaagccatggctgatcagtaagcggaatagactcacgattacgcctgcaattaatccaattagaattccttgtaccactgcattgatccgcgaaaaatcaatctttttatgctgcatatcattcatcatatactcctaacattttcgttcggctattattctatcatatgtagagtgtgtgacaaaactcgataaatcccagaattcaacgtaaacttactaacattagtgatgtaatcaatctcgacggagatggttacatcacttttttgataaagtgatagtggaactaaggtcgtaaggcttttaggcatacatgccgtaacgcaaattggccgtcgcaattggccgttcacagtgtttctagaactttgcctagttaaagcgcgcctgacgccgagtattgaaaattaaactgtagttacattttgaaacaagttccaaactcaaggaggtaattactatgcgtacagtgattggaattgatgtctcaaagcttcttcacaggttgccatattggtagatggtcaattgtctcaacgaattaaattgataataacagattggctttcaagaacttgatcatttaattcagatgccacaggatcagttgagattgtttttgaggaactggtgtttattcccggcgattacagcacttcttggagcagcatacttatccgtattgccgtcttaatccattagctgccaaaaaggatatggatcgttacggccaaataaaaatgatatcaatgacgccattggactcgctcagccaatatgaacttaactatttaaggacatatgttgaagcaccagtatatcaagaacttcaaattatgagtcgttattatcagcaagtaaatgatgacttagtacgcggtaaaaaccgcttgcataaagccttacaatgacttttcccgaacttgaaggacttttgtcgaccaccagcgtgatcaatattggaccttagtcgcacaattcccacatgcatttagtttctacaacatgaagttgaaatactggcaacaactctgagctcactaaacgcaatatgtcagctaagcgagctaatgacttggcaattagctgtttaattggcgcatctaaccagccacagtttcgcaaatagctacgaagttaaagtaatccacaattagctactcaattaatgagcctccatcatgagaaacaagaaattattgatcgcatggttaagctttgcgaaccattacctaaatacggatactaatgagcatccctggtttcgcagaaaccacatcggtatcccaggggcgaactaggtgatattagtagattcaaacccgctaacaccttaatgctttcatgggattgatttacgattcaacgattctggtaactataaaagtagcggttttatcactaagcgaggcaatcacctagccgtaagatactgtttaaagctattggcaacatggcacctcagcagctcataatcatccaagtcacattaatgattggtatcagaaaagaaagatctctttcgtctaaggggacgaaaaagatcacaattggtgcaatggatcgtctaatatccacaattccccatttggttctaacgaatcaaacctatgattatactgttgccacaacacaccagcagaactacatgtcctaaaaaagttggcaagaggataggcttatttaagtgtacctaatatttaccaaactactattcagtaagcaacgaaaaggcctgaagtacttgacttttggtagaaaataatgcctattccagtgaatttatggaataggcattattcgcgtgaatgacagaagtctcagattcgaacttgattaaataatattaaacgtgttgcacccacgtgatgaattcgctttgaaacccgtttatgggtgtaatgcctggtacttcgcttctttcctcgatgatgcctttttgctttcacagtcttcttgtgtcgtttgtgatgcttgtttaccttatgttgcttgtgttttattggagaatgcttatgcttatgctgatgcttatttttctgggcaatttgttgctgctccagcaatttggcatagcgatccatcaatttaattaatcttttgatcaacctttccaactcagatgaatcatttaacgagggcttattctctaaatgaattggtccaccactattattcggtttattgattggattaggcttcaaacccggttttacatccggattgggggttggagttaattccggctttggattaggtagtggttctggttctggttctggttctggttctggttctggttctggttctggttctggttctggttctggttctggttccggttccggttgtggttctggttccggtcccggttgtggttctggttccggttcgggttgtggttctggttctggctctggctctggttctggttccggttctggttctggttcgggtgctggttcgggtgctggttccggttgtggttctggttccggttcgggtgctggttctggattaggtgctggatttggttctggattaggtgctggcgctggttcgggtgctggttctggtactggttcaggatcaggtcccggtgctggatttggttctggattaggtaccggtgctggttcaggttgcggttctggttcaggatcaggtcctggcgctggatttggttctggattaggtactggtgctggttcaggttgcggttcgggtactggttcaggatcaggtcctggcgctggatttggttctggattaggtaccggtgctggttcgggttgtggttctggtactggttctggattaggtaccggtgctggttcgggttgtggttctggtactggttctggattaggtaccggtgctggttcaggttgcggttcgggtactggttcaggatcaggtcccggtgctggatttggttctggattaggtaccggtgctggttcaggttgcggttctggttcaggatcaggtcctggcgctggatttggttctggctcgggtgccggttgtggcttaggttcagggacaggcaatggttccggattaggctccagtttattagcatcgtcttttcgaacttttaattggatactcccattaccatcttggtcatacacgacttcatgtgatagaacctgatacccctgtgtgctcactttttttaaaagtgtttctactttatccgttacttgatcatacgccgatgtaaatccagtggttaacccatcattggccactgtttcttcattcgaagcctgataagtaatttggtaattaatttgtttacggtgtatcaccgtctcaactggggccatatttcgggttatcacagtctcttgattttccactaactcataatccgatttgagtggttccaccaaaagaggccgacaaattccgtcaactgtacctgaagaatattgataatcggtgaaatgctttgtacttctagtcgtatccggattttcaagaacataccttaattttggtctttctttgattgcatgtaggatcaatgcagattcaaatttaaactttgatacacccttagggattacaataggcgtgatcaagttaggctccaaattagaataattagggtagagtgacttcaaattataagttcttaaccctgcatcattaaaatccgttactcctgcgattggttttatcacagagactgtcttggactctttaggcaatgcttttagggtacttgaaccagcatctctaaccttcctaaccacctcaaacgtcagttcatacggcgaaaattctgggtgagacaccttggcactagcatgagtcgtcgttaagccgaatcccatagccacagttattcccaatattaatcggttatacttcattagtaactaatctcctctcttgtatagaagttaactacgcaagacagaccaattaaaatcgagaatcaaaaaaaagacctcaaccaatgaaaattcatcagttgagatctttaaatttacaccgagactaatagtcccgagatatttttacttgttttggatagcttcgcgagcttgttcactcaagttgtagaatgagtgaatacccttgtagtctgaaacttcgccaagttgatcttcgatacgcatcaattggttgtacttagcaatccgttcgccacggctcattgaaccagtcttaatttgaccagcgttcaatgcgacaactaagtcagcaatggtagtatcttcagtttcacctgaacggtgtgaaatgatagcagtgtaacctgcttctttagccatttcaacggcttcaacagtttcagtcaaagtaccgatttggttcaacttgattaagatcgagttagcaacgcccatcttgataccctttgcaaggtaatcagtattagtaacgaacaagtcatcaccaacgatttggaccttcttgcctaagcgagaagtagccatttgccagtcttcccattcgttttcgtccaatgggtcttcgattgaaacaactgggtacttgtcaacgatgctttcaagcaagctaacaaattcttcagcagtgtatgacttaccgtcacccttaaggtcataagtcttagtttcagtgttgtagaattctgatgaggcacagtcaaaggcgattgcgacgtctttgccaggcttgtaaccagccttcttaatagcttcaactaagatttcaaatggttcttcgttgttcttcaagtcaggtgcaaaaccaccttcatcaccaacggcagtagagtatccacggtcgtttaagattgacttcaaggcatggaaagtttcagcacccatacggatagcttctttaacagttggtgcaccaacaggcatgatcatgaattcttggaaatcaaccttgttgttagcatgcttcccaccgttgataacgttcatcattggagttggaagtacgtgaccattgaagccgcctaagtagttgtaaagcggaacttcaagttcgtcagcagcagcacgagcagcagctaatgaaacacccaaaatggcgttagcacccagcttacccttgttaggagtaccatctaacttgatcatagccttatcgattgaaatttggtcagttacatcgtaaccaacaatttccttagcgataatgttgttaacgttgtcaacggctttagtaacacccttgccaccgaaacggctcttgtcaccatcacgtaattcaacggcttcgtgttcaccagtagaggcacctgaaggcacgattccacggccaactgcaccggcttctgtgtaaacttcaacttcaacagttgggttaccacgtgagtctaagacttcgcgggcgtaaatatcagaaataattgacattgtattctctccttatgaatgtttaacctagcgggaaacttttccccgcagtctattttattagtttagctttgaacttgcaattactatttgagtttatttttgatagtgtaccaattgtaaaaaagtttccggatcaagactggcaccaccagctaaaacaccgtcgatattttgcttagccataatctgagaaatattttctggattgacactgccaccatataacacacgcatctcattagccacatcatcaccatataaatcagcaaccgtctggcgaatcaggtaacagccctcttcggcttggtcagctgaagcagacttaccactaccaatcgcccagcttggttcgtaggcaatcactagttgacgcgccaaatcttcactaacgccttttaaggcaccagttacttgactaaccacccagtgaatcttttcgccagcttccagtcgtcccatcgtttcatcacagcacagaattggtgtcatatgatttcgatagaccgcgtgtacttttcggttaatgatgtcatcggtttcgttaaagtaacttcgccgttcagaatgaccaacgatgacatatggaatgcccatttctgataaggcttgcggcgatgtttcgccggtaaatgccccggcatcctcataataacaattctcagcaccaatttttaaacgatcagcgccattagcttcaatcatcgtttccaacaaaatagcaggtgctgcaatcgccgtctcaacttgatcaggctcaggcagttgatctgaaacaatttgcataaacgaacgggcatcatcgacagacttgttcatcttccaattacccgcaataagtggtatccgcacggtaaacgctccttttgttcagtcatttaaaatcacaatactattctatcggaatgaaaacgttttagccagtgaagcccactatcaattaaaaaaggttatcttactaagaatgcgcaaagaagccaggacatgatcccagcttctttaaaagactacttttcgctgatagcagcaataccaggtaaagtcttaccttcaaggtattccaatgaagcgccaccaccggtagaaatatgggttaacttgtcgccaacaccaagttgttgaacagcagcagttgaatcaccaccaccaacaatggttgtagcatcgctcaaagtacccaagaacttaccgatttcaagtgttccttcagcgtaattactcatttcgaacacacccattgggccattccaaacaactaacttagctgactttaaaacatcttcaaaggcagcaactgatttaggtccaatatccaaggccatgtagccatcaggaatatcaccgtcaacagtcttatgatctgcatcgttgtcaaacttttcagcaacaactgaatcaataggcaatactaacttgtcgccagccttgtccatgatttctttagctaaatcaatcttgtctttttcaactaatgagttaccaatcttcatgccctttgcagcatagaaagtataagtcataccaccaccgataatcactttgtcggctttgtctaacaagttgtcaataacgccaatcttatcagaaactttggcaccacctaaaatggcaacaaatgggtgagctggatttgaaaccgcaccaccgataaacttgatttccttttccattaagaaaccagcagcagtttgtggcatgttagaagcgataccaacgttagaagcatgttgacggtgagcagtaccgaacgcgtcattaataaagacgtcaccaagtgatgcccagtatttacctaaagcaggatcgttctttgattcgcgcttaacttgttcaccatctttaacgtcttcgtaacgagtgttttccattactaatacgtcaccatcattcatcttgttgatggcatcttccaattgtggtccttctgttacgggaacaaaagtcacaggcttgttcaacaagtttgaaagacgttctgcaactggacgcattgataagccaggcttgtcgtcttctgacttgatccgacctaagtgagatagcaaaatagctttgccaccatgttcaataacgtacttaatggttggtaatgcagcaacgatacggttgtcattaccaataacaccgtctttaatcggaacattaaagtccacacgcattaagacttttttgctctttaaatctaaatctgaaacagttaatttagccaatttaaagtcctcctgatttatatcaagttgatcattgtgacctctggtacaagtcaattgttgtaaaaggcggagaaagtctccctcctccgccttctagtttttactcattaatgattaaagtgaagcaaagtgcaacaatgtacgaaccatgttgcaagtgaagccccattcgttatcgtaccaagcaacagtcttaacgatctgagtgtcgccagcagtagtaacttcagtttgagttgggtcaaatactgaaccatgagggtcatcaatgatgtcagttgaaacgatttcgtcatcgttgtaaccgaaggcatcgttgttaacagtgtgcttcttgattgcttcgttaacttcgtcagctgtaaccttcttgtcaaggacagcaactaattcagttaatgaaccatcaacaacagcaacacgttgtgcgtgaccctgaagcttaccattcaattctgggataactaagccaatagccttagctgcaccagttgaatgaggaatggtgttaatgcttgcagtacggttgttacgcatcttcttgccgcgagggccatcaagaatttgttgagtagcagtgaaggcgtgaatagtagtcatagtaccagccttgatgccaaattcttcgttcatgaagtatgctaatggtgctaaacagttggtcgtgcatgaaccagctgaaacgatcttgtcgctagcttgtaaagtatccaagttaacacctggaacaacagtacgaacggcacctgcaggagctgaaactaagacccgctttgcgccagcgtccaagtgagcttgtgacttttcttctgaagtgtaaaaaccagtacattcgagaacaaagtcaaccccatcgttcttaacccaaggaatgttttgtgcctttggttctgcatatacagggatttccttgccatcaacaacgatacctttatctgttgctgaaacttcgcctgggaaacgaccatgtgttgaatcatactttaataggtatgcaagcattgaaggggtagtcaaatcattgattgctgccacttcgatgtcgtcagaatgaagttcgtggatccgcttgaatgctaaacgtccaatacggccaaaaccgttaataccaatttttacagtcataactgtgttttcctcctttaggaagttaaaaaaataattattttaaacagcgacactaatacatagtatcactactttaaaatcatgtcagctaatccttcgtccgtaatcaaaaatgttttggccggaggaattttgaaatatgcctcaactgcggcagccttactatggccaccagcaactgcaacgaccagatccattcgttcaagatctgaaatcgacaaacctagtttgggaacccggtaaacaatctgaccatcttggtcaaaaaagtcaccaaaagcctccccaactgcatgccgttttactaacgttgctgttactttgtcggacatttgacgccgtttggccattgccattgcatcacccacgcaatgaatcgcgacgtttgcgcggtcaatcaattcaagggttttagcaatagcaggctcgtgacgtaatgatgttgatgttgactcagagcttagttcgggcaaatacaacgcttgaaaatgacctttggttgcttcagccattcttgcacaaattgtatttgcttgaatgttaggcgattcgcccatcccgcctcgagccggcacaaaagttaattgccggtcttcagccaatgtggctgataaagtctccgctacagcagccatcgttgtgccgcccataacagccacaatactttcgccaaccggcaattgctgtctgagcagatcattagctgctttacccatggcctgtttaacatctggacgttcatctgaatcaccagaaacaattaaacagtcctgcaagccgagacgttctttaagcaacgtctccttttttcgtaagccggttaaatcggccaccaagggttgtagattgaggattgctttttgaccatcgtctgttaaccaggcaccgttagtctgcattgaaaccaaacctgtatcgactaagctatccaaatcagtcctgacagtccgttcagtgaggttcatcttttctgccaatgaacgacgcccaactggttgcatctgtctgactgtcagcaacaacgaataacgtctgagcagtttctgggacatcttaggaacaactgcgttcacccatctccactcaaggtccatgtcttaaccaactctctaccacctatgggacaagttatgtcccatagtgacgtaatgtgacccatttaggtcaaaaattaatgggtacttatctttacccacatttcagattatagcagggaccctatccaattgcaaacacactcacatattttttcaaacagactaaattcattccaagattaccccttgtatttatatgcaaattcaggtatagtattctagtgttgaaatgtaagtggtatgcgcccgtagtgtaatggatcgcacgtaagattccggttcttgaaatgagggttcgattccccccgggcgcataatgcaacataaaacaaacaggataccgttaaatcggtatcctgtttttgtattctcattaaaatagcaggtaataaaagccagccagaccgatgaatcggtagatccatggcttaatggttgccagatcccacctagccgatagccgagacgcaatcatcgtgccaacagtcgctcccaccattccgactaatatgtatgggataacatgagttccaagaattccgctaacaatccgaacgctggtaatatagaaaccatcaatgaggaaaaagccttgaatattggcaatatattcaggtacagatttagaacgagacaaaaaataaagtgccatcagcggaccgccaataccaaataagccgttgaagaaacctgaaataatcataaataacagtgcaacgtaccagggatatcgtcgactacccgccttcttagaagtgagaaaataaatacttagcgcaatcaataatatgcctaacatgatacgcagaatgtgcgtatttagtactaggcccaaatgcacggaccaagttgccacagcagcataaacgataaacgcggacaaaacacgctttaatttaaaatgatgccgatagtgaataactaaggaaatttcacttagtaacataataataccgccaataccagcagcctgtgccattggtaaaattgacggaaaaaagatcatcataataataacggcaccaaaccctgtcaggccttgaatcaaaccagcaagtaaagctggcaaaatcaccagcagccacgtcataaacttcccccctgtaaatagcaagtttaccattaagtatgataatcccttaaaccagtgtcaacaagatttctacaattaactgcatcatacgaaagacgagttagtcagtataggtattcaaaatatgttatcctaagttttggtataaggccaaaagcaagactgccataaaccaagtgattttgtttgaccttttttgacctttaggttaaactacaaatcagttagtcaaacagactaataaacaatagatcataaggaggctgcaaagctatgaacttagtcccaacggttattgaacaatcttcccgtggcgaacgtgcttatgatatttactctcgcctattaaaggacagaatcatcatgctttccggcgcaattgaagacgatatggctaacgcaatcatcgctcaacttttgttcttggatgcgcaagattcaacaaaggatatttacctttacatcaactctccaggtggtgtgattacttcaggtatggcgatttacgataccatgaactttatccagtctgacgttcaaaccatcgttactggtatggctgcttcaatggctagtgtcttggcatcttctggtaccaaaggcaagcgttttgcattgccacactcacaagtcttgattcaccaaccatcaggtggtgcacaaggtcaacaaactgaaatcgaaattgcggccgaagaaattttaaaggctcgtaaaatgatcaaccagattttatcagataactcaggtcaaccaattgaacgagttaacgctgatactgaacgtgaccattacttaacggctcaagaagctgttgattacggcttgattgattcaatcatgaccagtacaaaagaccgtaaataatatttaattagtaccaaaaagacgaactcaatcgagctcgtcttttttagttgctagccattgccgacgcgatttgcgaaatatctgccggtgtcgttcgacagcagccgccaatcaaactggcacctgccgcccgccattttggtactaaatcactgaatgcgggtgcatcgggtaccgtttgccaggttttggtcactggatcatagatatcaccattgttagggtaaacaataatcggtttgctggttgcccctgctacctgtttaaccagtttttcaatatttgtcattgccgtgcagttgacgccaatagcagccacttgcggatggctttcaaaatacgccacagcttggtttaatgaagtcccgtcgcaaagctggcccttttggttcacgctaaacgatacccatgctgacatttccggaaattcattttctaataagtcaaccaacgcctgagtttcctcgaagttaggctgagtttcaaacgcgaataagtccgcgccagctgctgccagtatctgcatccgttctcgatgaaaattctgatactgctgctttgttaattggtagttgccagtatattcactaccatcagccaaataggcaccgtaaggcccgacactgccagcaatcaacaagggacgttttaatccttcttctttccggtattcatcccgtgcccgctgtgctagccggaccgactcggaaattaaccgacgactctcagtaaccgatagtccagccgcttcaaacgcgggtaggtttgcttggtaactatccgtaattgccacgttagctccggcttcaaagtagcttttatgtaccgcaataacagcatcaggattatgaatcagcgccatcgctgaccacagggcattgtttgtttcaacaccccttttttcaagttcagttgccattgcgccatcaataacaagtggttgatcaaagttaattctactcatttatgataatcctctcatatttagacttgcgtacccatattttttaatgttattctaattctcgttggtttgcaattatggaggtatcacaatttggagaaaaaaacacatactacccttgaacgtaagatgacagcacgccatttatttatgatttctctaggcggtgtcattggtacagggctcttcttaagttccggttacacgatccacgaagcaggcccaattggcacgattctcgcatatggtattggcgcagtcgtggtttacctggtcatgctgtgcctaggcgaactatcagttgctatgccgcaaaccggctccttccacgtttacgctgaccgctttattggccacggtacgggatttaccgttgctattctttactggctcacatggacggtagcgttaggctccgagttcacagccgctggtctcattatgagcaagtggttccctcactcacccacatggatctggagtgctttgttcatggtcgttatttttgtttccaacgccatgtcggttaaattctttgccaatactgaattttggttctctagtattaaagtgatcgcgattattctctttatcatcttgggtggattagccatcttttgcgcgattcatattaagggttatcagcatgcaccttacttttccaacctgtttaaagacggccttttccccaatggttttaaagccgtctttacaaccatgctcaccgttaacttcgctttctccgggacagaattaatcggtgttacggccggtgaaactaaagatcctgaggtcacactgccgaaagcgattcacaccacgctgtttcgactgatcatcttctttatcggtagtattaccgtgatgtctgcattgattccatggcaaaaagctggcgtcaatcaaagtcccttcgtcttggttttcaacagcatcggactgccctttgcgggtgatctcatgaacttcgtggttttaaccgccattttatcggctgccaactcaggtctgtacgcttcgacaagaatgctgtggtctttggcaaacgaaggtacgattccgttgaaggtagctcagactaaccgtcgcggtgttccaatgctggcgctatgtttaagcatggttggcggtattttagcgctcatttccagtgtggttgccgcatccactgtctacctggttttagtttccatttctggtttagccgttgttatcgtttggatggcgattgcgatatctgaaattaatttccggaaacaatggcttaaaaccgggcacactgtttcagaattaaagttcaaaacaccttggtatccggttgttccgtggattgcattcattatgtgcttattatcatgtgttctgatcatattcgatccaacacaacgtcccgcactattctacatggtgccgttcttgattctttgctatgttgtttattatggtaaagaagcttggagcaaacatcatggtagtacaaagaaccagtatgttaaccctgataagagtcatgaagataatctttaacaaaaaaacagagtttcaggaaatcatcagattccttgaaactctgtttttatatatgttcacactttacacagcttttgctgtccgaagactatcagcgtaatcactgattttacgtaatcggtgattaattcccgacttcgaaattgcaccacttggcagcatggcacccagttctttcaaactgacttcacgattagctaaacgaatttcggccacttcccgtagttttggtggtagttggtctaagccaacggtggactgaataaactcaatgttagcaatttgtttactggatgcattagcaactttatccatattggcgttttcacagttcacaagccggttaaccgaatttcgcatatcccgcatgatccggacatcctcgaacttcagcatggcactagaagcaccaatcagcgaaagaaaatcagcgattcgttcaccctctttgaggtaggtaataaacccaccacggcgagcagttgtccgggcatttaaatcataatgattgatcatttccgcaatcatttgattatgatcctcatatacggagtagatttccaaatgataccgcgacgtttctggattgttgaccgatccacccgctaaaaaagcgccccgtaaatacgagcgaacctgaccgtcattttttaacagctcaggtgaaactttctcggtcagctgaccatctttaaaaataccaagatcagcaaggactctttcagtcccttcattgacccgaacaatgtataaattatttttcttcaatttcatcttacgccgaaccatgagttcactttctacatcgtaaaactgcttcaaaagctggtaaattcggcgcgaaattgccgggttttccgtttgaatattaagaacaaaatggtgattggaaattgcaatagagccattcatccgaatgagcgcaatcaattcagctttagcgttatcgcggtgaacttcaagtgttgtcagttcttttttaacttcactggcatatgacattggcactacctcccctcagcaaacctcgatgtaacctgtcccagcaggttcattagttcgttaaccactagttcgccgttatgaaacgcaccgttatcccgcaattccagaaaatcagcagaaactactcgacagccttgttctcgcaggccatggaagtcatgctcaacttgacgtgacatttcgttccagcgctgataatcaatgtattcatctggaaccttttgagtattaactaaaaccgtattgatgacattttgctttaaatgccgattcaacacgcgaacgtgatccgcatcagtgaacttttcagtttcacccttttgagtcataatgttgcaaatataaacgacttcagcctgcgttttccgcaaagcatcacccacgttactaatcattaaattaggcaaaatgctggtaaataaactacctgggcccagcacaatttggtcagcatccatgattgcattaatcacttcatccactgcttgtggtgctatgtccttatggttgcttgacgtgacccatacgtgcttaatcagtttgtgtgcagcagtaatttctgactctcccgtcatggtagtcccatcagaaaactcggcattgagttctagcggttcattagcagcgggataaatatgcccgtcaacctgcatgatatcgcaaagctcttgcacggcatcaaaaataccatttttcatttctgatagtgctgcaatcaccaagttacccagtgcatgaccagcaaagaactgatccttactgtcgaatcgatactggaacaactgcagtacgagtggtgacaactgagacagtgataccactacgtttcgaatgtctccaggtggcaccacgttcacataattgcgaataatgccagatgatccgccatcatcagccacagtcactacggccgtaatatctacatcgtgaccctttaaattacgaaggatgactggcaagcctgtgcccccgcccatcacaacgatcttgggccgacgtcgttcttccatcatagttagtttgattcctttcgctttgaaatatcacggtgagtaatatgcactggatacttttctccaagcgtattgcccaatcgttcagccaatgcaactgaccggtgctgaccaccagtgcagccaatggctaccgttaaattattctttccttcccgtttatacccgggcatgattgattccagtagccccaaaaactgcttgtaaaacgattcagtctcaggctgcttcatcacataatcatagacaggctgatccaaaccggttagatttttcagttccggccgatagtatggattaggtaagaaccgaacatccattacaatatcagcatcaatgggtaacccatacttaaacccaaacgacatcaattcaatgtggaatttttcaatatcaccagcttcaaagttatgaaaaatttcttcacgcaattgacgtggggataattctgacgtattgatgactaactgtgcagcctgtttaagtggtgccaagagctttcgttcagccttaataccctcgatcacccgaccattacgcgccaacgggtgtgaccgtcgtgtttccttgtaacgtgaaaccagtgtctcatcatctgcgtccaaaaagacgatctgagtcgtatctgaccggtttaaatccgaaatatccgtggtcatttgcatgatttcatcataaaacgctttggcacgtaaatcgatgacaacggcgacttttttgattttgccagtttctcgaactagctcccagaacttattcattaacgacggcggcatgttatcgatacaaaaatatccaaggtcttcaaaggcctgcatgccaacggtcttaccagcaccgctcatgccagaaataatgactagttgcacatcattgttcatagttctatctccaatcaaatcaatcatttaaacattctaacacaccaggcgtgtcattactaatttccaccgggtgttttgacaaaaaaactgccaatttcctattcataaactggcagcacttaaaattgatattttccgttctcaccgtcttgcaaacgccaacatgatcgcattgatgccaaaaacaatgaggtaaaacccaatcagccaagtaaccgacatcattgcaatcactgggttaatcagcagtaaaacacccagtatcagtgacaaaacgtccagaatgatagacgcgataaaatagccagtgccaaagtcacgcaaatgtgcgacaacgattagccgttcaatcgcatcaataataaaccagaacgctaccacataacctaaaacaacgataccgctactgggtttaataataaagaacagcccaatcagtaaatcaataatggctaaaatgaaggccccaactgcccaattgccaacaaaatctcgcagtttactaacacctgataatgtggtgagcccactaagaattgctaaaaagccaaaaatgactgacatggctgttaagcttacacgtggcatcccaatcactacataggcagctatcaagcttaagacacccgtgatcagctcatgccaatcgaatccccaccgaggttgcatactaaacatattgctcactccaatcttatatacggttgatataaatccatcatagcgattgtaagcattgaggacaacccacacccaaaaaaactaatgcagcattactctgctgagaacgtttcttaggtccgctaattgcacattaggctgacgatccagcccaataagataaaaatgacggtgatactgttgtcccagcgactgacgaacgacctctgaaggaagaacaccctctgacataagcgttttaccgataccctgcgttaataaaccaataatactctgattactgtcgacaactaatgtctgttgcggtacgattccctgctcatgcaagtacgcttccgtgtaatgacgcacaccagacccaggttctcgtagcagccaaagtttttcatccggatgaccagccaatacaagctgatcgccaggtacctcggtttgctgaacataatcggcaacgattggtttttcaataatgccataggcaactttacgatcaacaacagcctttaggataccctctgaattcattgtttggatttcaaattgaaaccgcggatcggctaacagtgattcaattacccggggcattaattctaccgaggtggtttgtgaaaaccctaaaacaacttttatctttgactgctctgccgtttgtttaagttgctcgtacccctgcttccaagtgcgctgcaactgttcagccgtagcataaagtttaactgctgctggcgttggctgtacctgtcgatgaccactacggtcgaacagacttagacccagttgcttttctaattgattaatttgtacagaaacactcggttgagaaataaataactgctttgcggccaacgaaaaattccgagtttcatatacagccataaaagttattaagagtttatccacggtctgcctccaactattaagattattaatagaacctattataattcgatattttattaatgataccaatttctgtatacttcaacaagtataaagagggaggagtcaatatttatgaaacctgaacgtgcagttctgcctggacttagccttagttttgtcattgccattattagccaattgatcaactcatttttgcttaaaggcattggcgcaccaacagttgccttattgattggcattctactgggaaacaccattattcgccaacctgtttggcagagtgggactgcttggtccgaaaaacggctgttagaatattccgtactgctgctaggcgccaccatcacctttcagacgattcgtgaattacatctaacaggagtcgcttttattttacttcaaatgaccatcacgatttgcggtgcacttttactcggtaggttgctgcacttttctgaagggatgaccttactcatggcgggtggtaacgcggtctgcggctcttcagcgattgcggcgatcacgccagccattgaagcaaaagatgaagaaaaacggctagctgtcacactagtcaacctcatgggaaccattctaatgctcactttgccagtcatcagtttactagccttccatcacgataactttttacgaggtgcgttgattggcggcaccgttcaatccgttggtcaagtcattgccagtgcaaccatggtcaatgaaccaactaccacctacgctacactctttaaaattttacgtatcattatgttagtagccgtagttgtgatttttagtcggattcatcagcacaaccagtctgctcaaggagttgaatccaccgtccaaaatagttggcgtcgtgccttgccctggtacgtagtgggttttgtggtattatgtgcgcttaactcttggtttcactttaatccagcagtttcaggcttagctcatggcctttctggttggtgcgaagtcaccgcactggctgccatcggtcttcgtttaaactttgctgcgttcgttaaagctggtaaaaaactcgccctatatggtggcggtctgttagttattcaagttaccagtgcactgattttaattacggttctgctttaatgagccaaacaaacgtatgatacaaaataagcgatatcctgaatttaatcgggataccgcttattttaatcggaaactgaatcacgacgcgaacagctttccaaaatctttttatttacttttaacggttttagcctgttgtgcttccgccatccgttttttgtcccgctggaggattgggcctaagtattgcccagtgtagctttccttcacctgagcaatctcttcaggcgttccagtagcaaccacttggccgccaccctcgccaccttcaggtcctaaatcaatcagataatcagcagttttaatcacgtccaagttatgttcaataatcaaaaccgtattgccattatcaactaaccggtgcaacacatctaacagacgcttgatatcatctgtgtgtaaaccggtagtcggttcgtcaagaatgtagaagttcttaccatctgcttttttctgtaattcagcagcaagcttcatccgttgtgcctcaccacctgataacgtggttgctgactggcctaatgtgacataccctaagccaacatcgtgaatcgtttgtaatttacgagtaatcttaggaatcgcactgaagaaatctaatgcttgatctaccgtcatgttcagtacatccgcaatattcttacccttgtactcaacttcaagggtttctgagttatagcgactgccatgacaaacttcacaaggcacgtagacgtctggtagaaagttcatctcaatctttaaaataccgtcaccatgacatgcttcacagcgaccgcctttgatgttaaaactaaagcggcccttttgatagccacgtaacttagcttcagtggtttgagcaaacaacccccgaatatcatcaaacacacccgtataagttgccgggttgcttcgtggtgtccggccaatggggctttgatcaatgttgatgattttttcaatgtttttaatgccgctaactgacttgtattttccgggcttttccgaattatggttaatcttctgggctaaaactcgctttaaaatcgtgttaaccagtgtcgatttaccagaaccggaaacaccggttaccaccacaaattcacctaaaggaaaatcaacggtaatgtccttaaggttattttcggcagctccggtgatccgaatcttcttaccattacctttgctacgttcagttggtactggtacaaattttttacccgctagatactgtccagtcaaagatttcttgacccgagtaacctgttttggcgtcccagcagccataacttcaccaccattagcaccagctcctggaccaatatcgatgaggtagtcagccgctaacatggtatcttcatcgtgctccacgacaatcagcgtgttacctaaatcacgcatcttctttaaagaagcaatcaaccgatcgttatcgcgctgatgcaacccaatggaaggctcatccaagatgtacaaaacaccggataaattagaaccgatttgtgttgctaaccgaattcgctgagcttccccaccagatagcgttcgagcagaacgacttaacgtcaaataatctaacccaacgttttccaagaaggttaaccggtcacgaatttcctttagaattggtttagcgatcgtttcgttttgttcactaaagtgtaacttctcgaagaacggcaactctttactgattgccaaatcagaaacttcaccaatgtgatgaccatcaattttaacagccagtgccttacgattcagtcgataaccgtgacaagtttggcaagttaattcacggaaatactgctgcatctgaccttgggtaaagtctgaaccgttatgatagcgacgttccacattattgataactccttcaaatggcgcatccgtttcacgaacaccaccgaaatcactgtccaaaacaaagtggtagctctttccctttgacccatataggacaaattgccggtctttatcggctaatttctcccagggcgtatccatatcgataccagcctgttcacacgcttggcgcaacatttctggatagtacttagaacttgagttccacggtgcaactgcaccctcacgcaacgtttcagtggtgtcgggaacaatcaaatctggatccacttctaacttcattcccagaccgtcacagtctgggcaagcaccaaacggcgcattgaatgagaataggcgtggttcgagttcaccaacagtgaatccacaaactgggcaagcatagtgttcagagaacatgatgggttcaccatcaattaagtcagcaacagcgtaaccgccgcttaagcgcagtgctgcttcgaaggaatcgaataagcgagaacgaatgccatctttgacgacaattcggtcaacaacgatatcaattgaatgcatttgattcttattcaaatcaagctcttcatcaacatcgtgaacctcaccatcgatacgaacacgaacaaaaccttcacgcttgattttttcgaagatcttcttatgctgacccttcttctcccgcacaattggcgacaaaatttgtaatttagttcgttcaggtagcgagagtacgcgatcaaccatctgttcaacggattgactggaaatttcagttccatcattaggacaaattggtgtaccaactcgagcccataataacctcaggtagtcattgatttcagtaacggtccccactgtcgaacgaggattttttgaagttgttttttgatcaattgaaatggccggtgaaagcccatcaatggaatcgacatccggcttatccatttgtcctaaaaattgacgggcataagcagacaagctttgaacataacgtcgctgtccttcagcgtataaggtatcaaacgccaacgaacttttcccagagcctgacaatccagtaacaaccaccaatttattcttgggaatcttcacgttaatgttctttaagttatgggcccttgccccatgaatatcaatataatcgtttgccaaaaaccatgtcccccttattacccatctagttcagtctttaattctaagatggtatcacgtaacgttgcagcgtgttcgaaatccagtttcttcgctgcgctgcgcatttcatcttcaaggcgtttgatcatgtcttgctgttcttcagacgtcatcgattcaaagtcagtttcaacaaagtcatccttcttaccggcgttttcatccggtttggtgacgctgatcaaatcacgaatatcttttttaattgttttaggtgtgatgccatgctttttattataggcaatttggacttcacgccgtcgagccgtttcatccatcgcccgtttcatagaatccgtcacggtatcggcatacataataaccgcaccatgttcgttacgagcggcacggcccatagtttgaatcagtgaccgttcgttacgcaggaagccttccttatcagcatctaaaatagccactagtgaaacttcaggcacgtcgatcccttcacgtagcagattaatcccaaccagcacatcatacttaccaagtcgtagatcacggatgatttgggtccgttccagtgtcttaatatcactatgcagataggcaaccttaatccctaagtcctttagataatcacttaaatcttccgccatcttcttagttaaagtggtgacaaagacccgttcgttcgcatcgatccgtttattgatctcaccgactaaatcatccatttgacccatgattggtcgaacttctaccgttggatccaacaacccagttggccgaataatttgctgaacaacagtatttgtctgatccaattcgtagtctccaggtgtggcagacatatagacaacttgattaatgtgtttttcgaattcatcaagctttaacggccgattatccagcgcacttggtaaccggaaaccataatcgatcaactgctgctttcgtgagcggtcaccgttatacatcccacgaacttgtggcatggtaacgtgagattcgtctacaaccagcagaaaatctttagggaagaaatccagcaacgtatacggcggttcgccaggtttacggccatccataaagcgcgaataattctcgataccgttggtgtaacccatttcccgcaacatttcaatatcataggtagttcgctgcttaagccgttgtgcttccagcaacttaccttctttttcaaagtatgccaagcggtcttttagctcagcctcaatccccgtaatcgcgcggtccataatatcatcattcgtcataaaatgagttgcagggaaaatggcaacgtgatcacgatcaccaataatttcacccgttaaggcgtcaacttctcgaatacgatcgatttcatcaccaaaaaactcgacccgcaacgcgtgttcatcgtgagaagcgggaaaaatctccagcacatcaccatgaacacggaaacgaccacgttgaaaatcaatatcgttacgttcaaattgaatatctactagtttacgcatgagatcatttcgctcaatttgctcaccaactctcagtgttaccgtgtggttcttatattcagttggatcccctaaaccaaaaatagaggaaaccgaagccaccacgatcacatcgttacgttcaagcaatgaactggttgcagagtggcgcaacttatcaatttcatcattaatggaagaatccttctcaatatacgtatcacttgatggtacataagcttcgggttgatagtaatcataataactgacaaaatactcaacggcattattggggaaaaattccttaaactcaccatacagctgtccagccaacgttttgttatgggaaagaattagtgttggcttattcacatttttgatcacgttggaaatggtaaacgttttcccagttccagtcgcacccaacagtacttgagcctttttaccctgttcgatacccgctgtcaattctttgattgcttcgggttgatcccctgtgggctgatactttgaaacgaggtcaaactgacgattttcctgccgttcaatcataaatggcttacccccttaatttcagtacacgataaaagtaggaaagcagctgccttcccacatatgtttgtctattctaacatagcgaacgtattttcgccaacgaaagaatcaacatcaaataaaattcacctaaagcctggtttaacgggattccaaaggctattcagtctataacgttttttgataaatcagggcatccataaatgtctgaccgacctgtgttcgcgtttcactcactgtttcaaattgggcattttcgtaaaaatcacggttagcctgatcagcttttaaaaccagtaattgaacttgtaccgccgttaattgctttaaaacattcagaatttgatctagaatcttagcccgctcactagttgacacttggctctcatcaacaaaatactggccgagccagactaactgaggcagcggataatcaatcgtcaaatcgagagttgctaccagctgatcagcattgaataaacctaaataatgcttttgactagctgttgcttcactggcaatttcatctaaatcagaaactgcttcacgcttcgttaatttgtgatctaagaacaaatcaaagaatttttggtgctgcttttgcaactggtaaatttgattgtcatcgtcatgagtcaggtcccgaacgtcatagtcgagctggttggataattgcttagcaagtgtttgcatgtttgatgtcccctttttagttaacagttctacttcattatatagtaacttaccggaattacgactttatttaactaaactcaaaaagggaatggccagcgaccattcccttaaaaaatcctaattatttaacgactgcactactgtcagccaatgattcaatgtacttaaacacctgttggccagccataccaccgtcaccgacagcggtcgtaatttgacgcagatctttaacccggacgtcaccgattgcgaagatcccgggaaccttagtttccatgtgatcattcgtttcgatccaacccatctcgtcagtaatcccaagattagtaaactgctcagtcttaggtaagataccaacgtaaatgaagacaccgctagcatcgatagtggtttcttcaccagtcttgttgttcaaaactttaacgccagtaactttttggtcgtcccccaagatttccttaacgttactgttccagacaaagttcatcttttcgtttgcaaaggcacgatcttggaggatcttttgtgcccgtaactgatcacgacggtgaataacggtcactttagaggctaattgagttaagtaaagtccctcttcaacagcggaatcacccccgccgactacgatgacttcacgacccttaaagaaagcaccatcacaaacagcacagtacgaaacaccacgtccaccgtaagtatcctcacctggaacacctaacttacggtactctgagccggttgcgataatcacagctttagtttcataggtatccgaatccgttgtcactactttggtagcaccatgatcttcaacggattctacgctaccataagcgtactcggcaccaaactgagtggcacctttatacatatcctctgctaaatcgggtcccatgaccgatgaaaaaccagggtagttttcaatggccgcagtgttgttcatctgaccgccatagattccgcgatctaacatgaggacggataagttggcacgggatgcataaagcgcagcggtcatcccgccagggcctgcaccaattacaattacatcatactgtttagccatactacttcccctttcaagcgcaacatgtgcgacactgagtgtttatttaaatattaatagtttcaaagacgaaacctagtctactatctttttgtaagtttgtcgagaaataagattgcgcacaagcaacctgtcgttaaaactctgaacgaccttcacgcatcattaagtccgaaattgctttacgaatatccttaccttcgtagagaacttggtagatagcttccgtgattggcatttcaacgccacgctgtttggataattcgtaggctgccttagtagtagcaaccccttcaataaccattcccatagtatcgatgacttcttctagtgtttgaccttttccaagttcgtcacccgcacgataattacgggagttttgactagtgccagtcacaataatatcgccaacaccggctaatccggtaaaagtctgtgggttagccccaaacgaggcacctagccgtgaaatttcagccagaccacgggtcattaaagccgctttagcgttgtcgccatagccaagaccgtttagcgcaccggtacccagcgcaatgatatttttcaaggccgcagcaatttccacaccgatcacgtcactgttggtgtacacccggaaatagcgattcataaataatttctgggtatgcttggcagcatcttggtcagtactagcagcagtgacaagggtaatatcccgcttggcaacgtcttccgcatggcttggtcctgaaagaactgtgatggctgcccgaagatcagcaggtatttcttcagccagaatttcagaaacccgcttgtaagtgccttgttcaatccctttgctggcgtgaataatttgcggtttagtgtgcaactcttcaaggaccgctttagcttcaccggcaaccgaacgcacagccttagtaggaacaacaaacagtacggtggttgcacctgccagcgcctgcttcaaatctgagtaggctttaagggtttcagaatacgtaaaatcctttatataatgcgtgttagtgtgcttttcattaagttctttaacctgatcaggattatatgaccaaagtgaaacttcattgccattttcatccaataagtttgccaaaatactaccccaagaacctgcgcctaacactgcaattttttcagacatagtaaattctccttaatttttagcctgctgggctttttttgaatacggattaccatccaaatacattgagacctgagaaccaagtcgccgacgataaataatgaggccaattgcaccaataaacaataccacggataacagctgcgaaactcgaatggtgttaaacagcattaaactatctgtccgcataccttcgacaaagaaccgaccaaacgaataccagattacgtagcttaagaatacttcaccttgtttaaataatcccggccgatggcgcaggctcattaaaacaataaaccctaggatatcccaagtagattcatacaaaaacgtgggctgccgataagcgccgttgatcagcatttgagaaataatgaaatgcggtaagtgtaaaccttgaaggaaactcaaactggtaatttgaccaaaagcttcttggttcataaaattaccccaacgtccaatcccctgtgccataatgactgttggtgcggcaatatcgagcattaaccataccggaataaaccgtgagcgacagaagaagaatacgacgataccagcaccaatcagtgagccataaacagcaatgccaccatcccaaacgcggatgatttccgctggatgttgcgcatagtaaggccactcaaaggccacgtaataaatccgagctgcaataatagcagcgggtaatgcccacaaaatcatatcatatatatcatcggaatcaacgtttcggcgactcccttcgcgaacggccaaagtgaccgcaataataacggcactggcaataataatgccgtaccagtgaacctgtatcggccccagatgaaacgcaatggggtttagtgctgcaaggattcctcgcaaaagtgccacctcttaactttcagctatatttattttaatttattcatgctttgaatttttcttgatcaagcgatttaagttctgatcaaagacttttgttgcgtcatagcccattgaacgtgcccggaagttcatggctgctgcttcaataataatggctaagttacgcccagttttaactggaaccgaaatcttagggatttcaacgtcaaaaatcttttgagtttcggaaccactgcctaaccggtcaaattttttatccggcgtccaagcttcaaggtgaacaattagttcaatatcagtctcacttcgaacggctccagcgccaaacaaattcatgacgtcaatgatcccaataccacgaatttccagcaaatgagataaaatagctggtgctgcaccaactaacgtctgctcgtcttgttggtaaacttctacccgatcatccgcaattaaacggtgaccacgtttaacaagttccaaagcagtttcactcttaccaacaccagaatccccagtaattagaaccccaacaccatagatatcaaccaaaacaccgtgaagtgactgccgctcagctaacttaccttccagatagttagtcatattactcaaaactctggaagtcgtcatcttagtcccaaggattggaatacccgtttcttttgccgcctgaagcaattcttctggcggttcaagttgggttgaaattacaaaggcaggcgtttccggctgacacatctgcctcatcactgataacagatcttcatgactcattccctttgcaaaagaagtttcagtaattcccagtaactgaatccgcttagctggatagtaattaaaataacccgttaactcaagacctgggcgtgaaatatcactggtggaaatttttcggtcttccaaaagatcatcaccgtaaaggacatcaagccgaatatttttaactaaatcagcaaccgttacactatctgccaaattattgaccactactggtacatcaaatgcatgctcactaaagcgctatcactttagtttcccggttagctatcgggtattttatgatgctccacttaactaccatcctcatctaaaacctgtttagctaacaccagccagtagcggctcgcccttctttccgaatccggtcttaatgagaactgtgaaggtgaaaattttacatcaaatatcttaattgcttctacgtccatgacccacatagttagaaatcactgcgttgcaaagcgacattaaaatggcaaccaacagcgcggtaccaaacgaattaaagtgaaaatcattgccaaccagcattgatgttagctgcagcatcactccattgatcacaatactaaacaatcctagcgtaaccaccgtgattggtaacgataacaccactaaaaacggttttactagtgcatttaaaagcgacagcaccacgctcgccaataacgcaacccacggactagcaacgtaaaaacttgaccttaaaaaaccagccagtgccataaataacactgtgttgattaaaattcgaacccaaaatttcatatcgacaactcactttttatctgtgtcttcttcagtaacatcatggagttcttttcgagaacgagattgctgccccgttccccaaaatgtcgagtgatgcattgttccagaatcttctggaatcaatacagtgagcagcaaataaactaatagaccaaacaaaatatggcccggataaatcgtcaggataacaaaaataacgcgaaccagcgttgcactaatcccaaaatacgctgcgattcctcctagcaccccggttaatatccgctttgacgaccgtgttagtcggcgtttgctattcatcaaaaaatcacctcatttctagctaccaattacaaagtcagtgagctgtttaaacctaactgaatccaaaagtaacttgaattttgctactagaatcattatacccactcagatggagatagacaattcaatcgtgtccctatgttgaattccacaaaaggccagcagttatcagtcgacaactactagccttaaaatagcttatttcattaattttaattccacgatttgaccagttttcagataaacgatccactcaccaacgttggttaaataatcggcaatccgaaccaaatctgctgccacgttattgtaattcatggcggcaactaaaacatctgcatccgaggcaatctcgttatagctggcacgcataatctgatcccggtattcaattaactgatcattaaccgttaccaatgctttggcagcttcttcgtccttatcaacataggcttgaatggcctgtttcaccatgtcagtggtcaaatggcccatttcggcaagctgtgtctcaatctcagctactcgggtgttacctttgacttcaatcgttgcgtgagcaatatttcgagcatggtctccagctcgctccaaatcagaaaccgcctttaaaatagtgactacttcccgtaaatccgatgtcaccggctgatagagtgcaatgatttcaaaggatttggactccaattgaatctcacgttcgttaatatcatgatcgtggtcaatgattgcctgtgctgattgacggtcatgattaataaacgcatcaactgattgctgcaccacattactgactaagatacccatttcagtaaaaccgttgtcaagttcatctagttcttcatcaaataagcgtctcattgataccctcctcaggttttatccaaaacggccactaatataatcttcggtttccttacgtgctggattcatgaagattttcttagtgtcgtcaacttctatcacttcaccattcataaagaaggccgtgcgatcagatattcttgatgcctgctgtaagttatgggtcacggtaatgattgtataatcggttcttaattttaacaaagtcgattcaatttggctactggaaattgggtctagggcactagtcggctcgtccagtaagataatttgcggagaaactgctaacaccctcgcaatgcagacccgttgctgctgaccacccgacaaagataatgcactttcatgtaaatgatccttgacctcgtcccaaacagcggcttgtttcaaactcgtttcaaccacttgatctaaatactcgcgatttttctcccctgctaactttagaccaaaggcaacgttatcatagattgaaaagggaaacggattgggttgctgaaacaccatcccaatttcctttcgtaacgtcactaaatcagtctgaggcgcataaatatcttggtcacgaaacttaatagtgccagtgatcgtcacgttaggaattaaatcattcatccggttaagggttctcaagtaggtcgacttgcttgaacctgaaggaccaattaaggctgtaatgccaccttcttcaaaggtcaaatcaatcccttttaaggcttcattttgaccataataaacgtgaagatcgtgcgtttctaacaggttagtcataatgtcctcctagccaaagtccccggcaacatagtcattagtcaattgcaccttgggactggtaaaaatctgtgacgtttcatcgtattccagtgcccgccccatattaaagaatgcggtataatcactgattctagcggcctgttgcatattatgggtcacaataataatcgtgtaatcttctttgagtttcagcaacgtttcttccaatttactggtggaaaccggatctagggcacttgccggttcatccagtaataagatatccggtttgacagcaatggcgcgtgcaatacaaagtcgctgctgctgaccacctgatagcgcaagcgcacttttagtcaacttatctttaacttcatcccaaatggcagcttgcttaagactagtttcaacaatttcatccagtttcttcttgtcagttacaccccgacgttttaatgcgaaggtgatattgtcgtagatcgattttgaaaaggggttgggccgttgaaagaccatgccgattcgtcgtcgcatttcgtaaacatcgatttctggtcgattcacgtccacaccgcggtacaggatttcaccactgacgcgagcaatgccgtcattcatccggttcaatgacctgagataagttgatttacctgagccagatggtccaatcagcgctgaaatctggtgttcaggaaactttaaatcaccttcatggatagcttcattatcaccgtaataaacgtgaagctgctgtgtttccaatacgattggttgttgacttttgaggctgggatccacgatatttcgttccagccacccgccatctaaacgcgggcttgagggattaatcagcatttttattcctcccgataatgactttcaacaaactgactaccccgctgttagtcgtttaaacaaccgatgaccaacaaaccgagcgagtaaattaaagcctagaactgaaatgacaagcactgcagaagcaccagaagaaattgccttggcatccggcataataccttccgagttaatcttccaaatgtgaacggctaaggtttcagcaggccgcattggatttaagggactggaaatattaaacggattccagtctgtaaaatttaatgccggtgcgctttgaccagcagtgaaaattaaagcagcagcttcaccgaagattcgaccagcacttaaaatcacaccggttaaaatggttggtaacgcggctggcacaatgatgtgaaggaccgtttcccatttggacaatcccagagccagaccaccctcacgctgctcatctggcactgcagctaaggcttcttcaatgctgcgagttagtagcggcaagttaaagaatgttagggcaaatgcaccagaaagtattgaaaaaccaaaaccgaactgaacgacaaagaccaggaagccaaacaacccaaccaccactgaaggtaacgaactcaaaatctcaatggcagttcgaactagggacgtcaaccagttttgtttagcatactcgtttaagtaaatacccgcacctagcgcaatcgggaaagaaatgatcatcgttaaaattagcagatagaacgaattaaatagttgaatgccgatgccgccaccagcggtaaatgctttagcgggagacgtcagaaaatgccagcttaatgcgggcaagccactaataatgatgtaacctaacaacgcagctaagattactactatggtgctagcgatgacgtaaagtgttgcaatagcaatttgattacttactttggaattcatttggacattgccccctttcggccaatcattctgatcacaaggttaaaaatcaacgacatcatgagcagaaccagtgccagcgaccacaatgcgttattttgcagcgaccccatgactgtattaccaatacccgtagtcaagactgatgtcagtgtggaggccggtgaaactagattggttggtagcaaagcagcgttcccaatgaccatctgaacagctagtgcttcaccaaaagctcgagccatgccaaacacaaccgcagttagcattccaggagttgctgcccttaaaaccactttataaattgtttgccattgcgtggcgcctaaggccaacgccgcttcgcgataatatcgtggtacggatctcaaagcgtctacgctcattgaagtcaccgttggtaaaatcatcacgaacagcacaaaagtacctgctaagataccaaaaccactgcccccaaaaatactccgaatggctggcacaacaacggttaaaccaataaagccataaactactgagggaataccaaccagcaattcaatcactggctgcaaaagtttagctccccgatgcggtgaaatttcattcataaaaatggcggttccgatggcaaagggtgtggctagtaatgccgataagatcgtcactacgaaggaaccactaatcatgggcagggcgccaacttctggctgtccctttgaattcgtcacgttagggttccaatccttaccagttaaaaaatctatgatattaacgcgatttgagaagaaagtagcaagacccttagaagcgacaaaaatgataatcgcaaaaacggtcaccgtgatgagcattaaagccaggaaactaaccgttttccccaaccgttccagcttggcagctttcgaacgtttgagcagttgtttttgtaatttattattcatgacttgcctccactttatgcactcttccctgtccatctcgagtaacgttcatatctgccatgctgatatagcctaaacgccgaaccagtgaattttgaatttgtcgagattgaacgtatttaatgaatcgttgagccaatggttgaggcgttttactcgtatacatatgttcataagaccagattgaccacttattactggccacgttttgattagttggtgccacaccgtttaggctgacagcttgcaccgacttatcaacgtaggaaaaaccaacataactaattgcaccaggagtggttgagacaatttgtcgaaccattccagatgaatcttgttcttgagctgcgatgctgcgatgattcttaaggccaaaccgttcaaaggttgtacgggtaccgctcccctgcgcacggtttaaaatgacgattttttgattattgccaccaacttgggaccagttacgcactttcccagtaaaaatattaatcaactgcgtcgtggttaactgatggacacctactgactgattaacgattggcgtgatgcccacaaccgccaccttgtgatcttgaagtcggttcgctttaatgcctttttgctcttcagcgaaaatgtccgcattaccaatatccactgcgccttcttgaacctgactaagtcctgttcctgaaccgccaccctgcacattaataaacgtacccaagtgatgggtcgaatagtcttcaccagcagcctctactaatggctgtaaagcagtggatcccactgctgtaatggtcatgtttgccttattgacttgcctagtttgatacgcccagccgcctagaacgatcaggccaactacgagtaggcactcaatccaccgcttttttcgcatgttcaagcctcccatttcatctttcaaaaattagtatatcgagacaatgtaaatgtaatgtacatttctttgtaaaggttatgtaaacattcttgatttactactataccaatcttcggttagacaaaaagaatcctaaatattcaataatctgaatatctagaatccaccaaaaatcattttattattactgtttaacaggaaacgaaacggagaaagcactaccgacgccacgttgactttcaactgaaatctgcccttgtagagattggaccaattccaacacaattgctaaccctaatcctgtaccgttaacaacttgtttcgtacgcgaagcatcgacccgataaaaccgttcaaagattctagactgctcattttgagcaatgccaatacctgtatccgttaccttcaatgtccattgttgctcgtcaactgcataatcgatggttaccgaaccatcttcacgattatacttaatggcattagacactaaattcttgataatttcaactaacttgccttcatcgctacgttgcacggtaccaagcggcacctgattaatcaacgtaatgtgctttactgaagccatttgctgcaacgtgcttaactgttcatcgactaaattagaaacatcaatatcagttattttttgttgggaaatcgattgcgattcaattctggaaatcgacaaaacatcttgaatcaattcagttagccgcttactttccctttggataatgtccaaaaattgattcaaggtttcgggatcattctttgcgccggcctgtaacgtctcagcaaaaccagaaatcgcagttacaggtgtttttagttcatgagaagcgttggataggaagtccatttgcatcttttcaaccgcgtaaatttcggttacatcatacagtaaaactaaaatttgaaagaaatcttccgaagttgacgtatagatgaccgatgcctccacccgtttttcagttggcatccctggcagcgtgatgacttttcgtttggattgcttattagtaaaaacttggccaatcaaagaaaccagctcaaactgatggatatcttgcgtatacggatgccgtctactactaatatccgtttgcaaaaattccgccattgccgaattagccatttcaacttttctataccgatcaatcaccatcacgccaatgggaaggtaggataacaacaatcgcagttcctccccctgctgagccttgtcacgcagaaccttctgctgatgggtctgcaagtgattgattgccattgctaaatcgtaataatcgctatcttgacgtaacagaatatgagctggctcttcgtctttcaacatgccttcaactttatgtgtcattgcaaccactggctgctggcgataccgaaaaagccagttaaagagagccacttcaatcgccgaaacgatcaaatctagcatcgctaactgagtatacacatgtgcaacgatttgctgatctataagtaactgggcaactaagataaagaccagcatattgatcaccagcacgcccaaatactctaaactaatccgtttaaccatgctgcggtacctcaaaacgatacccaaaaccacgcacagtctttaaataaacagggtgtttgggatcagtttcaatcttgtctcgtaaatgtgaaatatgaatatccaccattcgcgtctgaccagcataatcaaacccccataccccttcaagcatttgatcacgtttcaaaacttgattgggtcgcttaactaggtaaattaacagctcaaattcttttggcgtcagtttaaccttacgaccatcgacggtaacggtgaccgttgactgatcaatgacaatgttaccgacacgcaattgctgactctcatcaaaacgagtttctctgtcagtctttccctgtgtccgtcgtagaaccgcttttaatcgtgctaatacttctctgggactaaacggcttggtaatgtaatcatctgcacccagttccagtccaaataccttatcaaattcatccgtcttcgctgttatcatcaaaattggtgtatcaattttttcttgacgcagttttttggtgacttccacaccatctaaccctggtaacatcagatccaataaaattgcatcgaaatgcttttttttagccatctcaactgcatcaggaccattagtagcagtatccacttcaaaattagctttttccaaattgtaggttagcagcgttacaattgctggttcgtcatcaacaactaagactctttgcatagggccctcctaatctttaaacatcacaataccaatctcatgcggtgaaccgtcaaaaattgcagtttcagttactttcaaatcaccttcaggcgtctgaattttaaggtgacaataggttgggtcagacaataatgcttcgtaaaaactagtttctgaatgtaccggttgctgattgcaagtagtgataatatcaccaacctggatgtccatttttgcagcaggtgtttccgttttaattcctaatactcgtacaccatgatcaactttagagtaccaaaatgactgtcgtcgatcatgccaccgtgtttttagtagacagccgatatagcccacataggctagccccaaaataatccaagcagcaggttgactcaataacgcaacgattccgcctatcagaactaaaatactaagaaccagaaatgactttgccaaccgtttaaaagccgtcctaggattttgcttaaaaattgtcaggtgtaaacctaaaagtattggcaaaaacaacggtgtgacgtgtgtgccaccaagtgataatactggccaaaaagccaaatgagcactgataaaatctcccggaatcaagactaaggttggaacaactaacagttcgttaaagggatagcctgcgataagtttaccccgtttttgggcaaaaattttgggcgaagcaaaccgaccacccgttttttttagccaacgactcagcaagaataagacggccgacagtagcattattaagacagcaatctttactggttgacgggagaatcccaactgtcgcaacagtgccatcactgggtggctaaaactagctttatcgaaccagtcatacaataccacggttcccacaaaaatggtgattggaagtcgtgaacccaggccaaaaataattgcaattagtgcaaaaactgagtaacaaacccaccagccaataggcaccgtcatcccaacagcaaatgaaacgactgacattactagcccccagaaaagacttaataatacaaaatgccgcacttcaaatttgtcagaataaactgcgctaccgaaagttcgtcgttcccgtttaatccggcgatcagctgtccaccattcgtaaatcaacccaaaccaccaaaccggttgagctaccaaacttaatattaataatcctattgtcatcatcaacacctgcattttcattatcagtttctaaaagaagtatagcataaacctattacacccgctttcttgctttaagatactctttatcaataatagcgtatttgatatatgacgttaaccaattgaacagtattaaaaaacgtctaacttttcaattaaaaaatatgttagacgttgttcatcatcagtcagggtttgcttgctccaactgatattgcaggtacgcattaataaagggatctaaatcaccgtccatgaccgcttgaccattcccggtttcgtagttagtccggtgatcttttaccatggtataggggtggaaaacgtaagagcgaatctgagagccccagccgatatccaactgttcaccttcaattgctgccttttgcttggctttcttttcttcttctcgttcatatagcttagctttcagcatattcatcgccgtttgacggttttgaagctgtgaacgttgggcctgactagcaaccacgattcccgttggctcatgtgtaattcgaaccgctgaagaggttttgttaacgtgttggccaccagcaccactagcacgataaacatcaaccttcaaatctgctggattaatttcgacattaacggaatcatccaattcgggtaaaacgtctactgatgcaaacgaggtatgtcgtcgaccagcggaatcaaacggtgagattcgaactagtcgatgaacccctttttctgaccgtaaataaccataagcgttatgtccagaaatcagaatggtaactgaactgattcccgccacttcacctgcttggtagtccagggtctccacagtaaaatcatgctgttcggcccaacgcgtatacattcttaacagcatcgaaccccaatcttgagactcagtgccacctgctcctggatgaatttccaaaatagcattattagcatcataaggttcatttaaaagaagggtgagtcgatattgttgcaaatccttcttgagtttagccaggttatcttccaattcaccttgaacttctgcatccggcccttcttccaacaactcaactgccacagaaatatcatccaattgattttttaaatcttggtacgattctgatttcgcttttagctgattagtctcatcaattagcttttgtgccttaggctggttatcccaaaacccgggttcagccatttttgactcattgattgaaatactttcattcagggcatctaagtcaaagagacctcccaaagccattgatttcactagtcatggcttttatatcacgtttaatatcactgagttccattacctcttacctccagattaatgctcttaacttaaaatcagccttaacaataccgcgtatgtgattatttcctctagatacgaaaaatccgcatgaccaaagtcatacagattttcatttggtcggtaatcacaccgactaaagtctttaacgcttaatattttgacgaatttctgacttcatgaacaaacgagtagcatcgtaatcaatgtcagcaatcatttcttcaaacatccggtagccatcttgttgatattcaactaacgggttcaattgaccataaccacgtaagccaatagaagtccgcagttgatccatgacatcaatgtgatcagtccaatgagagtcgaccacacgtaaaatgaccactttttcaaattctagcatttgtgctggatcataaagttgcttttgtttggcttgataaacatcatccgctaagcccttaagcagttctttgatttgatcagcactcttgttcttgaggtcatccaacttaatctgatccggactaacaattgcagaaatcgcaaagtccaaaatcgtgcttaaatcccaatccttctgctcgccttgcgtatggagattaacaacccgatcaatggttcggtcaaacattggcttgataacccaacgtaaggatttatcttcattgatcacttcattacgctggttatagataacctcacgttgcgcacgcatcacatcatcatattgcaggacgtttttacgtgaatcatagttgttaccttcaacccgcttctgagcagattctacttggcgactgatcatccgactcttaatgaccgcatcgtcaccctcaacattcatccgttcaaggaaggctttaactcgatcagtaccaaaacggcgtaacagatcatcttcaagtgacaggtagaactgtgtcaaacctgggtcaccttgacgtccagaacggccacgaagttgattatcgatccgtcgtgattcgtgtcgttcagtaccgagaacaactaaaccgcctaattcacggacaccgggtccaagcttaatatcggtaccacgaccagccatgttggtggcaatggtaaccgcaccacgttgaccggcattcataatgatatcagcttccttagcgtggtttttagcgttcaaaacaacgtgaggaatgttctccttatccagcaattgagaaatgtattcagaagtttcaaccgccacagtaccaaccaagattggctggcctttttcatgcaattctttaatccggtcggcaaccgcgttaaatttagcttccaaagttgggtacaaaacatctggttcatcaatccgaataacgggcttgttagttggcactgaaataacttccatgctgtaaatctcacggaattcttcaatttcagtccgggcagtacccgtcataccagctaacttatcatacatccggaacatgttttgataagtgatattagccatggtcttggattcttcttgaatatccacgccttctttggcttcaatcgcttggtgcaaaccgtcagaataacgacggccttccataacacgaccggtaaatgaatcaacgatcaggacttcaccatcggaaaccacgtaatccttatcacgaagcataatgaaattagctcgtaaagcttggtccaaatggtgggtcaaagcagtgttatcagtatcaaagaggttcttcaggttgaagtatttttcagcctttgcaatcccttcttcagttaatgacacactcttagattccaaatcgatcttgtaatcggtatcttcatgtaaagttttcgcaaaccgatcagtccgctgatacaactgtgaagtaccttctgattgaccagaaatgattaaaggtgtccgagcttcatcaatcaggattgaatccacttcatcgacaatggcaaagttcagtggccgctgtaccatgtcttccttataaacaaccatgttatcacgcagataatcaaacccaatttctgagttagttgaataggtgatatcacagttataagcagcacgtttttcttcaggtgatttttcagtcaggttcaaaccaacgctcaaccctaaccagttgtacaattcacccatttcttcagcatcacgagatgacaaatactcgttaaccgtcacaacgtgaacccctttacctgacaatgcgttcaggtaaactggcatcgttgcggtcaacgtcttaccttcaccagttttcatctcggcaatattaccctcatgaagcacaataccacccataatttgaacgtggaatgggtataagccaagtacccgcttagcaccttcacgcgcaacggcaaaggcttctggcaataagtcatctagggtttcaccatcttgataacgtttttgaaattctggagtttttgcttttaaatcatcatcagataaagcttcgtactcttttgagtagctattaacctgatctgcaattttgctgattcgtcgaagttctcgtttatcactttcgacccagcgttttaaaaagttagccattcttgattcccttctgttaatgtgttctcaattattatcattcatttgattgcataccatcaactagtctaacatttatacgcagtttttaaaactcatctgataagtataatttttaaaagactgtgataaaaacattacagaacgactacaaagggaccgaagctttaattaaaaagcttcgatcccctcataactaccttcttaaataattaatcgccggcttcaatcaaaccgtaacgaccgtcattacgacggtagacgatattgacagcatcggtttcagcgtcttcatagataaagaagtcatgccccagcatatccatttgcagaattgcttcttcgttgtccattggctttaaggaaactcgcttcgtccgaacaacttctaactttgcactttcatcagagtcttcgttgtcggcagtttcaggtgtaaattcaagatttttgaaacctttttcacgagacttacggttgacctttgtcttgtacttgcggatctgacgctctagcttatccgtaaccaaatcgatacttgcatatagatctggagacgtttcttctgctcgaagggttaaataagggagcggaatggtaacttccaccttagaatccttgttttgatacaccttcaaattaacatgagcagttgaatccacgctttgctcaaaatacttctcaagcttactgatccgcttttgcacgtaatcccggattgcttgagtgacctcaatgttttcaccacgaatattgaatgtgagcatagaacttctctcccttccacaacaaacaaaagttaatttaagcatacctaagtctacggcttaaatgtttgttttgtttatagcttaattataatagaaagcgctacaatacacaatagtttaaggcttcaaacagcattattctgaatttattcacattatccgtgcgctaacgtaagacccataacctcactagcaccagcgtctaagagcaatgttgcagcgtggcgaatcgtcctaccagtggtataaatatcatctacgatcaagacccgctttttattaaatttttcggcctttaaatttagcttaaaaggttgtttggatttgagtcgttcctgtcgattttttgctgactggggttgctgtttatcagactcaagcgtcatgagaccttcaaccgttttaacaggttccaataggccagcaacttgattgaacccccgacgttgctgagtcgcggcatcaattggaattgggaccactaaatcagccttaaattgattgacttcatgaactattttagtttgaaaaacttttcgtaaccgataatcaccgtaaaatttatactgtgacatatattgtttgagcagatcattatattgaaacattgcccggttcttaaaatttgacggttctcgccactgtacacaatctgtgcatagctgatctgaccacgcacgaccgcaacccgcgcacgcctgttcaggagaaatggcttccaaactatcaagacatgcccgacagagcaacgaatgttcaactggctgaaaatttaataactgccatagtgttagctgttcttgactattacggtgacatagcaaacattcagccacgaaaatgacctcctattaaaccttctttttgggcttttcggttaacaaatctgatttgacaccgtgcttctttgattgctttcgtttgacgatcagcaaaaaaattcaccagtcccgtaggataggccgctttacgtccagctctccccgcaatttgaactagggcagcggttgaaaatacggcatcatccgcccccagtacaatcacgtcaatattggcaaacgtgacaccacgctctagaatggtagtcgtgatcaaacaatccaattcaccatttctcatctgctgcactttttcatgccggttctcatctcctgcatgaactgtcgctactttcatatctgggaattgatattttagtgctgattgaaccccctctaaatcctttacatgcgggacaaagattagaaagtgacgttggtttgaagtgatttttctaagtatggttttcactggactaggtaaacgctttttgaccagggattgacgccacctactcgttaactttaacctgatctcaggcagcggatgtccatgataccttgcgggtaaataactaactgaaagttttttctggcgttcttgtcgctgcagttccttgctaggcgtcgcagtaagataaagtaacgccccggactcttttttagcctgttcggcagcatagttcaacccaggatcagcagcaaacgggaatgcgtccacttcatcaatcaccagaacatcaaaagcatggtaaaatcgaagaagctgatgtgttgtacatatcgtgagctggcagtagtcgtaaggtctttccatctcaccatacagcacaatctgtgaaataccgctaaatgcggcttgaaaacgtggtgcaagctctaagcaaacatcaattcttggtgacgcaatgccgacgcgtaatcctttcattaatgcttctgcaataccatgaaataacatttcagttttaccagcgccagtaactgcccagagcagatgggttttaccagcagtaaaaatgtcgctgatctgccgactgcaggcgtcctgagcaggtgttaactcacccgtccaagtgagcggtgatgctgcacattgtacaaattgattaggttcaggcaacgaccaaagccatagatttgacgttactcgtcccaactgaaaacagtgcggacaataatagtggctgcttggtaaccgaacctcttgcttggtcgttttctggctgcaacgttgacaaattacccactgactagtctcaatcattgctggccgacggattaaacgtgattgctgattgatttcaaccgacatcgtatccgccaacacctgtcgaccaaaaagctgtttttccttcatcacttttaccacctcattaaccatacatacgcagaaatggagtcattcaaccaatgtcagaaaattatttaaccattaaagtcgctggatctcacgaactggaaattaaaaaatctcgttttatttgcagcgtacaacgagttgaaacaaaagaagtggctgatgccttcatcgcatccgttcgccaggacaacccaaaagctaatcacaactgcttcgcctacatgctaggtgaacacgatgaaattcaacgtgaaagcgacgacggtgaaccttctggaaccgccggcgtgcctattttggaagttttaaagcaactgaaaattcataatgttgttgccgttgttacccgttattttagtggtactaaattgggagctggcggtcttattcgtgcttacagtaacgccacctcccgtgccatagagcaggttggtttagttcaaaaggtcctgcaacgagatctcattttgaacgtctcatacgctaattacgaaaagttaatttatcatctcaaacaagaacagatcaacctgattgatacgacttacggtagtgacgttgtagtgaccattgcggtggatcttgattctgtcgccgaagttcaaacccaaattacaaatttactttccggtcaggtcacgattaaagctggagacgaacattatcatgaagttgacgttccggtttatccggactctcaggattaagatactgccacaactttgctactatataatccatctgccatttaacgcaaataaaacccatcccgacaagtacatcggaatgggtttttattcacattaaattctgaaatctaccaagttttatcacacactcaatgtgaatttttagaagtcgttccctttaccagccgcttgatccagtttaataaaggctgtcgatttacaccaactagcccaattgcctcaacaaataactctaagccaaccaaactggcaacggtcaaacaaatcgtcccccaagtaggcgagattgggtacatcaacgaaatgaacgcaaaaatcaacgcaattccgtaaatcactaacaccgtttgccgatgtgtcagaccaatttgcatcaatcggtggtgtaaatggtgcttatcagcgtgtgaaattggttgccgattcagtaaacgccgcagtatcgcataaaccgtatcagtaattggaacccccataatgatcactgggatgatgacagaaataaacgtgacgttctttaacccatacagtgagaaaaccgacatcataaaaccgataaacagtgaaccagtatcacctagataaatccgagctggaaagaaattatagggtaaaaagccaatcattgcggccactaacgcaaaaatgctaatgcctacgaaagtatttgcaacgttcaaaaaaaacagaccagttattcccatagttgataacgcaataatccccacaccagtggcaaggccatccaagccatcaatcaagttaacggcatttgtaatggctaatatccagatccatgtaatgggtaagcttaaccaacccagtgatatcataccgacaaacggaatcgtaatatgactcattttaactccagcagcaaagtaaaccactaaagctgcaatggaaataccgattaccttttgacggggtttaagttcgaaaatatcatcaataatgccggtggcaataatcacacactcaccagcgaaaactccccataactgacgcgttggaatttgaaaccttagtaggaagatagttgcaaaggagtatgaaagaaaaattgccaaaccacccatcgtgggcatcggcactttattcacccttcttgcattaggattatcgattgcaccaactttaaaggccagttttcggataaacggtgtcaggatagcggataaaatcatagtcgcaactagactaacaatgatttcaaatttcatagtagtttcctctcttcatgacacattaatcctattatacaaatgactttcagtaaacacaatcacgcaccctaaattttttctgtcattaattgaacaaattgagcaaactgattaatttagagtctaattacacaagtcatttttcagtaagcgtttacagttatgactataatcttgcgttttattggaaaaatgagtatacttacattgtgaagcgaaagcgctttactagtttgtgaaaaattttttataatttctgaaaggagtgtttaattatggcaagtaaccaagctaccaagacagagggaactgaacacgaagcggcaccaattttgcaacaaatgtgcatcttcgcatcggtcttattcgtttcatcattaatttcaccattattcccaaagtcgttcccagttccaactccggttattggtctggctttgatgtatgtacttttagcatcacacatcattaaattataccaagtggagaagatggctgactttttgattagcttaatcgctttcttgttcgtcccatctggtatccaaatggccaactcactgaacgtcttcactgacgatggtgctttgaccggtgttatgctgattgtgactatcatcttagctactattattctgttagttgtaatttcatacacgaccgcaggatttatggccatcagtcgtaaagtattccacaaatcaactgatgttcagtaattcggcgactctccccaactatagaaaggattgagttaaatgacctgggtgaactttttcggtaatgcattagatccgaaagtcggtgggattgcattctttggtattttcttatcattagcagtgtttctcattggccaatatttatttaaaatttcaaatggtttcttcttattccagccattattcgttggtatggttctaggtatttttattctttggctgttggccaaatggtttggtgtttcactgccaaccttctacatgtcagcatacaagccaggtggtgacatcctgttctggttcttgaaccctgccactattgcttttgccattccgctgtatcgtcggaatgatgttgttaagaagttctggttagagattgttttgtcattgatcgttggtatggtgatttcattattcgtcatctactacgtatcaaagggcttaggtctcaacaacaagatgattgcttctatgttgccacaagctgcaactactgctattgcgatgcctatttctggcgccactggtggtattccagccgttactgcgatggcatgtatcatcaacgccgtcttgatttacgccttagctgatgtcttgatcaaagtgttccgcttaaacagcgacccagttggtgctggtttaggtttaggtactgccggacacacggttggttcagctaaagccgttcaactcggttccattcaaggtgctatggcttctatcgccgttgttgtcatctcaatcgttgtcgacatcgttgtaccaccatttgcacacatgatgggcttgttctaaacaggtaattaaataaaaaatttttctcaactacaaacaaactaaataagtattaggatgccatatcctaacttaacaagaaagctgtcagatcaagttctgacggcttttcttgtactaatgtaaatctaggactgtgccggattccgcatttcaaccatcttttagccagaattagttctaattgtgcttcgactgactaactgttccttaacataaataaggcctatttcccaacaatgattgctggaataggtcttatttccttatctatattaaattctggaatctaacgcgtctcatcttactgagccgtgtaaccaccatcaatgacaaattcactaccagttgagaacgtagactcatccgatgccaaatataaggccaaaccggcaacctcatccttttcaccaaatcgtcccagtggcaacgaagccagatgagcaccaatcaacttctgttctttaggatcattatcaagttctggtttgtgaattggtcctggatgaatcgaattaacacgaataccatacttctgtttagcacagtaaagagctgcggactttgtcatcattcgtacagccccttttgcagcagtgaaggcaaataagttaggatagccaatcaatccttcgattgaggacatattaatgatggaaccaccatgatctttcatattcaaaatgccatacttaacgcctaacatttcgccgtctaaatcaatggccataactttatgccattcatccaaagtcacgtgttcagcatcgttaaacgctgcaataccggcgttattgaacacaacatcaacgccaccgaacttctcaataaccgttttgaatacgttttgccaatcttcttctttagaaacatcatgcttaacaaaaatagcgccatgaccgatttctttcacaacttcatcactttgagcgtcatttacgtctgtcacagcaacctttgcaccctcactggcaaaccgctttgcagtggttaaaccaatcccgttggcaccaccagtgataattgcaactttattatctaaacgtcccataattatagaacccctttcaaatgaaatgtgatttacttacttgtgttattaggcatacaattgagttgttaaaatagttttcctgatcaaaagctcactgaccaaaggagttttcaaattgaatctattaggattacgttacttcattgctgttgctgattacgccagttttactaaggcagctgaacacttatttgtgacccagcccacgctgagccgacaaattagcgatcttgaagatgaaatggatacaccactattcatccgcagtcaccattccctcaaactcaccagtgcaggcaaccgttttttaaaggaagccattcgcattgtgaatcaacttgaccatcttaaagaggtcgtcaatcccggtgaaagcagccaggcagagacaattcgaattggttatcaaagctttctggacaccaacctgatgtatcagattctgaaacaggtcagccaaaaattccctcaaattgatttaccgctttttcgcggtaccccttcagagctacgcaatcaattattgaatgataactgcgacgttgtcttcgccttgtcaccttgtattcagggactaccccaaattgactatatcgatctccaagaaaacaggttaaaaattgcggtgcccttaaaccatcgattagcccatcaaagttccgttaatttaaaggacctagctaacgaaaactttgtcatgctcgaccggaaagtctccccttacattgtggattatgctatcagcctgtgtatgcaaaatggtttctctcccaacgcgtctcactacgttgataacgctgagaaggccttaatgtttactggtgctggcaaaggcattacattcctgcacagcatgaataaagttagcaatcccatcgacagctttgatgttaaattactcaatatcgaaggtcaggttaatgactttgatttcgttttggcttacaaagaaactaatcacaatccgcagttaacgacttttatgtcagaagtcagtaacttcattactaaaaaccagcaaaaggcttgaaagctcgatgaactttcaagcctttttggtttattttctaactctaaatccaactgacttaaaaccgccatccagctgaataaactcagcatccgctttaaatggtaactgactggttaattcatctttgttttcttcagtcacaccataaagagctgcgtggaattgatgagttccggctggaaaatgaccaacgcaaacacagtatggttccttgctgacaaagaactcatcggcctttctaaaggtatagtcgccaccaacactggaatcttcaaagcgaatctcatcaatcacagcttcggttcccaaatcaatccagtctaagttcgtactcccgcacttttggcaagttggtagtggtggccaaacaacgtcgccacaatcttgacacttcatacccataatcttacctttttcaagattatcgtaatacggttttaaaattggtcgtaatttatacatactggtttcctcctagtcttggttttctagtaaaataccaacggtcgtgtgaccaccgcccataccacggacgagaacatcattaactggcttaggaacctgactgccaccagcagtaccacgcatttgcataatcgcttcacttaacatgttgatccccgcgcagccgaaaccatggccaaaactaagatcaccgccatgtggattaattggccggtcagcatcgaaacgagtacggccttcgagttcatacttataacctttaccctctggtaagtagccaaagacttcggcgctgtcaagctgttcaccagaagtcataaccgtggtgatcatgagatccaaatcatctgggttgaagttatcctgacctccgtaaagggcatcacgaacatcaacgttcatctggtggaagcagaatggatagcgctgcgtgttggaaactgaagcatgatcaataaccgtaattggatgatcttgatacttcttagcaatatcagcagaacaaacgatgattgcacctgcttcaacgttgtgcagcacactgccgctcttacggatatattgcgtaatcttggggttattatctgaacgcatgtatgccatgacgtcatcataaccagcttttttagcgatttcactatacggtgtccgttctagagcatgtgggttatgtgacgcattgtaacgtaggttaatggccattgcgttataggtatcatccagcgtcttttcatcgataccatagtgcttaatgtagtatttgccttgttcctcagtcagtaaattgtcactaaccccatcaaagcggttgtatgccgtgtcaaacagtgcacgtcctggtgaccaccagccgtcgtatttctggattggctgtaacatataagcaggttgattccgggcgttaaagtgttttggtgtttccaaaccagcacacatcacaatgtcgtacttgccagaagcaacagagttaaccgcttcgttaaaagctaaatagccaccagcacacgcctgttcaatatgagtaacgggtttgccagctaatcctgcccattcttccagcgagccgacaggtgacatgacattgcccatcgtaacaaaatttgccatttgtgaatagactaacttgtcgacgtcttttggtttaattcccgcatcttgcatagcttgattacaagcagctgcccataattcataaattgataagtccttgtattccggatcatcaaaagatctttgcggtaagctgctagtgccaatgattgaaacaggtcgagcgaatttttgttttaacatattactttcccctttcatccaggtcatattatcaaggaatgtatgcgcatacatttttatttatcgccaaagttcataccggaaaagctatgaacaatttctgcgattacctttggtacacgtttatcataacctgcgggataggggtttgtataattgttattccgtatgtaaatcgggcaagacagttctcatgaattttttgtatgtaatttcacaaatcatctttacccattgatttccgctaatcgtttctatcattattattttcaataaattgatataattcatgcaagatttgattctcataatgctcgttaatagccacaacaatattttggttcagactattatcctctaaatcagcaatcttaatttgatatttttcttccaatgtaccgtcgttcatgccagaatacagaaaagcaagcccttttccaacagcaaccattgataaaccttcgtctaaattattgacataatagttagccttcaagttaaatccattcttcagcccctgagcaataacgtaatcgacaatcactggtgactgctgccgttccaaaaggataaaagtttctttttttaaatcggcaaaatgcagctctttcttttgactaagtctgtgattcctgggtaacgcaatttgcagatggttttccataaacagtgactgtttgatagctgacttattttgaaaataagaggccagactaaagactaggtcatagctaccgtcagcaagaccgtctgctaaggccataggcgtcccttgatacatcatgaactgggtacttgggtggctgactctaaactgatttagcagccggtacatgccactccatttaaagttagccaaataaccaatttttaggatagtcgtcatcgaagcaacgtttttttgagcgtcaaacaagtgggataaatgatccacacgttttaaaatagccgtcgcttcaatgacgactttttgcccttcattcgtaagttctagggaatgtacagtttttcagaggccttagtaaagcttctttcagtggcgacttcaacaaagtacttcaaggttgttagtttcaaaagaaaacctcatttcaaaaaagaggctgtgacttaagtcgtaaatcatagctttcaaaaaaggtttatcgaagaaatcaaaatttgatttctcgataaacctttttttctgaataaaatcgggattttatcccctgattttaacaatttttggcaatatttaaggcccaaatgacgatacctggtccttataaaccttgctacaaacctcggaccaaaactttgtgaaaccctaataagcctctctctaccggactggttctacatctattttacgccgggcatacatttgtgccggtcgttccgtggttaaccggtcccgctggctgagctttaaaatcattcccaactgggattgatactgatatgttagggtttgtccagacgcggtcaggctgctggactaacctgggtgatcctctcgaattttctctgcccgatagattttgaaaatcacgcgtgaataccacttcttgtcagtggcttctgaataacgctgaattatattaacgccccgctgatagcaatataatagtcgtatcgcgtgagattcagtctcatgattttacgatctccagactgccactgacggcttggtctttaagacaaacacgttccgtacggaatgctgtgctggagtggtgctcatagtttcttctattgtacggtaattcgcttctaccataaccagcatcagccacaaattctcagccaactggttgttgtgtgtcttaaggtccagaaatggtaataaacgtcttgcgtatcggttggacgcgtgtgataaactgaaaacctaatacgaattggattattggtgcgagttgtaagttattaggctggctgaactgaccattcaacattggatcttctttgacgcgcatgaagtgctatctatgtcaggttttagagtagctattgcggtcaccaaagttttccaaatgtgttgagttcaatcctttgcctttgcgttgagtgtgagctggcgcttgatcttcttgatttttcgcgatcctgcttagctggattgggcgataatttgggagagtgtttgatctccttatccagtatcgagcgatcctcaagtcgagtaatcacctcatccatcatcaggttaaattcgtcccctcgggaacgaagctgcaccgtaggcgtggcttaatatcagccaagatcttttggatgcttcacgatttcatctgatcaaagcgcacggtattcttacgccgacaacaactatactattggcatcgccaaaatcttggtaccatcaataaaggtcacatcgtcaattagttttgacgacgcagtagtcaaccaactggtctaacccatcatgaatcaaagtttctaactcatcggaatccggaagcgacatgtccgaatcgtgggcatctgtttatttcatgggtcagcagcgatgttaagttcctcaccgcaaaggtttcgattcggcgactactaaagaccccgcgaggtaggcgaaaaagaaccagcttcatcatggcacccaaatcatattctcgaggacgaccgataggtaggtagtgctcctaattgagagtgactcaaccagttcattaatatagtaagcaggattatcttttgaacgatatagtcggtagttagaggtaaaatgtttgatccatgttaaatttgtcatgtggattgtcctttcgggatgatttttgagtatcgggtgtgaccggtactctttttttctgtcattatatcaaaaaagcaggtagttaaaaatccttggatttttaactacctgcttttgaattaagggacttatgtcacagcctcttttatctcacaagtcaattattgtttaacaattggcgttgtcattaatggcatttgtaaatatgacgcatattggccaccagtatgaagaatgtgcacaccttgattatccggtgtgcagcctggggtacctggcataacggcaccaagttcgtcctttgaactgaccacgattcgaagcgtttcaccagccttgtaagacagacccactggacttaagacaacatccaaagaaacaatttcacccttgttcaatttctcgacccggtcgaaactgtacgctggaatgtcctcagtagaagtcttgctatccaaatgacgcatagaggcacgtaaacgaccccatgagcccttatagcgaagtgcagaggcaccttcttggctaaagtcttgcatggcagcaccgtggttaggaatcacgaattcgctaagaacattacccatcttatcaagtttttgaacccagacgaagatatccatgtcatcgtagccatcgacttccatgtacagtttggctttcggatacccaacaaactgggtatctttatcaaacgtcttcatgaatgacgcacggccaggcagaccaccggcttgatacttcacaggtaaatcggttgtctcaggttcggcctgcagcactcgagttttgccattgaagtaatagcgcttattctcactaccagctggcgggaaggattcggctggaatatcagtcttgtcatgaccctcaaagtcaattaatgaataacggactttaggcgtctccaaccagtcgttatccttacctaataagtaatggtcaaagaaccgacgaagttcctcgatattgtctttatcgtagtagtaaggccattcttgacgatcatggattcgcagccatttgtctttcgaacctaattcacgccatgctcggaaggtccccatggtgtgtaatgtactagagtaactagctaccacaaaggccggcattttgattttgcttggatcagcaactttgtcctgccagattggtgcgtctgccaatggataagcgtccatttccttgatccagtcctcacgcttcgctcctgtggcactaacgtggttaaccgctagtcgttcaataaagttcttatcaggaataccaccaatgaaagctaagtcacgataaccatctgataacccttcagttggattgatacaagttaaatgaggtgacatctctgcagcaatataccattgtgagaaagtcaggtaagacgttccggtcaaagcagttttgccgtttgaccatgactgagaagctaaccattcgatcaaatcatagccatcttctgcttcctgagagccaatcatggtcgtattcccttcactgtgggcaataccacgcatatctgggttgcagactgcgtaaccatgagcaacccagtaatctggatctggcgcttcaaacttggttaaaccagagttccactggttacccatacccagcatgttaaataaattcttgtatcgcggtgcagtaccagcgctctttccataagggctccaagcaattaacgttggaaacttgtcatcggttgttggcatataaatatcagtataaatcgtcacaccgtcacgaagcttcacggggacgtcttttagcatcttaatatcacctgaaagtggtttaaatccatcggcgatttgctgacccttcttgaggatcacttctttcgtttcaaatggactaagaacaccatgttcaacaccattatcgatgtaatcaaaagcgggactaaatttcatgtcttcagtaatctttacggtcatttgtattacctccaattgtctaagcttattcgtttaagcaacttgagtatacgggaagcatagacgggatgtacaattgcaaatttggatacttatgaaggaaatacgtctgttatttagtttatgaataacactcgtgaaactttggatccttatgtataacaaaaaaggttgtgtcataagtcgatattggcaagcatttcaatcaatttttcagcaaaaattagtgatgcctgtcctttggttcaatgcgtcaatatagcctaatcatgcgcccaaactcagattcctgccatttaacgcaaataatgcctaccccgcacaaatcgcggaataggcattatttacattaaattctggaatctaccaagttttgtcacacactcttggctaactatctctttaaatgataactataagttgaaacaatgatattttgacgtgtatttaaagccgaccgcagtctcaacgccgtttggttatgcaaaacattctgccatggccgtcgtggtacgaattgaggaacgagcaccgtagtggtgaagttccgttccgctgcccgcttggcgatcacatcacagaatcgcaaagtgggtgtgatgattgaccggtaagaagaatgaatatcaacaaatcggacatcagggaactcaactttaaacttctgagcagttttgtgttccttacgcggattctcgtcaaatgacacatgcatcgcaatgacgtaatcaccaaccgaacgggcataatcaatcgcatgagccgttacctgcgtcacatcactcacaaggacgatcacggttgcaccatcatagtgatgattgaccgtatcgctgttttcgctaatccgtaactgccgtgcaacgttcatgtaatgccgatggattcggtagaacatataaatcagtgcgggcatgacgattaaatatggccatacattaccaaagtgaagtaggaacaagcaaattaccagtgacaatgaaatgaacgcaccaaggaagttaatgcaggcctttaatccccatttaccttcacgaactctaaaccagtgacggatcataccagattgagacaaggtaaacggtacaaacaccccaacagcatacagtggaatcaatagactcgtcttaccatggaagataatgatcaagaagattgcccctaccgcaagggaaatgatcccatttgaataccctaaccgatcaccacgatccaagtaagcatgtggcaggaacttatccttagctaggttataagccaaaattgggaaggctgaaaaaccggtattagcagcgacagccaaaatagcagccgttgcaagttgtagtaggtaataaatcaagccgtgcccaaaaacagcttggccaatttgtgacagaacagtattatcggccattggcttgatgccaaggtagtaacttaagaacgtaataccaccaaagaagaaggccaatatcgacgccataatagctaatgttgcactggcattatgactcttaggcttacggaagttaggtaccgcgttactaatcgcttcaacccctgtcagagaggaagaaccgcttgaaaacgcccggaagaacaacactagtgtcatcccttggacaggcgccccaacggccgcagaagcgtgatatgcaacgtgtccggtgacaatctcaaagataccccagccaatcattacgaaaatcatgagaatgaagaaataaacgggtaaggtcagcatcgaagctgattcacgcattcctctaagattgagccccatgatcagcaaaactaaaataattgaaataccgacttgatgagcgctaatagcgggtatcgcagaaataatagcgtcagtaccagaagtaacagaaaccgccacggtcagcatataatcaactaacagtgatccaccagcaactaacccagctggttgtccccagttagttgttgcaacaacgtatgcacccccaccggatgggtaagcgtgaataatctgttggtatgacaacgtgattgcgaatagtaaaaccaaaaccaaggcagcgacccaaagttgatacatcaatgctgctgctgaaagtgtgattaaaaccgttgtaatttgttcagtcccatatgcgactgaagataacgcatcagaagaaagtagtgccagtgccttaaacttggttaaggcctgtccaccctcgtccgttgtcttcaacggtttaccaatgagtaaccgtttcaaataacgccacatgatttttactcctttatcgacgaataacagctatcaatcacaacctcatagtgactgatagctactttcgaaaattaatatctaaaatgaatggatgccgcaaatgggtatgcaaaatcaataggtattgtacaacaaactatcagatgaaagcaagctgatatcgggcaatctaaaaaggttcacgaacaatctctagtgtactagtttttcgaaccaattactggtttatttgaaactaaagaagcatccgcaattttcatcaattgcggatgcttctttagtttcagttagtaatagtaatcactagccgttaagccaagtttacatcataccgcccatacctggttgagcaggtgcagctggagcagcagaatcatcctttggttcatcggcaacgacagcttcagtagttaacagcaatgctgaaactgatgcagcgttttgaagtgctgaacgagtaactttggttgggtcaacaataccggcatctaccatgttttcgtatttgtcagtagcagcgttgtaaccttcgccaggcttcaatgtcttcatgtgttcaacgattacagagccttcaacaccggcattctcagcgatttgacgaactggttcttccaaagcacgacgaacgatagcaacaccggttgcttcatcgccttccgtatccttttcaaccttttcaacttctggaatcacgttgatcaaggcagtaccaccaccggaaacgaagccttcctcaacggcagcacgagtagcgttcaaagcatcttcgatacggtacttacgttctttcaattcggtttcagttgcagcacccacacggataacagcaacaccgccggccatcttagccaaacgttcctttaacttatcacggtcaaagtctgaggtagtcgcatcgatttgagtcttgatttctgcgacacgttcttggatttgttccttggcaccagcaccttcaacaatggttgtgtcgtcttttgtgacgttaaccttgttagcttgaccaagttgttcaagcgtagcatccttcaagttcaagcctaaatcatcggtaataacagtaccaccggtcaatacggcaatatcttgaagttgagccttacgacggtcaccaaaaccaggagccttaacagcaacaacgttgaaggtcccacgcatcttgttcaaaacaagtgttggtaatgcttcaccagtaatatcatcagcgatgatcaacaatgaacggctttgttcaacaaccgattgcagcaatggtaagatatcttggatgttagaaatcttcttatcagtgatcaagatgtatgggttgtccaagttagcttccatcttgtcgttatcagtaaccatgtattgtgacatgtagccacgatcaaactgcatcccttcaacaacgtctaggctggtatcaacaccacgggattcttcaatcgtaataacgccgtcgttaccaaccttttccattgcgtcagcaattaaatcaccgacttgttggtcagctgaagaaatagaagcgatttgagcaatatcactcttagtggcaaccttgtggctcatctcatgtaaagccttaacagcggcgtcagtagctttttcaataccgcgacggataccaactgggttagcaccggcagtcacgttcttcataccttcgttaacgattgcttgagtcaaaacagttgcagtggtggtaccatcaccagcgatgtcgttagtctttgaagcaacttcagcaactaacttggcaccaaggttctcaaagtggtctgacaattcaatggcctttgcaatggtaaccccatcgttagtaatcgttgggttaccgtatgattgttccaaaaccacgttacgacccttggggccaatcgttgttttaactgtatctgctaatttatcaacaccggcaagcattgctgaccgagcgtcttcagaaaacttaagttctttagccatagtttttcttcacctcataaaataatttagtttgaaaattttagtccagttgattcttaattagtcgacaattgcgactaagtccttttcatggacaacgagatatgagtcgccgttatacttaacttcagtacctgcgtatttatcaaataagacagtgtcgccttctttaacacttggcgcaaccttttcaccattgtcaagcacacggccactacctacagcaataaccttgccagtttgtggcttttcctgagcattacttgctagtacaattccaccaacagtttgttcttcttcttcttgtgcttgtaaaattacacggtctcctaatggttttaacacttgaatccctccaataaatataaagtttagcactattagcactcatctaacataagtgctaatcacaattaatactataaaattattcccacccaaatgcaagagatttacccaaaaaaagcacgatttactaaatcttttacaatgtgctggactccttactgaaagtaaaagtggctcaactaccagcacatcagctgataattaagccacttcatgtcattaagtgttaaattacttatctgtgaaaacagcagtttactattcaccacatttgcagaaaactactcttcttcattataatgatctaaaaagtagatcagtgtttgcagttcattagttaaatcaacgttttgaacccgcacattggttggtacagatactcgtagcggtgtgaagttaagaatcccgcggacgccacccgcaatggcatcatccgtaacgttttgagcaactgattcagggaccgtcaaaatcacaatcttgatttgctgatcttctagttgcttacgcagttctgacatgggatagatgggtacaccgctctgaacagtgtttgcgaggtctggacgaacatcaaacgctgcgctgatccgcacattactgttctgatgaaagttaaagtttaacagtgcgttccctaagttacccacaccaataagggctgcgttagtcagcttgtcctgatttaaaatcttcttgaagaactttaacaaactgtcaacatcgtacccatatcctcgttttccaagcgcaccaaagtacgaaaagtcacgacgaatcgtggctgaatcaaccttaacggcctctgaaagttctgttgatgatacccgatttttatcagaatcatgcaaaatattcagatagcgatagtaaatcggtaatcgttttgcagtggctttcggaatctttgtttctgccaatttcttttcctccttgtgaatttacctgattaaaaataccttagaaaacgaatcttttaatcatcaaaataattgcgaatttctaaaataaataagtttgtgaaaacatcattctagttaattgtagcatattgggacgatttgtgaaataattttcaataaaaaatccatgaacattttatcaaacctatcagaatctcactaattaatggtagaatagtttcacaatagaaaggcagctgatacgacatgttattacaggtccagcaagtaacacgccggttcggcgcggatactctttttgataatgtcaacctagatgtacctgaacacggtcgggtagcactcgttggccgaaacggtgctggtaagtcaactctggtccgcatgattacgggcattgacgctccagatgagggacagatcatctataaaaaaggcatgaccattgggtatttagcccaagataccggccttgattctaataaatcaatctgggaagaaatggccagcgtcttccaagaacttcaggatcaggaagaagaattacaccgtttggaagaacggatgagcgacccagacgtgatcaatgataaagaacaatttgaacagctttcaaaaacttatgatcaacgacaaacctccttcaaaaacaataatggttatggttatcgtgccgagattcgtggtgttttacacggttttgaattcggtgaagaagattatggccgctcgatcaacgaattgtctggcggacaaaaaacacaactagcattagctaaattactactggaaaaacgcgacctgttagttttggatgaacctactaaccacttggatgttgagactttaacttggcttgaaggctacattcaatcttataaaggtgcgttactgattgtgtcgcatgaccgttattttttggaccgcttagtaaccgaggtctacgaaatgtctatgggaactgtcacgcactttcacggtaactactcagcctacgtcacacaaaaagcagcgcagttgcagcggcaatggaaagaatacgacaaacagcaacataagatatctcaactagaagattttgttaaccgtaatattgtgagagcttcaacaaccaaacgcgcacaagctagacgtaagcaacttcagaaaatagatcgtatacaacggccagaagctgatgacaaggtggctcactttgcgttcacccctcgtcgtcaaagcggcaacatcattttgactgtaaaggatctggcagtgggttatgatcctagtaagatattggcccaaccagttaatattgacattaaaaagcaccaagcaattgccattgtcggccctaatggggttggtaaatcaactcttctcaaaaccattttgggaaaaattcctgcattagctggcagtgtgacctttggaactggtgtcgatactggttactacgatcaagagcaaaaatcgttacacggcaataaaaccgttctagctgagctttgggacgaccaccctaccacaccggaaaaagatattcgcacgattctcggcagtttcttatttaccggagaagatgtggataagttagttcatagtcttagcggtggcgaaaaagcacggctactgttaacaaaactagcaatgaagcacgacaactttctgattttggatgaacctaccaaccacttggacattgatagccgtcaagtgcttgaaaacacactgaacgactttgatggcacgattttgtttgtttcccatgaccgttactttattaaccaagtggcaacttcagttgttgaactgtcagccaagggctctgaacttttccttggggactacgattactttatcgaaaagaaacaagaacaagctgccgttgcagaaaaaaagcaagaagaggctctggaaaaagatcccagtcttgcagttaaacctgttagtcaaaaaaagcaaagttatcaacagtcaaaagaacgtcaaaaacaagaacgaaagttagcgcgtcaagttgagacgctagaacagcagcttaacgacctcaccgagaaaaaaagccaggtggaaaccacaatgactcagccagaaattttttctgaccaagccaaaatggcagacctgcaaaaacagctcgaagagattactaagcaaatagaagcaaccgaaaatgattgggaagaagcttctctaaccttagaagacttatctgattaacctctagaaacactaaaaaacagatttccgaaaatgggaaatctgttttttagtgtttctagagttaatactgttatgaagccatccaatcaaactctagactaggatcagcatttaaagtcatatcaccaaactgttttagttgataactaacatagcccgctgctccaatcatcgctgcgttatccccacaaagtttaaggggtgctttgataaaatcaacgttttcaaatgcttctagttctgaatctaaccgctcacgcagcccttgattagcagcaacgccacccgctaaaatcaattgttttactgaataggcatcaagtgcccgaacggttttatccgctaaaacatccactactgcttgttggaaactagctgctaaatcttcccgctttagcgtttcaccaatttgatccgcatggtgaaccgtattgataaaggcactcttcaaaccgctaaaactaaagtcaaacgattcggagtcatccattgcccgcggaaagttaaacgtatccttacctaaatgagcgaggcggtctacttccttacctgccggatagttgatgcctagtacccgaccaattttatcataagcttcgccagctgcatcatcgcgtgtttcaccaataatttcaaactgtcctggtccagctaaatatactaattcagtatgaccacctgatactaacagcgctaatgcaggaaattcaattggcttgacataacgagcagcataaatatgaccagccatatgattgactggaatcaacggcaaatcatgggcataagccactgttttagctgcagtaacaccgattaacaatgcaccaactaaacctggaccatacgtcacggcaactgctgacaaatcatcataagtcactgaagcttccgacatcgctaaatcaatgcagtccgtaatttgctcgatatgatgccgactagcaacttcgggaaccacaccgccaaaccgctggtgacttttaatttgagtagcaacgatattagaaagaattttttcaccattttcaatcaccgctacactggtttcatcacaacttgactcaaaagccaagattaaattacgttccacgtttaattcgctccctttgtgcctctctttatacgctgagtttcattaaaattgcgtcctcatccggatgggtgtagtacgctttacgcacattaatggcggtaaaaccgacccgttgataaaggtgcctagcagctaaattggattttctgacttccagaaatacctgcgtattagcttctaaggacgtgatcaaacgactaatcattttaaacgcccagccctttcgctggtaagccggatccactgccacaccggtaatatcaacctgatccaatactttaacggcgccaacgtagcccaccagctgattgccattgtaaatcacggtatagacccgatgtgctgctcccatatcggcctggaaatcttttagtgtccagcccgttccgcttgaataagctcgtgtcgcaattcgtgcgcaagctttaaccaagggtattagttctgcttcggttgccatttggactctaagattctgcattttcagaatctccaatagtaatcaccatgtctactgcatcctcgtggtcgccgaaatagtaaccccttttgataccagatttttcgaagcctaaatcctgatataacgcctgtgcgcgcacattacttagccgaacttcaagagaaacttgtttgagttctaactgacgcgcttttttaatcatcacagcaattaaaaaatgaccaaggccacggttttgatagtctggtaccacggcaatattagtaatatgtgcatcgcttttaacatcgttaaacgtacagccaatgaaagctaacaagcgatcatggcgccgcaaaacaaggtataaacggtccgtatcatgacgcaattcactggcaaacgccgcagaatcccacggcgttttccctccataaaccgcccgttcgatgccaagcatttcgggaatatcagtaaattgtgccttagctaaaaaatacgcaacattttggatatgaacttcatggtttttgatgtccaaaacatcctgatatttggtatctcgaatttgaaacaattgctgataccaatccttaaactttctcaacataatcgctactatcctcttctgggtgttgtttctgccagtcagcctcagccttggtcaaacgcagatagcgtggcacaaaaccattgacatcacttacaggtgcttgtcgttgaccaagccggcctaactgcaccgcacttggaaggcttaactctagcggataatgaatataatttgcttcaagcgctgttttcaaccgctccgtaaatgcatcaaggtcgcctaacaccacaaccggttcagccaatgccttcagctggggtaataatttttcaaatggaatatgctgatcttcaatgacggataccggtgtcccgttttgaatccgataaacgccagcaaagacgttatcattacggccatcaaataaaaccgcaaccaactgggtctcgtttacaatgttagccgcaatcgttgctaaactagaaatgccaaccagttcaatctttaatgtatcagctagcgttttggccgttgtgacaccgatcctcagtccagtgtacgaaccaggaccatccgcaacaacaactcgattcagctccgctggcttcagcttagctgtttgcatcaaattctgaataataggtaacaaatgtgcgccatgttttttggtcgtcgtcactgtcgttgttgctagaacctgatcatctgacatcaccgcgacactgagtgtttgattagacgtatctaacgccaatactttcatatcgttttcatacccctttttcctgattcttcagccatcatcatacacctaagcccaattatctgacaactaagcttgagctgaatgattaatgataggttcccagtgacattctgcttcagtagccacgtcaccattttccatagtaatccggtgcttagtcacaatggaatcagggatatcggtcattaaggtcgcttcactagtgacgatatgatgatactgaacctcattttcaaaacgaatattgatactggttaaattatggcgcgtgagaaaactcattggtagcgcatctaataaccaatcaaaataacgtgagttgttaacatgaccattgccatcaatatcaaaatagcgtacccgatattgtttcgtcattaattgatctgcttcagtcagcttttttggtcgagacagacggggaatcattttaactttttcagagtgggatggtgcaataatgcgctccggaatcgtaacgattttacgcgtttcatggttcatcgtgacccaaatactctcgacgtggacacattcgcgaccttcactgtcatgaacccaaaattctcggaatgcaaaataacggttataacaggtagcttgggttgatacttcgatagtttctccctgttttggtaaacgggtaatgtccatcttatattgagtaacaacccaaccaatgccgaggtcagcgactgcctttgcaccgacgcctaatgaatccgtttggtcttctgaagccaaaataatcatattaactagcatggctggtgttacggtattcgtaacatctgtttcgtagaaagtaatttgatgcttttctgaaaaaattttcgcgcccattcggttttcctctaattctatttaattctggttaagatgatgataaatctgataaacttcctgtttctttagttgacgcaaatgagctacctgtttgatagcgtcatttggtcttaatcctgtttcaatgagatgatcaacgtgatcttcaatacttagtccgctataatcgggctcctcgtcatcttggtctccttttgaactgccgctaacgatcacaacaaattcgccacgtactcggtctgattcattcgcccactctaaaagttcggccaaagatcctcgtaaaaattgctcgtgttttttggtcagttctcgacaaagagaagcttggcgatcaccaccgtaaacatcaactaaatgttgaagtgttttcgctaaccggtgaggcgcttcataaaaaatttgactctccgaacgatccttgagtttctctaattctgcaacctgaagtttgggtttacggtctaaaaaaccgtaaaaataaaacggctgtgggtcaagaccagaagcaatcaaagctgtgagtcctgcattagcaccgggcaatggcactactggaatatcgacttcgatacaggcaacgactaattcgtgtccaggatcgctaattgatggcattcctgcatcactgacttgagcaaggttttctcccgcttgcagtttggcaatcaattgtggaatacgctcttgagtattatgttcatgaaaactaatttgcggtgtttcaatttcaaagtgattcagtaacttttgcgtatttctggtatcttctgccgcaatcaaatcgacttgttttaacacctcgacactacgaaaagtcatatcacctaaattaccaattggggtcggtactaaataaagtgtgcccgtttgattctgttttgaaaagcttaattgcgattgcacgctgatcctcctaattaccgttcaccgtagataacatctaaacaaaaagcacagggttcatcgttttcccgtcgcttaccatactcaaagttgcagacgtgaaacccttcttcatacagtttttctaaatttttacgcgacttcgacagcggtggctcagtattattgccactaataccctcattgcgatcagaacgcaaaacttcgcgtagatgctgattttcaatttccagttcagcattctgttccaatgtttgggttacttcgtcttgaacctgttcaaatttcgagatcattttcaccatttcggcctgtaagtctttcaactcttcataaacatcccgctttgccaagattgcacctctttaattattcattatgtaatgaatgctccactatgagaacatccgtaaccgctaaacatgttgctttatatcagctaaaatccgcaacgtcaaggtttctaagatactctgaatattcatatttcccgcaagtgcctttttagtgtccagcacagccgttaaaatctggagtaattgttcccgagtcaaagcctgagccatttctaacatggttgtttgaagttccggaaatgctgactgtgtttcatccgacagatactttgcttgcaacgtgctttgccaaagtaacacaatggcatctaaaatcacggcttgatggtcccggtcatgagctaacggcatcaaacccgtctgaaccgttacaaacgccatatcgtcatgttttgcaagttggttaaaccaacgactgagttcatgctgacatttagccagccaatcatcggccactaattcatcagctgcatccatactatttgtcagcccacttaataacggaatctgattctcggaaatctggtgctgccgcaaactttcagcaaacgcttttgatgatagcggtgggaattcaacgatttgagttcgagataaaatagttgctaacatcatgcttttattggtagtcaataaaaaaatgacccggttggcaacgggttcctcaatgaattttaatagtccgttagctgcattagtcgtcagcgtttcggccccttcaataatgaataccttagtcgacccttcaacaggactcttagcgaactcgtccttaatgtaacggacctgatcaaccttaattcgctgcccatcaggttccaccgtgaccacgtcaggattatcgccagctaaaattcgcccacattctggacattgaccacaaggcataccatccgcattcggattttgacaaaagagccgcatagcaacaacttgcgcaactgctcgcttaccacaacctggcaagccagagaataggtaggcatggctaagtcggttaatcagcacaaggtgaataaagtgctgcattaactgtgactgtttgctttcagcttgttcaattaaagtttgttctgccaagacctactcctccactaagttaaaattgatgaaattgttcaattggtaagacgaagacggtcgcaccgcccacctgaacttcaactggataacccgacgtactttccatctgggcatcaatattgacgggtggtgtcatgaattgctgccgggttcgggaagtttcatgaatcaaatcaagcacttcttgaacacgcttatcttcaataccaatcatataagtcgtgttaccggactttaagaaaccaccagttgttgataatcgtgttacgccaatgtcagctttaacaaattcactgcgcaaacggttagcatctttatcctgcacgatggcaatcactaatttcatacttgacccttctttctaccaatttatcgttgctgcattctatccgtaatcagcgtcatggcttgactgatcacgtcagccaccggttgtgtggcgtctacggtaataattcgttcgggaaacttctttgctagtctgagatatgctgcacggacacgtttatgaaagctcagcgcctctgcatccaatcgatcaacattctgccgatgcgctttaatccgtgccaacccaacttcagagggaacatcgacgtaaatagttaaatcaggtgttaaaccttcagttgcaaactgattcatttgataaacggcttcttcaccaatttgccgacccgcgccctgataggcaactgagctatcaacaaaccggtcacataaaacaactttgcctgccgctaaagcggggcgaatcgtttcttgaataagctgacgtcgtgaagccgcgtacagtaaagcctcagttcgcacatccatttgtgtattttgtgggtctaaaatgatttttcgaatggcttccgaaatttgattaccgcctggttcacgggtaaccagaatgtcagtcctgtttgctgtatcaagctgctctgcaatcgcacttaagacggttgtttttccagcgccatcaggtccttcaaatgaaataaataatcctgccaaatcggttacctcgcttacaattaatgatggtggctaataaatttaaagccaccttttatgatgtacgacacttgcaattgtacttgattaagactacggaatcaagcgcttggcaaggcctgaacggtttcttaaatgactagcaaaagtcgcaatatttagagagtgtgacacaactcggtagattctagaatttaacgcaaacaaagcgccatcccgacaaatcttcgggacagcgcttgttgatgttaaattctggaatctattgaactgattcacaatctatttgatttaatgatcaaaaacagacgcttgaatatggtcgccgcgcacgttgcgcaaccgcgcttcacggtataaaaagaggtacttttgccgagctaatgctgtttgcgctgtaatctcttcatctacatccgcgatggctatttcagtttgcttagcctgatcccattcttctttagcacgctcaatcgttgctaataacttttcatcaaactgatatctaatgtgttgcttgcgcacaccaaacacgttgtcacttccttacatttcggttcggccttcaactgccttatataatgtcatttcatcggcgtattcaatgtctgatccaactgaaagcccatgggcgagccgtgtcactttgataccagctggtttgatcagccgtgaaagatacattgccgttgcctcaccttctggcgtagcattagtcgccacgatcacttctttaacgctcttattggtttgcaagcgtttcagtagactagacatattcaaatcttctggacccttaccttcgattggagataaaaccccgtttaaaacgtgatataggccgtgatattccttcatcttttccatggtcatgatatctttagcttgctctacgactaagatttgactctggtcgcgggacttatcccgacaaatatcacacggatcgttttcagttatattaccgcagatcgaacaaaaatgcagatctcgcttagccgaaattaacgacttagcaaagcgggtcacgtcatcattgtccatatcaatggtataaaacgccaatcgcgtggccgttttttgcccaatacctggcagcttcatataactatcaattagttgtgcaattggttctggatattgcatgactgccattcactcctttaactcaattacataccgggcatgttgttcgtatacttgcctaaggtttgcttaccatcttcatcgatttgttttagtgctgagttaactgcggctaagattaaatcactcagcatatctgggtcatcaggatcaatcgctttggaatcaattgacaaatcggtcatttcacgtttgccagtgaaagttgctttcaccatttcgtcaggtgaaacacccacgtacgtcttggcttccatcgccttttgttcctcggcgagctgtttttccatctttttcatttgtttcatcatgttgcccatattacgatttccacgcatcatagttcgttaccatcctctatagttattattaatctgatttaacatcaatgacatcatcgccaaaaagttccttggccttatccaccacgggttcggcttttgttggggatgactcgtccttggattgaccgtcatcctgagcagtactttcgggttcttgaccattttgattgcctacctgatgctgttccaaataagttttacgaatttctggccactggtcagtagggacaaacactaatttaggtaccttatgtgttaaccgatctaacccattttccaacgcatcatttaactcttgatctgcgttggcgcgctgctgaagaaacgcataatcaaacgcaatgattgcaccatcaggactggcagccactggcttggaaacccccataatcgagcgttgcggtatcgacaaaatattcatcaaatcgggccagacttcttgtagtgctgacaggtcctgtcgggttgccgcacctaaaatcgggtaaactaggctaaggttaacctgagtacgttttggtttgacagtcttcatagcagcaggtcgcttttgaaccgtttttacggttgcgggcgctttttgtaaatcagctaccgtctttttaagactgcttacctcggcctctaaccggtcaattgccgtattatcgactggagcagacgatactgtctgagtgccctggttttgatgacctgctaagcgtaccgttaatacttccaggtaaacgtcttcgtgagtcgtaaaccgcatttgctgttgaatatcatttaaatcatcaataatatcatataactgctgtggttttatttccgttgccagttgtttaaaatccgaatctacctgatccatttcgatctgagttaccaattctggagattgctgataaagcaacaagtctcgggtcaaattcaccagatcttctgtaaatcgttcaggatctttgccttcgtctaaaatctcttgaatggtcatcagcgctttttgagtttcctgatgagtcacctgggtaagataggtaactaatagctgtttacgtaccgcacccgtgaccagcagtgcattatccagtgtgactttgtcatcaccaaacgaaatgacctgatccaaaatactgagtgcatcacgcatcccaccttcagaagctttcgcaattacctttagtgcttcatcatcataggaaaggtttttttctttcagaatataggccattcgtgaaagactgtccttagcttgaatttgcttaaaatcaaatcgttgggttcgcgaaataatcgtggctggaatcttatgcggttccgtcgtggcaagaataaaaatcacgttcgccggtggttcctccaacgttttcaataacgcattgaaggctcccgttgacagcatatgaacttcatcaatgatatagactttatagtcggcctcagtgggcgcatacttaactttatcacgaatgtcacgaatctcttcaacaccattgttagaagcagcatcaatctcaatcacgtcattcagtgtgcccttagtaattgccttacaggtctcacattgattacaaggttcaccatcttcttgatgctgacaatttactgccttagcgaagattttagccatcgaggtttttcccgttccccgtggtccagcaaacagataggcatgactaatttgtttagttttaacggcgtttttcaaagtttgggtaatcagtgtctgcccaatcacttcatcaaaccgctgtggccgccacacccggtacaaggcttggtaactcatgactattttcctcgattcttttgggttatctcttaagactcactgataaacattatatagtgtttattcaccaaatactatacatacaaaccgttaaaaattgtataagaagaggacggtaacaaaactcaacgttttgtcccgccctcattaagatcatatcaacttggagcacaaagtcactcatacttagtgctgcttccttccggacctgacacgattcgtaaggtcacccttgccccaaggccttgcggcaacttctactttaacatatttaaaatctgaatgccacccaaaatctggttataatcacagtttatcgatttggtgctgtttctttagtttattgcgctttcgagcagctttaaaaaaatctttcaataccttgcctgcctgggtcgctaaaacgccttctttaacttcaacttggtggtttaatcggggatcattcagcagactatatagtgttgccactgcgccagctttcggatcacgagcgccaaaaacaacgcgatcaatacgtgaattaatgattgcaccgctacacatgatgcatggttccaatgtaacgtacatggtacagtcaaccaatcgccagctatgcagtttctggttggcttcacagatagccataacttcggcatgatcagctgccaactgactgtgttcccgtaaattatggcctctgccaataatttcattattatgaacaatcaccgctcctatgggaacttcaccaattaaagccgatttatgcgcctctaatagtgcttcttgcatgtaacgctcatcattttctatcatgcacgtctacctttcttcaacgacaatctctaatccccaaaaatattttttactgactaaaagtaactgtaattgccgtagttacaccatatttagtgtttaccctttttaacgtacacaaaatataggcctcgacggttgaaattttagctgaacggtgtaaactctatttatcgagattacataggagtgtggttcatatggcaaaagtaacggtttattcacggaacaattgtatgcaatgcaaaatgactaagcgttttttaactgaacatcacgttgattttattgaacacaatattaacgacgatccgcagtacgttgattatctcaaggaccagggttttcaatccctacccgtcattgaaaccgctgataccaagtttagcggctttcgaccagatcaattacaaaagctggccatttaatgtacgcaagcgttaggatggcgtattctggataccagaaaacgccatcttttattttacttaatttagccctaagagaaaagagtgagtttaaaaaatgagtttaaaagagcttaaagatgtcacgtattacgatctcaacaatgagattaatattccggtaaacggtcaaattccactaaacaaagatcaagaagcactgcaagcatttttaacacaaaacgttgaaccaaacaccaaaaaatttgcttcgttgcaagaccgcttcacttacttactggacaacaattacattgaatctagcttctataataagtacaactttgattttattcaatcattatacgactatttaaaatctcaaaatttccacttcaaatcatttatggctgcttataaattttacgctcagtacgccctgaggactaacgataacgactattatttggaaaactatcttgatcgagtagccttaaacgcgttgtatttcgctgatggcgatgagcggttggctatggacttagctgatgaaatgatccaccagcgttatcaacccgctactcctagttttctaaatgctggccgtaaacagcgtggtgaattagtttcttgtttcttaatccaaaccaccgacgatatgaacaccatcggccgtactattaattcagccctacaattatccagaattgggggcggcgttggaattaatttatctaatttacgtggcgccggcgaccccattaaaaacattgaaggtgcggccagtggtgtcgttcctgtcatgaaattgttggaagacagtttttcatattccaatcagttgggccagcgacaaggtgccggcgtcgtttatcttagcgtctttcaccctgacattatcgcatttctttcggctaaaaaagaaaacgcagatgaaaaaattcggcttaaaacactttcgttaggtattactgtccctgacaagttttacgaactttgtcgcgataaccaggatatgtacctcttcagcccctatgacgttgaacgcgaatacggcgtacctttcagttacgttgatattaccaaagaatacgacaagatggtcgctaacgatttgatccgtaagaagaaactgcctgcccgtgaactagaaactgaaattggcaagctacagcaagagtctggttatccctacattattaatattgatacggctaaccgggataatcctattgatggccgcatcgttatgagcaacctctgttctgagattcttcaggttcaaactccttcaacggtcgataatactcagacttacgaacaactaggccgtgatatttcatgcaatttaggttcaaccaacatcgttaatttaatggccagtcctgacttcggccactcagttgaaacaatggtccgagcactcactttcattactgatcattctgacattgacgttgtcccttctatccaaaacggtaataagctcgctcatactattggtcttggtggcatgggacttcatagtttctttgccaaaaaccaaatgatgtatggcgaccccgaaaccgtagagttcaccaatatctacttcatgctgcttaattactggaccctagttgcctctaatcagattgccaaggaacgtcacacgactttctacaactttgaaaagagcgcctatgcagatggcagctactttgataaatacactacccaaaagggcgaattcacgccacaatctgataaagttaaggccctcttcaaggacattttcatcccatcggcagctgattgggataagcttaaacaagctgtcatgaaggatggtttgtatcaccaaaaccgtttagccgttgctccgaatggctcaatttcttacattaatgatacaactgccagtttgcatcctatcattaaccggattgaagaacgtcaagaaaagaagattggtaatatctactaccctgctccttatctgtccaacgaaacgttgccttattataaatccgcctacgatactgatatgcgaaaagtcattgacgtttatgcggctgctcagcaacacgtcgatcaaggtatgagcatgactcttttcatgcgttcaaccattccagaagggctgtatgaatggaaaaacggtcgaaccaataagatgaccacacgtgatctcagcatcttacgtaattacgcccacaaaaaggggctcaaatcgatttactatgtccggacgtttacggacgatgaaggtgaaatcggtgctaatcaatgtgaaagctgtgttatttaaagaaccctgttcatgacaatcgttgcaaatagacgttaaaggagaaacaaatgacagaagcatatcatgcaataaactggaatgcagtggatgatcaaattgataaagcaacttgggaaaaattaacagaacagttttggctagacacccgaatcccgctttcaaatgacttagatgattggcgtggattggatgacaagcataaatgggtcgttggacacgtctttggcggactgacccttctagatactctgcagtcacaagatggaatggcgtccctcagaaaagacactcagacccaacatgaaatggctgttttgaacaacatccaattcatggaatccgtccatgccaaaagttattcatcaatctttacaaccttaaatacgccagatgaaatcgatgagatttttaactggagtgataccgaagaatttttgcaaaataaggcattacgcattcgcgacttgtatcacgatgatggccacccattgaagaaaaagattgctaacgttttcttggaaactttcctcttctactctggcttcttcaccccgctttactatcttggtcataataaattagctaacgtggcagaaattatcaagctcattctccgtgacgaatctgtgcatggcacttatattggttataaattccaaattggctacaatcaattaggcgagaacgaacagcaagaattgaaagactggatgtttaactttttgtacgaactgtacgagaatgaagagaaatacacccacctagtctatgatcaagtcggctggactgatcaagttttgacgtttatccgctataacgccaacaaagcgttgatgaatcttggtcaagatccgctgttcccagataccgctgatgatgtgaatcccatcgtgatgaacggtatttcaaccaccactgctaaccatgatttcttctctcaggttggaaacgggtatctcttaggaaacgtggaagcgatgcaggatgacgattacgatatttaacttctaaaattttatctttaaaaacaagctgcgactaaacttggtagatgccagaatttaacgtgaataatgcctattccgcgatttttacggagtaggcattattttgcggtaaatggccggaacctgagttttagcgcataattagggtcacatattgacgtacagaactaaaggacagtgatcactatttatggctaataattgattgaaatatttatcaataccgacttatggcacagcctctgttttttgaacaattatatcagttaaacactactccccccaaaaccactcgcttagctaacttaacgttacttctgggtaaattgattgcatcttatacaacatccattaccagtcaaatctgaaggtttgccgacttcgcctagagaatacaaaaaagcactgtgcaaaattgcacagtgcttttttaacgggtaccttaaattacttaagggtaaccacgccaccaacttcttcaagcttagctttaagatcgttagcttcgtcttctgtaacgccttccttgataactgaaggtacgttgtcaacaagacccttagcatcctttaaaccaagaccagtgatctcacggacagccttgatagccttaaccttttggtcacctgattcagttaattcaacatcgtatgaatccttagtagcaccagcatcggcaccgccagcagctacagcaacaggagcagcagctgaaacatcgaattcgtcttcgattgccttaacaaggtcgtttaaatctgagattgacgcttcctttaatgaagcgatgatagcatctttatcaaaagccatttttgtttcctccattttatattgaaatagtgagttgagttactgggttaggcagcttcgccttcacccttgtcagcgatagccttaaccgcacgcgcaattttacgcataggatcagacaatgcactagcaagcattgataacaagtcttcacgacttggcatcgtagcatattcgttgatttcatcaagagaagcaaccttaccttcaaccataccacccttaaggctcagggcatcatggctatcagcaaacttcttcaagattttagcaggtgcgattgcatcttcgtcagaaaaggcaacggcagtaggaccaacaaacgtgtcgtttaggtcttcgtagccagctttttcagcagcacgagtcaaaatcttgttcttgataacactcattgaaacaccagcttcacgtaattgcttacgtaagtcagtgacttcagcaaccgttaaaccacggtagtcaacgacgatagctgattgggcgtttttaaaacgttcagtcgcttcttcaactgccttagctttgattgcaacattttccttactcattagtttcacctcctgaattcttttaggaataaaaaatccctatgtccgccaggcatagagagaaatgcaaaactaaattcacatcttcctcggcaggtaaattaaggctttcgccacctgagtcttgggcagaacaaatatcaacttactaagcatacagaatgctagagtaaaagtcaacacgggattttctatttaattaaagggatgcaacatcaacattgacacttgggccaaaggttgatgagattgatacgtgttgtacgtaagtccctttaacagctgcaggacgggctgaaacaaccacgttcgcaattgtcttcaagttttcaactaacttgtcagcatcgaatgataccttaccaacaggaacagcaacgttaccgtcacggtcagtccggtaagtaaccttaccagccttagaatcgttaacagccttcgttacgtccatggtaacagtaccagtcttagggttaggcattaagcctttaggtccaaggacacgacctaaacgaccaacttgggccatcatatcaggtgttgcgattgcaacatcaaagtccaaccagccatcttggatcttggcaactaagtcgtcttcaccaacaaagtcggcaccagcggcttgagcttccttagccttgtcacccttagcaaatacgataacagtctgatctttaccagtaccgttaggcagaacaactgccccacggagctgttggtcagcttgcttagtatctacattaagcttaaatgcaatttcaaccgttgcatcaaacttagcaaaatcaatcttcttaactaaatcaacagcttcatcaagtgtgtagttcttttcagcttctacttgcttgacagcgtcttgatactttttacctcttttatgagccatcttgtgaattcctccttgcaaatgtggttataacggcttggcctcccacttgatacatttgctttaacaaagtatccgtagtgttagtagctgggattaaccttctacagtgaagcccatgctacgagcagtaccttcaaccatgcgcatagctgcttctacgtcagcagcgtttaggtcttgcattttggtctcagcgatttgcttaacctgatccttggttaccttagcaacctttttcgtgttaggttcgcctgaaccgtgttcaacaccggcggccttctttaacagaacggctgctggcggagtcttagttacgaaatcgaatgaacgatcttcgtaaaccgtaataacaactggaataatcatcccagcttgatcggcagtacgagcattaaaatccttcgtaaagcccatgatgttaattccggcttggcccaatgctggaccaactggtggagctggtgttgctttacccgcaggaatttgcaatttaacaatgttagctacttttttagccacgagacatacctccttgagtccgtgttgtggtaaatggagagcagatttctcctcccacacgtgtatgcagaacatactcatataaactaccacaattataacgacttgccaagtaattctttagattatttaggcaactggatcaacttgatcaaaattaagttcagcactggtttcacgaccgaacatattaatattaaccttaagcttgcccttttcatgatcgatctcggtaatcttaccttccattcctgaaaaggcaccatcaacgattttgaccgtatcatcaacgtctacatcaagatcttcatgccggctgctcatgccgagacgcttcaaaatgagttcaacttcatcaggaagcaatggcgttggctttgaaccttgaccatgagaaccgataaatccggtaacaccaggtgtgttacgtacaatgtaccaagcatcatccgtcatcaccatttcaaccaagacgtaacctgggaaggttttgtccatcttgatcttttctttaccgttttttacttcacgctcctcttcctcagggacaactacacgaaaaatgtagtcttgcattcccattgattgggcacgtgattccaaattcatctttactttattttcatagccagaataggtatgaaggacataccattgcttttcagctgattcaaccattttgttccatcctttcctaaagggactaatacagtcatttaatttaatcaaaataaaaaaactccgaccgcgcgaagttttcaacaaaacctattatagcatagattactgtctagtggcattaagccaagaactttaatcccatttgaaccagatagtcgacaattcctaaaaagatcgccatggacaaagcaacaaagatcacactgcttgtatcctttcgcgtctgtttagcatcgggccaagaaacctgcttcatttcgtctttaacagcaactaaaaatctaaaaaagcgcatgagctcctccttacaccgggtaacagcgcgttaccgggtctcccgatgtaacgtatgcttaccacaatacttacagtatttttttacttcaagtcgaaccttacgattaggactagccggaactgtgtagttccgagatccacagacagaacatgctaacgcaaccttcttttgagccacgttcaacacctccttatagcaagcttcatgatagcatcttcattaagtacgtgtcaagcaatgttagttttctaatcggcctgcttacgtcgtctaatttttcgtttaattcgctcattagcgttatgaaactgagtatgatcaagtccaaaacgttcacagattttttcttcagcttcacccgagagcaacgcaattaggactgctctttccatttttgacatgtcttttttcaccgtttctactagttgctgttgaaaaataactcgattttcggatgaaaacaaatgctcgtctgctaacgtttccgcaaaataggtgggattagcatcgatggaagtaactggaccagtagctttccgtttcttcgcgttgactcgtcgtgcataatcacgccgacgattaagtaaagccgccttaagataggacccaaatgcatgtgtccgagtgacatcaaagcggttcactacttcccagagcacgatcactgattcttgaaaccaatctgacagttctaattcctgtaaataataccggttctgaatgcttaaaatgagtggtttataacggtttatcagttcctgtaaagcacgttcgttaccgtcacgagccttttcaactagtacccaatctgcttcattttcgacgtgcattttgtttcctccattatgactagttcaccattggaaacaatataacaagaagcatcatgggtgcataccaaacagaaatcccaattgtacacaataaaaacaaccgattcttaattttcaactagaagtgtaatgacaccacatttcatagaactagtccaaaatataaatcggttgtttttaattatcatttttactgatcatctggatgatggtcatcacccagatgatcacgcaatttttctagttttgataactgaccatcgctccacggtgaacgccgaacttgccctttatcggcaaacttcactgcctgagtatgaacttctttgcgggttcgattaatgttagttagaagctcgcctgccggaatacgcaatgccccagctgaaaaaacagtccactgctcagcttgatcactcgttgcaacggtaacttgcgtaaaacgggtctgcttttcctttgttaatgcttcaatatattcatcagcagtctgatcctgccccgtccaaacgacctctaaaccatagtgatcgtattttttggacatccccggaacgtacatcgcatcaaataccacaatcatttcgattcgctggtatttatgatattccgataggatcgacagtaaattatcacgcgcttcttctagccgtcccgctaactttaaccggttcaaatctggccagttgccaatcatattataagcatcaacaattaaaatatcttttttcaataaattcacccaattcgtttaattcagtgggtgacgagaagaaaaggcttggtacatcaatagactagcggccacactggcgtttaagctctgtacatgaccaaccattgggatcgtcagcatctcatccaccgtttttttcaatagtggtgaaattcctttaccttcgttgccaatgataatgcctactggacctttggcgtcaaagtgacggtaatcagttccgtccatatccgtaccaaacacccagaggcctcgctccttcagttcttttacggtattcactaaattagtcacacgagcaactggtacgtgttcaattgcacccgtagaggttttcgcaaccacaccagtcaatccaactgagcgtcgtttgggaatgataatgccatgtgcacccactgcatcggctgttcgcatgattgaccctaaattatgtggatcattgatgttatccaaaatcaagaaaaatggctgttcgtccttctcctgcgctttcgcaaacaagtcatcaatactagcatacttaaaagccgaaacagccagcacgacaccctggtgattctcacgtggcgccaatcgttctaactttgactttggaaccatctgaatcaccaaagagcgctttttagctagtttgataatttcaccaatcagttcgttcttcaagccatcctgaatgaacaccttgttaatttcctgatcgctttttaaagcgttaatcgctggatgacgaccaaaaataaattcagaaggttcttccggagtctgttcgttatttttcatttggtaatctccctgcttcgacttgttcgatgcaccattgtgccatttcagctaaacgatccttctggtcactcaaagttaaatagccaaaaatagcttcgaacccagttgaaatacgatacgtcatcacgctggtgtttttagcatgcgtatagcttttagcgttgcgaccgcgtttgaagtaatacgcttcttcttccgtccaaaaatcgtcttcttccatcaacgtgatcaatccagcctgtgccttagcggaaacatacattgttgcagtatgttgtaacttattgggcttggttagtcccatttcaattaagtgccgtctgataaaaacttcataggcagcatcacccatgtaggctaacacaaccccatttaattgccggtaatcctgttgcgtttgttcgctcatgcgtttcctttctcatcgtctcggtgccagcgggtcccttgcggtgtatcctcaagaataatcccctgagccttcaactgttcacgaatctcgtcactgcgctcaaaattacggttcttgcgagcgtccaaccgttcattgatcagcgcctcgacaccgtcatcattaagcgtttcttgtttaaattcaattccaaaaatattcactaattcggttaaggttttcaaaatgaaagccaaactgtccttaaagacaaccgggcgttccgcataaacattacccaatttagcaagttcatagacctgagctatcccattttggacgttaaaatcatcgtccatctgatcaacaaaatccgcttcaatttggcgaatttcttgttcaatcttaggatcattacctggttcagcatccttgagccggtaattgagattattgaaagccgtttgcagccgcttcaagttgttagccgcatcatccagattaccttgagtatactgaattggccgacgatactgcgtggttgccataaagaaccgcaagacttgtggatttacggtcttcaagatatcgtgaaccgtcacaaaattgcctagtgacttactcattttctcgttgtcgtcgccaaccgtcacaaaaccgttatgtaaccagtaattagcaaatttttgcccggttttagcctcactctgcgcaatttcgttctcgtggtgcggaaaagttaaatcttgtccaccaccatgaatatcaaaggtatcacctaagtacttcgtcgacatcacagaacattcaatgtgccaaccaggccggcctttaccccatggtgagtcccaggagatttcccctggcttagcggctttccacagtgcaaagtccacgggatcttccttccggttgacttcttcgggatccgtgtgctgactggcgccaacctcaagatcatcaatgttttgatgggataattgaccataatgagcaaattttcgggcacgataatacacatcgccttccgattcatacccataacccttggcaatcaaatcttgaacaaattcaataatgtccttgatgttttcagttgcacggggatgtttagttgcaggttcaatgttcagtgctgtagtgtcttccataaacgcagcaataaacttgtctgcaatggcaggaacggtagtgttagcttctttggcagctttgatcatcttatcgtcaacatccgtaaaattagaaacgtatttaacgtgataacccttatattcgaagtagcgtcgaatggtatcaaacgcaatggcactgcgcgcgttaccaatgtggatgtaattatagacagttggcccacaaacgtacatttttacgattcccgaagtaatcggggtaaacacttctttttgtcgtgtaagtgtgttgaatactttaagcattaactcgctcctctctgattaatcgtaagtacattttatcataattaatctctataccgacatttttagtgacatcattgcaaattaattaggctgtacgagctacgataatcttttttacgtgagaaacaagaaaagggctagctgcagattcgcttacctgcaaccaagccctctaactcgtttaactaattttcattcagttgtgccaaggtttgagcaacgtgctccaacgtcttgtcacgaccaaccagttcaattgattctggtaattctggtccgtgcatttcgtgggtaacggcaattcggataggcatccaaagcttccgtcccttaataccagtgtccttttgaatagctttaatggttgctagaatctgaactttatcaaaaattggtaacttcttgattcgttcagagaattccttcaaaacaactggtgcagtatcgttagaaatttcttctaacgcatcaccactgacttcttcaggttcttcaaagaagacgctagccatgtcgttgatctgagccatataactcatttgttgcttatataaattgatcaactgacgagcccattcaagggtcttagcatctggattttcaggaacgttacctgcttcaatcaattgttgcaaagctaagtccaccacaacgtcttcatcagaagatttaacgtactgattgttgatccattccagtttcttcttatcgaaggtagctggtgatttactcaaacgcttttcgtcgtacatcttgacgaattccttcaatgagtaaatttcgtcttcgcccactggtgaccagccaagcaagatgatgaagttcaatagcgcatcaggtaagtagccaagcttacggtactgttcaataaactgcaaaacagtttcgtcacgcttagacaacttcttaccagtatccttgctaatgatcagactcatgtggccgaactttggtgcatcccagccaaaggcttcgtaaatcatcaattgcttaggcgtgttggcaacgtgatcatcaccacggaaaacgtgtgagatcttcattaaatgatcatccaaaacaaccgcaaagttgtaagttggaataccatcggccttaacaatgacaaagtcaccgccaatggtgtcagaatcaaaggaaaccttacccttaaccatgtcatcccaagcataagtcttgtgttctggaacgtggaaacggataacaggcttcaagcccttagcttcagattcagccattttagccttgatttcatcatctgacatgccagcatattcgtattcataatgaggcatctcgtgacgggcacgttgtgcttcacggtctgcttcaagttcttcttcagttcggtaagatttataggctttaccttcatccagcaattgttggatgtaaggcttgtagatatcaaaacgttctgattgacgataaggaccgtattctcccggcttgtcaggaccttcatcccaatcaagacctaaccaacgtaaattatccagttggcttttttcgccgtcagccacgtttcgttttgtatcggtatcttcgattcgaataataaacttacccttgtagtgacgcgcaaacaagtaattaaatagtgctgtccgtgcgttaccaatatgcagatgtccagtaggactaggtgcataccgaacgcgaattgaatcatttgccaatatctattccgcctctttcaaaatatttcgatttgaaactctctttgtccgccaacaaagggatacatcgcttgatgcatcccttttgtcaacgaacacacttcatacagtattccagtgtaccaaacaatcgacatctttttaagtgtacaatggaacttccgaaaagaaaagttagttcgacttcttcttattatttttttggttagttgtgctatttttgtttgatttatcgcctttatcggtttcttctttaatttcatgagttgaatgtgccggtttagcaaaaatcatccgtccagcatccgtttgaatggcagaggtcacaatgacgtccaagtgttcgttcaaatagtaacgaccatcttctaccacgaccatggtcccgtcatctaggtaagcaaccccctgctgacgttcggttccgtttttaaccaccatgacatccaagtgttcacccggaatcactcgtggcttcaaagcgttggccaaagcattgatgttaagtacctgtaccttttgaaattcgatgaccttgttcaagttatagtcattagtgacaatcacaccatcgacttcttttgccagccgaatcagcttactgtcaacctctgaaatatcgtcatagtcaccttcgtacatttcaacgggaatgatattttcctcacgcaacttgttaagaatatcaagtccccgacgaccacggacgcgcttaatactgtcgctggaatcagcaatgtactgtaattcatacagcacaaaattcgggactaacagcgtaccttcaatgaaacccgttttgaccaaatcataaattcgaccatcaatcaaaatattggtatctagaattttataatgatgatagttttcatcgattggtcgatcaatgatgctttcaccgtcatccgtgcttttcttggttcgaaacgaaaatagttttcgccattcttctcgtttagtcgtcccgagccgaaaaccaagataaccaaacaaaatcattaaaataacgggaattaatccgctaaatattggtgaattgatccggtaaagcggtgtcgaaatcagtatcgccagaatcaatccaacaattgtagaaacacttccgaacagtaaatatgcggggctttttgaagtcagtgatttctcaaatcgattgattaggcgctcgatgtaacctgaaaaaataagggataatagccataacactagcgcaccaataataccattcgtgatttcgttgttaaaccacgttcggtttgagtaaccaaagcctgcccatacaagtggaatataggcagcgccaagtcctaatccaataaacgcaaaaattgcttgaataattgctctttttttattcaattaattcacctccaaatccgttaagctaaaatcttatgcagtgcctccccaagcgtagccacgccaatcacctcaatatcagttggcgccgtccaatccttcagattatttttaggaatgtagattcgtttaaagccaagtttcgaagcttcctttacccggtcttcaatccggttgacccggcgaacttcaccagttaagccaatttctcccacgtaacactcatttggattagtccccttgtctcgatacgaactggcaatgctaatggctagagccaggtcaattgccggttcatccaacttaacgccaccagcggccttcaaataagcatcctgattttgcagcatgagattggcccgcttttccagcactgccatgatcaatgatacacggtttcggtcaagtccggaagcagtccgctgagcattcccaaaaacagaaggcgttaacaaagcctgaatttctacgaggatgggcctggttccttccatggaaactacgattgcggaaccagtagcgtcttttaaacgctcctccagaaaaatttctgaaggatttttaacttcttttaacccatcttcctgcatctcaaaaatacccaattcattagtggatccaaaccggttcttcacggctcgaagaatacggtacgtatggtgaagatccccttcaaaataaagaacggtatcaaccatatgttccaaaactttaggaccagcaatggcaccgcccttggtcacgtggcccaccacaaagatggtgacaccctgtgatttagcgattcgcatgagttcagcagtgacctgtcgaatttgcgaaactgacccgattgctgaagtaatctcaggctctgacatggtctgaaccgaatcgatcacaacgtaatttggcttcatctcattgatattcgcccgaatccgactcatatcggtttcaggatacaaataaagattgtcacttgcaacgcctaaacggttagcacgcattttaatttggttagcactctcttcaccggagacgtagagtaccgtaccaccagtttgactcagttggccggatacctgcagcaacaaggtggatttaccaattcccggatcaccaccaattaagaccaaggacccaggaacgacaccgccacccaaaacacggttaagttcacctagctgtgttttgacccgaggttctttttgcattgaaaccgcggctagcttttccggcttagtcaccgtaccaccgcttaaactagttgccgttttagcagtcgtcgctggcgcaatcacttcttcaacgaaggtattccacttgccgcaattgggacagcgccccaaaaatcttggtgcctgataaccacattcttgacagacaaactgtgttttttctttcgccaatcatttcaatcctttccggtgatactctgactaatactaaccaaacttattttagcatagtctccgcctgttgaaggcttagactcttaagctttatttctttttaactacttaccagaagaaccaaaaccaccctggcgttcctgctgaggcttttgttcatcatccgccgtaaaatagtgcataaagatgccctgcccaatacgatcacccttggcaaccttggcatccgtcaggccaaagttcagcacctgcataaagatttctccctcgttgctgtcattgttataataatcggcatcaatcacgccaatcccatttggaatgactaggctgcgcttaagtgggttacttgagcggttcgccaagatcaacacttcgtcatcacccatatatgccttgatccccgttggaattaaaaatggtttgagaatctttttggccttttttgaagtttcgctatccacgtttgactcatgacgaattgcccagatcactttcaaaaaatcgagtttccaaatactcggcacgttaaaatcaaccgcactttcaaagtcatatccggctgcccgttttgtggtgcgatacggcaaatgtaacccctcgttagcgtaggaagaaacaatttcaaatccacgtgtcatctctctcactcctttcatgcatgtgttttatatcttacactataacgttgtgggaaaacaccccaaaacagtctatacttagctcacttttaccaccgaaatgttgtacaataatgactatgaaacgagaaggagtgtgatccatttgagtaatgataaaacagctgctatcagcagtgatcaaattacccgctatcagactttatttaacgaccgtaaggatgccaaagtggtggaacgcgcagttagccatcaagggattctggctaccagtgctgattttgcttccgacactgacatgacacccgtcttttccattgagttggacacagggaaagtagccaatcaaaaacaaagtggtcgttgctggatgtttgcggcattaaacaccatgcgtcatcacttagctgacctgtttaacctcagtgacttcgaactttctcaaaactatactaatttctgggataaattcgaaaaagcaaactacttctatcaaaacgttctggacacggcagaccaaccgctaaccagtcgtaaggtcgcctttctcatggcaaccccacagcaggatggcggccaatgggatatgctttgcgctatcattgaaaaatacggtatcgtaccaagatcagtgatgcctgaaacctataacagttccaaatccagtgaactaaatagcacgttaaacaaaaagttgcgtaaagatgccgttactcttcgtggcttaactgctaagggcgccagtgatgacgaaattgccgctgcacgtgacaaaatgctaggtgaagtttaccgactgctgtgctatacgttaggtgaaccagcacaaaaatttgattttgaatatcgcgatgacgataagaactaccacattgatcgtgacttaacgccaaaatcgttttatgacaaatacgttggctggaacttagccgattacgtttccatcatcaactcgccaacttcagataaaccgtacaataaaacttataccgttgaaatgttgggtaacgttgtgggtggccgtgaagttaagcacttaaacgtcactatggatgattttaaacaactagccattgctcagttgaaggatggccaaagtgtttggtttggttgtgacgttggtcaaagttctgaccgtcaaaaaggcatcatggatactaacgcctacaaaaaagacgaactactggatatggatctctccatgactaaggcggaacgtttagattacgctgaaagcctaatgactcacgccatggtaattaccggtgttgatctcgtcgacggtaaaccaactaagtggaaagttgaaaattcttggggcgacaaggtaggtaccaaaggctactttgtgatgagtgacagttggatgacagagtactgctaccaagttgttgtgaacaagaagtacctgagtcctgaactgcgtcaggctcaaaaagcagaaccaactgttttagccccttgggatccaatgggtgctttagcataatagagtgtgaaggtaggcgcttagagactggagcgtaaacccaaaaggaacggtggtcaggcgatttttgcctgatcaccgttccttttgggtttacgtgcaagtctttgcctacctgaacacgttttagaatatcttaaaccatatactaccttatcgaaaatccagataacgcccctatcaatcaatataaactcacgttaaggtattttaatcaccctttacgctttcagttcctttttattaatcacgtttaattgggtatcaaattcataaacaatcggcaccccgtttggaacttctaaatggtcaatatctgcatcactgatctgatcaatatacttaatcagtgctcttaacgtactgccatgagcaaccaccaactgattatgtccatccaacaaccgcggtgcgatttcatcctgccaatatggcattaaacggtcataagccatttcaaggctttcacccctaggttcagttacccctaacggctcatatcgtgggtcttgatcaggctgatctaacagtggcggtactacatgataactacgccgccaaagcttaaactgtttctcacccacttcggctttcaccgctgctttcttcttcccccgcaacgcgccgtaatgacgctcattgagacgccaagatttcgtcactggcagataaagttgatcgatctcatccagcacaatgttagctgtcataattgcccgttttaacatggacgtatgcaaatgttcaaactgcagccccgcctgtttaatggcttttccagcctggtgggcttgtgcaatgccctttttcgtcagtggtacatcactccaaccagtaaacacaccatctcgattagcctgactttcaccatgacgcaaaacgactaatttaaccataaaactgaccctctcttctcatgctctttcattcacataacagtatatcaccggctttaaattcaataaagggacctcggcatgaagtcgaagtcccctaattgaatttaatgtgaagcatttaatagtaacattaaaattggaatgaccagcaagctaagtaatgtggattcagtcaccattaccgctgcaaaactagaatctgcaccatagagtttcgatacaacgggcgcattggtcatgacgggcattgcagattggatgatgaaaacttgtttcatcatcatcggcatcccggttggcaataccaaaagcgccattaacgctggtgctaaaataaatcgaccaaagaggattcccagactgccacgattgatcgtcaaatcatgaagatcaacattagcaattgcaataccaataaagatcatggagagtggaaccgttaagccaccaatataattcagatccgccatgataaagttcggcagttgaattttcagcaaaactaaaacgaccccaaccataaagccaagcaaaggcggtgaaaaaacctttttaagtgtttgacccagactaaagtgataatcgccctcgccgtcacgttgaatcagataaacgcctaaagtccagaaaatcgtcgtgttggccatgtagtagaccaagacataaggcaaactcttagccgcaccaaatagcgcaacgttaacaggcaggccgacaaacaccgtatttgaattaaaaaacatggattcgaaaagtccgcgatgacttttcctaatatgtagaactttggcaacgatgattgaaataccaaacaggatcatcattgataccacgggaaaacgcaaatcaggtaacgtttccactaatcgcttaaacgtaaacttgctggtaatggtatacgccatatatgcgggtaaggccacctgagtaaccaaccgagcaatcaacttgctggctgattcattaaaccagcctagattagtcagaaggtaacctagcgcaatcattagaagaatctcaaccacgcccgcaacactccgggcgaataatagtaacattgtttgttataccttctttcacatcaaaaattaatattcattatagcataattcaataacgttgactttacaacctcacaaatatctacttgaagaacttcaaagacgagttcaattaccgttatttaagccctcattacccaatttacctcttcacattctgtcgttcaatgtaacttctactcattgaacggtttacgtgactcgcaatttgtgatgtaatagtacagttaggcaggggaagaagcgtctaatatttttcttaaaatcgacttaagcttcatgaaagaaccacactatctgagaaaatagacctataatgcaaagagattttacagaggcgagggaaacttatggcatcaaataatttcgatccagatcaaaataatcaatcaacacggcggagtgattattcacacttcaaatcacataaaaagcaccatggcttactttggagcatcctaatcattgtcttaattctgattactggtgggattgcctatggttatcatgcttataaccaagcgaagcaaactttcgacaacacgtttcaagcgggacaaacagataagctacggaacgtggacaacgtgattaaacaaggaaaacctttctcaattcttttgatgggaactgataccggggcccttggtagaaacgatgttgggcgaacagataccctgattgttgcaacgatcaatcctaaaaaggaaaccgcctatctgactagtattcctcgtgatacccgcgttcaagtgaagggtgattcgcagccgtacgaaaagatcaacgctgcctacacaattggcggcgctgccggctctgtttccaccgtcgaaaacctactcgatattccgatcgacttctacgccatcgttaatatgggtggtttggagaagatggtcaatgccgttggcggtgtcgatgttgtcccaccaatgacgttccactatggcaatgctaacgtggtgaagggacaaaagatccacttggacggcaaagcagccttggattattcacgaatgcgtgaagaagatccattaggcgattacggacggcaaaaacggcaacgacaagtccttcaaaagcttgttgtcaagggtgtgggcatcacctcacttccacgatataaacagattttgacctctttgaacggcaatatgaaaaccgatatgactttcaatgatatgttagcaattcgaaccaagtacggcgatgctagtcaccacattaaatctcaaacactgcaaggtcaggacgccatgattaatggtatttcttatcaagtggccccactttcagaattacaaaaggtctctaacaatattagacatactttgggtcttagcgaatcaactaagttaacgcctagttctacgggtacaggcgatgacagcagttatacgtcgtcaaccagtagttccggatattaagcctaattagattagattttaaaattgaattcacaaaaaagcgctattcgactgaatagtgcttttttgtgtggaatccgttcaattcttaaaaggtcaatttatctaaaaatggcttgatatctattggattatcatcaggtttttgctgcacgaccactttcaactttgcgtgatcggttaaatagcgtaatgcctttgcctcgtttttatcgaccgccacgccatccattagcattttcataccatcttgataggcaagtatccctaagttaataccaatcccgcttagatcaataccgcccttaaccagcttagccatgtccttagcagtttccgtcaggagtattggccgaaaattgttgaatcgagaatcttgataaatggtcagcatcttttttaacgtcagcacattagcttcaacccctgctggcacagactgcaaaatcagcgtctgtcgtaaatggttttgagccacccggttcgagacaactaagattcggttaggcgcggtggccttcacccagccacttgcgacctgactaggtaacagacggctaccgatgcgtgcaaacttgatgtccattgtcatagtggttaagcccctttgtgacctgtctccggttcaaaatgccgaatacctttctgaccgcttttctctagatggtcaaccactttatctaacggttggtcccgaatggtaaacgcatccatcacgattggcagattaactcccgtgatcatcgccatctgttcgggctgctgactcacgaaatgagaggcaacggtgaatggcgagccaccccacaaatcaactagaaataacacagcatcggcagagtcaaacttacttagcgcggtttgaaatttgatgatcaagtcatctggcgtttctttttcctcaaaagtcacggttgcaatgttagtctgcttcccaaaaatcatcgttgcagactgtaaaagtcctttggccaaattaccgtggctagcaatcacaatggcaatcacgacattgcctcctcatcattaaacaaaaattaattcctacatccattactacttacagttgctattatcatagcacactgacccgattcatgccctgacacattggcaaattaacgaactagggcaagtaactcttcgggagtcgcaaacgtataatcggcaccttcaacctttgatgcaccaccatttccccaagccactaaaccaaacttaattccggctgcgtgggcagcttgaccatcaaacttggtatcaccaatgtagatagtttcttcaggattggcatttagtcgatccatcgccactaagattggatctggtgccggtttaccccgtttagcatcttcaaagaaaacaaactgactaaaatatttgtctaatcccagcggtgtaacgtcccgcttgaactcaaatgtttgtttggaagtcataattgccagttgcgtcgtgggctgttcgttcaaatctgacagcattttctcaataccatcatagacgtggaccagtggctgaaattctggaatggcttgtgcccattcgtttaggattggctgtatcaagtctgctggcactttaaggtgctttaaagcgtctagactagtaattccaaacgtttgtgttaactcactgtacgggtgcttaatttggtgctgacgaaggaccttgtccagtgccttcatgtacatcgcttcagtatcaagcaaggtaccatctacgtcaaaaataaagtttttcattaaccctaacctccgaaaaaatttcaatcaaaaaaactcgaaatatttaaccaaagctggtcaaacattccgagtttacgtatgcggccaagaggactcgaacctccaccgggaaaaccccgacaagatccttaatcttgcgcgtctgccagttccgccatggccgcatcaacaagaaataatataccagaattataacttgttttcaatggttatttgcaaaatagttatatttactccgcatttaccgtcgcgccttgacgatcaatatcaaaaatacgaagacttcctctgacatctttatccattaatttttggcgtaaaacaattaattgcggttccttagcaaaggtcccaatcgttggcccagcgccacttaagtaggtaccgtaaataccaagttggtgtgccgtttcacgaatcattggtagttcagggacgagtttggtccgggcaacttcatgaaattgatcacgttccatcatgtgactaactaatttccaatttttagttgctaaaccagcaaccattacattagcaacactacttccgattaccgcctgtttacgaggtaactgatccgataagacgtttcggctatcagaagtcaataacggctggtttttgataaaagccagcatttttaacccctctggcattgccagcttaacactagttgcattttcaccatcaaaatcagaaatagtcacatcacctaataaagctggtgcagcattgtctggatgtccctctattttggcagctatcgtcacttgatcagctaatgaaagatccattttgcctaattcgttcgcaattttaactcccgcaaccaccgcggtagaagaactgcctaagccacgagccactggaatgtcagacatcactgtcagttggtgcggttgaaggttggggttcaccttcaacgcagattgaacgatcaaattttgatcatccgttgggacatcaggacctaaagcgtggttcacccgccactgctcagttttttcttccacgatcaccgtgaggtataaatgcagtgcaaccccaatagaatcaaatcctggtcctaaattggccgatgtcgctggtacccgaatcacaattttacccataaactcatcctccaatgctgaaatgcaacgcaattaaaacactttcagttctcattcactattatcaagtacatcaatttaaatttcaatcctgttaataattttccggtggctattgcagcacactcttttgaaaaatcaatctaccacgacacttaccgcaaacaaatttttgtgtattgatccgccgtcttcgttgatagagctgaccgcacttttcgcagcgataaacaaggtatttggtgggtttactctgtcgtggttgacgaggcgcgtaacgtaaaccaccaaccgcctgtaataattgtttaaacgctttggtgcaatgttgaccagattgaccggctaaatggagatgataatgcactaattcatgtttgataacaccctctagtgtagcttcaccaaacaccgtcagcatccgtggattgatatcaatgtgatgatcctgcaaatgataccggccacccgtcgtttttagacgctgattaaaaacggcctgatgcctaaatggtttgccaaatgattgaagcgaaatccgttcaaccagctgctgcaattcctgatcagtcattcggtgccaccatacttagctgaatccggtgtcgctgttcatcaacctctaatacccaaacagtcacaatatccccaacggatgcaacgtttgctggactgctgacataggattttgacagatgtgaaacgtgtaccaagccatcttgtttgacgccaatatcaacaaaaacaccaaaatccaccacatttctaacggtgccttccagcttcatacccggttttaaatcagtcatttgcaaaacatccgtcctcaaaatcggtgctggcatctcatcacgccgatcacgtcccggctgctgcaagctttttaaaatatcctgaagtgtctctttgcccacacctagctgatcacttaaagtattggcatcactattttccagtgcagaagcaaccgctggtgtaccaacctggttcaattttaagcctaaacgcgttaacacccgtttggcaatcgggtaactctcaggatgaatatccgtgttatccagcacgtttttaccattaacgattcttagaaaaccaaccgactgctcgtaagctttgggtccaagacggggaacctttttcagttctggacggctgttaaaactgccattttcttcccgataagcaacgatgttacttgccgtctgctttgaaagccccgaaatatgctctaataactcaatactagcccgatttaaatcgacaccaacctggttaacggccgtttcaatcacgcgtgcaagctgctcgtctaggccactttcaggaacatcatgctgatattgaccaacaccgattgacttaggatcaattttaactaattcggctagtggatcctgaagacgccggccaatactaacggccgaacgttcttcaacattaaaatcgggaaattccgcccgagcgactgcactggcagaataaaccgaagcacccgcctcattgacaatcgtatacctgacatctcgatcaacctgtttaatagcatccgccacaaactgttctgattcccggcttgcagtaccgttaccaatagcaatcatatcaacttggtaatcattcaataatttaataaaagctggcattgcttgctgccgctttgtagctgaagcaggtttatgcggataaatgacctgtttagctaaatatttcccattgccatccatgatagctaatttacaaccggttctatacgctggatcgaaccccatgacaacatgattctttagtggtgcttgcatcaacaagtggtacagattattaccgaacacctgaattgcgtgtgcctgagcagtctcggtcaatgatcgtctcaattcccgctcaatggctggaccaataaaccgtttataggcatcttgataggctgcttcaacaatggtcaccgatggtccttgatgacgaccaatcaactgaaattttaaatagcggtcaatggctggttcatcaacgttaatcttgacggtcagcacgcctgctttttcgccacgattgatggccaaagtctggtaaggactcagcttttttaaagcagattgaaaatcatagtatattttatatacttgatcttcatccttttgctgtccattacgctttaatttactggttaaaataccgtttcgttgcgtatagcgccgaacccattcgcgaaattcagctcgctcaccaatggcttctgccagaatctcattaacgccttctagtacactgctaatatccggtacctgatcgttaatatacccctttgccaccggctcaatagggtcgcgtttaaattgcagtacccactgcgccaacggatacaagccggcatccttggcaattgtggccttggtccgacgcttttgcttataaggcagatacaaatcttcaacctgctgcatctgcgtagccgctttaatggcagcggatagtttgggagtcaatttttcttgttcagaaatttggttcagtacttcttgcttccgctgctgtaacttactgatccgattagcttcatcctgaatctctcgaatttcaacttcatcaagattccccgtcatttctttacggtaacgcgcaataaacggtaccgtattatgatcgtttaataaatctaacgtcacgtcaatttggtgacttttataggctggaagtgcctgtttaatcagttttagcgtttcagtttccattcttcaacatccttacgtgtagtgtgtttattataccatgcaggtacccctacctacgcacaaaaatagagcaagcaaccatctcgctgacgattacccgctctattttcatattattacatcaccatcgacataatgcgttgcgctgctgaagtaatttttcccatcatattttcttgttcatgctcagaatcattaaaagcttcaacgttgaccgtctgatcatcagcgtcaatggcatcaaccattgcttggcaggcctgtgaatagttacgataggcagctaccaattgcttgtgcttacctaaaattctaaccggtactgaagcttgctgcaaccgattcaggttttcggtgtaagcatccgttcccttttgaaaggttgctttaatcgaagttagtgtttccgttcctaaatcagcaactgcatcatcatcaattgctttgcgcaacttttcaaaatccggattcatttccgacccagttttttcagtatcttcaattactttacttaaagcaggtaaataacttgccattgtttttggcttcataaaaattcctcctattttccaaaccgccgctgtaccaatttaacgatttcgacaatcgcaatcatcaaaagaccggcacccaagacgattccccactgcaatccattcaactcagtcaaatggaaaatggtattaaaaccagggacaacaattgtgaccgctaataataagaacgccgtcagaatcgcccagttcagtgaacgattcttaaacagaccaactttaaaaattgactcgtgaatcgacttagagttaaaggcgtggaacaactgaatcataccaagtgtcgcaaacgccatcgttaacgcatctgcatgagctaactgcgcgctggcatgaactgggaactttatggaaagcccatatacaccaagtgtaatcagcccttctagcaatccttgatagatgacattgccaaacacaccgccggaaaagaagttcgatgaccggccccttggtttgcgtttcataatattaggttccgctggttccaatccaagcgcaatggctggaaaggtatccgtaaccaggttaatccatagaatctgcactggtgctaaaatttgccagcctaacagtgtcatcacaaacagcgtcagcacttcaccaatgttagcagataagaggtactgcagcgctttttgaatgttagcgaagaccttacgtccctcttctaccgcaaccacaatggtggagaagttatcatctgccaataccatgtcactggcacccttagaaacttcagtaccagtaattcccataccaacaccaatgtcggcagccttcaaagccggcgcgtcgttcacgccatcacccgtcatcgccaccactttaccacgcttttgccaagcattcacgattcgcaccttatgttctggtgcaactcgtgcgtaaaccgaatactggtcaacagtttgattgaactgatcatcactcatcttgtccagttcggccccggtaatcacttgattattaccgttactttcatcaaaaattcccagccgctttgcgatggccgtggcagtatcccgatggtcaccagtaatcataatcggccgaattccggcttcatgtgcttcaacaactgcttgagctacttctggacgctcggggtcaatcatggcgattaaaccaatgaaaattaagtgctgttcagcagtttcactggttaagtcagaaggaacctcgtcaacctcattgtaggcaaaagctaacacccgtaatgcttgagtagctaattggtggttaatggccatgatctgctgcttatcggcatcagtaatactgcgaaccttaccgtccagtaaaatacgatcaactcgctttaataactggtctggtgcccccttggtgtacagtgtcaccttaccatcctgatcttcattaaacgtcgacattaattttcgttcagaatcaaagggaatctcagcaactcgtttattgctgctaatagtcgcagaagccggttcatcttgatccaaataatactgaatcaaagctgtctctgttggatcacctgcgagaccgtcatcggtaaatttactgtcattatttaacatcatcgctaacgccagaggatctgttaaatcaaccttccgctgtttagcatcaaccagctgaccgttttcatacaactgttcaaccgtcatcttattttgggtcaaggtacccgttttatccgaggcaataatatccgtgctgccaagtgtttcaacagctggcagtttacgaatcagtgcatgacgctttgccatccgctgtgtgcccaacgccaaggtgattgtcacaatggctggcatcccctccggaattgcagctacggccaaggaaatggccgtcagcagcatattcaccagagtttcttctccacgtaccataccgatcacaaacaccaacaccgcaattgccagaatcaatattgtcagccattttccaagctgattcaggttttcttgtaatggtgttttggtctctttagtttcttcgatcatgccagcaatttgaccaacttcggtctgcataccggttgccacaacgattcctgtacctcgaccagtagtaatattagctgtcatgtagaccatgttgtcacggtcacctaacgctagatcatcttcatccagcacatcgctggttttgttcaccggtacggactcaccagttaatgctgcttcttcaactttcatcacgttagctgtcactaagcgaatatcggctggcacaatgtcgccagcttcgagatggacaatatcgccaggaacaagctcatcacttttcacggtaatgacttctccgtgacgttctacgtgtgccactggtgcagccatttcacgtaacgagttaatggcatcttccgctttggcttcctgaaagacaccaaaaacagcgtttaggacgacaaccgcaaaaataattaaagcatcagctaattcgccggttgcgcctgcaattaacgcagcaacaatcagtacaatgatcatgaaatccttaaactgagcaataaatttttgcagaattgttgtttgccgtttggcagctaacttattttcaccgtatttttcacgtcgctctttaacgacgccctcagtgagtccttgttcttgtgtctctaaatttgcgaacaattcatccgttgtctgctggtaccagggtttgtttttcatctaaaatcctcctgtcatttatgaaacctgtattttcgttataagtctcatcgattaaggccttcccgggagccagttgccccttgctgacggtttgaccacagaagattctgccgattactccctcatcgtatcacgcagttacaagttgcttatttccaaaaagtatcgaaaactgtcacaggtaagtgacgtttgtgctgggtctttaaataccagctctcaatcgtttctgcagctttatctgaaacggttttaccttccaaataatcatcaatctcatcatagtgaacgcctaatgcgacttcatcgggtaatgatggtcgatcttcttcaagatccgctgtaggaaccttagtatacaggtgcttaggtgcgtgaagcacctcaagtaactgtttaccctgacgcttatttaagcgccagattggcgtaatatcagcagcaccatcaccaaacttagtgtagaagcccgttactgcttcagcggcgtggtcagtacccacaacggcaccctggtttgcaccagcaatcgtaaattgagcgatcatccgttgacgcgccttaatattgcctttattaaaatcagaaatttgttcctgatttgcctgaaccgcagcgactgttgcatccgttgcaggtttgatatcaactcggtcgacccggtcagcttgcataaagtcgatcgcatccattgcatcggattcatccgcttgagtaccatatggcaatcgaaccgcaatgaattgataatgatcattcttcgtctcttcacggagttccgtgactgccatctcagatagcttgcccgccaaagttgaatcctgtccgccagagatacctaataccaatgtctttaaacccgtcttttgtaaataagcctttaaaaaatcaacgcttcgtctgatttccgtttccggatcaatttgtggttgcacctttaaagctgaaataatctgttgctgtaactctctcatctcttcatcctcttacttattatcataatcaatttttttgacatattcgtgaacttttttaattaaattcatcttgttgtcccataatttttgagataaatcaacgggatacttttgcggattcagatctcgcttgtattctggccagaggttttctaagttctctgaacagcgactcttaatatcagccaattctggctgctgataaactaatcgaccctgatcgtaaatcgtctgtaagattgggcgagcatcaaagtcggtgaccgtcttattaatgtacgtgtaattaggatggaacatgtacagctcgtcttggtgacgggggtcttcactcgaaagtgcgatgtaatccccttcagacttaccactgtccttttttgtgattcgccaaacttgtttaggcccaggcgtggaaaccttctcaacattgttagacagtttgattgtatcttccatcttaccatttctctcaatggaaaccattttgtaaacggcacctagcgctggctgatcaaaagccgtgatcaacttcgtgccaacaccccaaacatcgatcttggcccgttgcatcttcagcgacataatggttttttcgtctaaatcgttggaagcataaatcttagcatccggatacccagcttcatctaactgttcacggacccgtttcgacaggtaagccatatcaccggaatcaatccgaacacccaagaaattgattttatcgcccatttcattagctactcgaatagcacttggtaccccgcttttaatggtatcgtaggtatcaactaagaacacgcagtcttcatgcgtctcagcataggcacgaaaggcatcataatcgttgccataggtttgtactagcgaatgtgcatgcgtcccactaagcggaatcccaaatatctttccggcacgaacattggatgtcgcatcaaaaccaccgatgtaggctgcacgagttccccaaatggcggcgtcaaattcctgtgcccgccgtgaaccaaattccatgataccgtcattaccggcaactgaacgaattctagcagccttagtggcaatgagggtctggtagttgacaatattcagcaccgcagtttcaatcagttggcaatcagccaatggcccttccacctgcagcatgggttcgttactataaacgagttcaccttctgcgacggaccgaatcgttcctttaaacttgaagtcagttaaatattggattaattcaggtgaataatctgttgcttcttttaagtattcgatatctgtttttgaaaagtgtaaattttcgatataatggatgatatgttccaatccggcaaaaacggcaaacccgtttttaaaaggcatatcgcgaaagtaaacttcgaaaatagcttgcttattttgaattccttcctcaaaataagtttgaatcatgcttaattcatacgcatccgtatgcaacgttgtgctatcgtctggatactgctttgccatggtttgtaacccctttaagtgtttgatatttctggttatgagaactattctatcattaatccgaattatcgtcagttaaaccgagtagtttacacattatttctagaatggatggttattatgtcaaaagaatttccactggtcagtgttctcaacgttccatttatcaacacgactcaagcagcttttttaaccacaattgaatcacacatcaataatcgtgaaaacacgtttgtcgtcacagctaatccagaaattgtcatgtacgccagaaacaatcctagttatcagcaaattttaaataatgccgactatattactccagatggcattggtattctaaaaggcgctgcaattctcggaaccccaatggccgagcgcattactggctacgacacgatgctcgacttactaaagtggggcaacgagcagcacaagtctgtctatttaatcggtgccaaacccgaagtcatcactgatgtaaaaaatgttgtaacaacccgataccctaacctcaatattgcgggcatacatgacggctatttcgatgattttgcacccattgcgcaagacatttctaaaacccagccagacatggtattcttagcagttggttttcctaaacaagaacagttaattgccgattatcgtcatcaaaataacggtctatggatgggagtcggtggcagttttgatgttcttagcggtcataccaagcgagcaccaaaattctttcaaaatcatcacctggagtggttttaccgattacttagtgaaccaactcgcttaaaacggatgatggtccttccaaggtacttaaagacggtcaaacaatctgcccgaactaataaatagaacagtgtacgaaaagaacctaggagttgatcaaactgatcgcttctaggttcttttttatttttccagtacaaattcgaatcgttcacccacatattgtgttctcacatattcgaacggccgaccgtcttgtagatacgagatttgacgtaagcgtaaaatcgcatcgccacgtttaatatctaagtattcggcaattctttctgacgcagatgaagccgaaaccatttgtttagcgtgtcctggaattagcccctttttggtctctaaagttcgataaagggattcagaaacctcttgtttagagaggccttccacaatctctaacgggatggttgccacttcaaaactgattggcacgtcatcgccataacgaacccgttccattcggagaacctgcgtatcatctttaagcttgagcttctcactttcgcttaaagaaggactcatcacatggtaagaaatggtcttactggacggttttttaccttgggcaagcattagatcagtaaatccagtgacccctgacattttttcttgtactttctgattagccacaaaagtacctgatccaacaaagcgctctaagattccttcctcaactaacgtttgaatggcttgtcgaagtgtcattcggctgacatggaattgaacggctagctcacgttctgatggaatacgatcaccaacagaccacttgccggcctcaattgctttcttgatctcattatgaatttgaatatatacaggtgatcccataaaatttacgacctttcttacctaactaatcagtttgactcgcatcaaattcgcgcccataactgtaggttgtttgtagattaagtgcacgatcaaaaacgtttaaatcagcatctaacccaggcaaaagtttacccttttgagttaggccaaattcttcagcttggttaaccgaggccatttggaccgcatcctcaattgcacagccagtaaaggaaatcacgtttcgaaaggcatcatcgtaacgtaatacagaaccggctaagtttcccgtttcaagacgggcttgcttatctttaacaatgaccttttgaccaccaagctcactaattccttcaggcatacctttagcacgcattgaatcagtgactagttcaatgcggtgaggccccttttgttcgtaagcgagtttaatcatatctggtacgatatggaaaccatcacagatcaattcagcatacatattatcttcaagcatagcgtgcccagtaacaccaggttcgcggtgcttaaattcacgctgtgcgttatataagtgagtgacatgagtagcacggcttgctaacatttgtgctcgggtagcattactgtgacccactgaaggtacaatgtgatgagctaagcagtaatcttcaaaaactctagcaccttgatcttcgggagcataagtaatgagtttaactaacccaccagaaagttcattccagtgatctaagagagaaacgtcagggtccttaatgtacttttcaggctgagcacctttataaatggccgcaatgaagggcccctcaaggtgaacacctttaatgactgggttaaccttagctgcttctttaataccagtcattgcgtgggcaatattatcgttggattgcgtcatggttgttggaaaaacggtggtgatcccttctttgatcatgtgattaaccatttgattgatttgatcagcatcaccatccatggaatcgaaaccatacccgccatgagtgtggacatcaataaaaccaggaacgattaccttaccgttaacaaacttaacttcatcttcgggttgtgcacgatagtcgcccatctggcccacagcctcaatcgttttgttgaaccgaatatagccatccgtaataacatcttcaccggtataaattgtcgcgtgtttcaacacgatactcataaactcttcctcctaatcaactctcatctactcgattaagtttacgaatttattatatactggtatagaccatgttgcaagcctgttgcattggtattcactgaagcttaatcgtgagaattggtgttttacagcttcaacaatttattcagcattattacgatcaattgtggcatcaatacccttaactacggcagtcataaaaccagcctcttccatagctagtaatcctgccaccgtactgccacctggtgaggagacttggtcaatgaggccaaagggattttcatcagatttcagtaccatttccgcagaccccatcactgcctgtgcagcgatcttagtggcagctgtcttagtcaaaccgtgcttaacaccggctcggcttaaactatcgataaagaaataaacgtaagcgggacttgaaccggctaaagctgagaaggtcgcaaaatcgttttcaggtaaagttaccgtactaccaatctggtcaaacaaaccaaccgcctttttcttggtctcaccggttaaattttcgttagcatgaactgctgtcatacctgcaccgattgcgacattcaaattaggcagcgtccgcaaaattggtaagtcatagcccgctaattcttctagtcgttctagtgttaaccctgcaacgatggaaattaacgttgtctttttaggatcaagttggtcacgaatttcctgaacgactgaagttgcaacattaggcgtaacggccagcactacaaaatcactatttttggcaacttcaacattacttgcctttgacgtaacacctgtctgcttagcgactctctcataagtcgaagcatgagcactgtgcaccaaaatatcagatggtgaaagtttagtttgcttaagaagtcccgttataatcgcttgcgccatgccaccgacaccaatgaagccaattttcatgagtatcactcctaaacgtttagattttgctgttgagattttaagtacattatatcagagattatcgtgtaccacagtctttctaaaagcccatcatgtatcaccataaaatttaaaaaaagcccatcagccaaaagactgatgggaaagttcagataaataattgggctagctgggttcgaaccagcgcatcacgggatcaaaacccgttgccttaccacttggctatagcccaataaaagagatggatgggagtggattcgaaccaccgaacccgaaggagcggatttacagtccgccgcgtttagccagacttcgctacccatccataattagaaacaaaaacaacatcaataactatacagcataatgtatatccagtcaacacaaaattggttgattgggctagctgggttcgaaccagcgcatcacgggatcaaaacccgttgccttaccacttggctatagcccaataaagaatggatgggagtggattcgaaccaccgaacccgaaggagcggatttacagtccgccgcgtttagccagacttcgctacccatccgtaattgatttaccataaatcaacttaattataataacaaaaatcagttagtctcgtcaagctggtttgccgttatttctcataaaaattgaatttcattcatttttatcggtcaaattaataacccgtactcgttttaaccactctgactggaaattactggttagccattcatgtctccgcgcggtcccataccccactgattgattgaaataaacggttccttcaagttcacgtgacatcggatggatatgcatatgaccaaacaaaacgtattttacgtgatatttagctaataaattgcctgtgcgcacacttcccaacatagcgttagccatattccaaaaacgatcgtcagaagtgatccgtaaatattcaattcgtgggacaaagtgagtcataaataacactcgcttgtgtgcctgctgtgcctgttgcaattgctcctcaatcacccgtaattcctcagtcattctttctggatcgcttattggttgtttaatggccccatcaatccaataggcgcgcttccagtgcaaaaaatcagcctccgggcggtgcatgacagctgaaaaggtatagtcataccacccattattaccaatgattcgccagtcggtacccatcacatcaaggtattgacggtgaaggtaggtcgtagccaggggcttttgaaggtcctcatagctaatatcattaaccatgtcatgattacccgcaataaaccgaacaacggtatgcggggtcatcttttgcaacttttcagcaaatgacaaagaacgtttaaagtgattaaaaagatctcccgcaatcaaatagacgcttatttgattttctttcagccagtcactttgctgtttcagggtctgttcaacgttcactttattgatatcaagatggatatcactcaccattgctacattaaccattgtttctctcctaattaaaaaagttgtgctacgacaatatcgtaacacaactttaaaatgactcgtttatagaacaccttccattaagcgcttaattggcttaatcataaagaagagaatgataccagcaataatggaaacaattccaataatgctgaagtaagcaatttcgtttgaaggtgtgtagaatttaacgatttgtgagttgacggcttgcccagctgaatcagctaagaaccacatactcatcattgacgactggaacgctcttggtgcaagcttagtcgttactgacaatccaattggtgaaattaataattcaccaatttcaacgattgcccagctaccaactagccatagcggactgagtagtgaatgggccccaaacatggatattggaatcactagcagcaagtaagacaaaccagttactagcatccccattgaaaacttacttggtgatgaaggctgcttcttacccaatttggtccacatcgtagcgaagattggtgtgtaaattaaaataaatagtgggttcagtgattgatagttagctggattaatgtgaatgacccagttaaaaagatgaatcgtgttgttagtctgatcctgtgcaaacagagccagaacaacagaaccttgttcctcaattgcccagaaaatagctgcggcaataaataatggcacatacgcccaaacacgggaacgctcgtgttttgtgactttcttactggtcagcatcactgcaaaataagcgactggcgttaacacagcgatgatacttagcaaagtgatgaagttagcaatgttaaatgcaccgaagacgtacataatcaacaatactaaaataaaggcaatcgcacccaaagtaacacggaatgataatttcttagcatcgccaggctctaacggatcatctggatacaatgaatctgcactcagatacttcttaccgccaaagtagtaggaaattaatccgaagaacataccaatagctgccagtgagaaaccagcatggaaattaaaggctgtccacattgctggtacaacaattggcgcgatcagggaacctaagttaatcccgaaaacgaaaatagtgaaaccagaatcacgacgtgtatcttctggtgaatacaacgtcccaaccatttcggaaacgtttggcttcaataaaccagtaccaatggtgattaagcagatcgaaataaataacgcgattttaccagcgggtaatgacaaacagatatgaccaaacatgatcaaaacaccgccgtaaaatacggtcttacggctaccccagatacggtcacttaaaaaaccaccaagcactgaggataagtaaaccaatgacccgtaaatcgacatgatagaggcagcaagccccttgtccatgccaaggccaccctttgcaattgagaaatacatgtagtaaatcaaaattgctttcataccatagtaactgaaccgttcccacatttcagtcatgaataacgtagataatccacgtggctgaccgaagaatgagcggtctaattgcttgtttccttggttatccaaattcaagccctccagacatctctcactcaagcaataccatttatttaccgaagtgatgattaaaggagcgggaaccccgctcctcatagtattctaattgaaacatataggatattatacgccagaaaaggattcaacgcaatggcatttagggtataaaacactagctagcattgattttgcgagaaatgtgtctaataaaaaaagttcatttttataccttatttgtgttttaatttaacctacgactttattcttatctaattctgtcatagcaaatttaaccaagctttcaccattgacccaagcataaatatcatctgggattttttccaatcgtgagttaatattctttaaagctgcgtaatcgcaaccgacttgtggcgcaactaaaattaaatctgcagtctttaaaccatcattttttgcggcagcaacacttgttgattcaaacgtaatatcagcatggtaagcctcagcagatcgttgagcagtttcttgcaataattgactcgtaattccactagcacatacaattaatacagttgtcataatcatttacctccaaattttgcgttatgtattagcgcgttcattgtgtataggttaccaccaaaaaatgtataccacaagttaaattgttattgatttccttttattttagccgttttaacatctataccaattatacaagctagattatttgtggttttttagtcttcggtcaactatctatcgttacaaaagtgtacaaaaaaaggcaccaacgcagatgcgtcagtgctttttctcagttgaatagatgccggctgaggaattcgaatccccgaccctcggtttacgataccgatgctctaccaactgagctaagccggcattactaaaactaaattatgactccggcaggcgggctcgaaccgtcgacatcttgattaacagtcaagcgctctaccaactgagctatgccggaataatatatagcgtggcaacgtcctacccttgcagggggcgatcccccaactactctcggcgtgctgaagcttaacttctgtgttcggcatgggaacaggtgtatccttcaggctatcgccaccacactattgagaacgaaacgcaggtgggacctacaaccgtccagggtggaaggtggtgcggtaaaaagcgactggaaggcccgaaccccgtttgacgttgggggaaaagtgcttgggataggtgtgtggaggtaggccgggtatgaaatggcacaaacgatacttggagatagctgggttctcgactcctatccgtccgactatctttaaagtgctaaatccccttcaatagctctggtttctctctatctccaacattttgtttccctttttcaatcttttccctatcccaattttatcttcttgcatatcagccttcctcgcattccctccaacgtttataacttccgggatatcagacggtgagtgataaagatccatcgtcgaaagggaagaacccccccagaccaccaattaaggtccctaagttgtatcctaattgaaaaggcgtggagttgctagacagctagatttggctcagaagccgccatcattaaaagagtgcgtaattgtcactagccgtagtgattcggggcgcgaaatgtaccggggctaaggatatccaaccgacctgaattgtggatgcgaccaatatttcgcgtgataggagagcgttctagggcgtgctgagctagatcgcgtaaggactattggagcgcttagaagtagaatgccggtggagtagtcgaaagaacaagtgagaatctgatccaccgaatgactaaggttcctggggaaggctcgtctcccagggttagtcgggaccttaagtcgagggaccgcagagcaacgtagacgagcaaacggttgatattcctgtacagtaaaactgtgttgtaaatggagggacgcaagaggctaagccgtcaactgtttggatatgcgttcaagcagcaagtctggttgttagttaaatgctttcaatcatacggacaacagctgtgataggagccgaatttaataggaagtgagtatgtcacctccgaaaagcttctagtgaatagtatactacccgtaccgcaaagccgacacaggtagtcgaggagagatactacaggtgagcgaagtgaactctcgttaaggaaccggcaaaatacctacatgcacccccgtaactctgccaggggtgcttgtctcatagtgcaaccagcattgaagatctcctgcctaggattacataaataaacattttcttgcaaaatcgtaagatgatataggggctgacgcctgcccggtgtctggaagttaaaggtgagttacttcggcgaacccgaaattgaacccagtaaacggcggccgtaactataacggtcctaaggtagcgaaattccttgtcgggtagattccgacccgcacgaaaggcgtaacgtctgcactgtctcaacacgagactcggtgaaattaatcctgtgaagatgcaggtacccgcgacaggacggaaagaccccatggagctttacttagcttgatattggggtgttgacgcacttgtacaggataggtggagcctaaaagccaggaacgctagtttcggtggagcactggtggtacacccttgttgtgtgaacactctaacccgcccactagcgtgggggagacagtgtcaggtgggagtttgactggggcggtcgcctcccaaaaagtaacggaggcgcccaaagttcctcagatggttggaaatcattcagagtgtaaagccaagggagcttgactgcgagacagacaggtcgagcagggacgaaagtcgggcttagtgatccgtggtaccgtatggaagggcctcgctcaacggataaaagctaccctggggatacaggcttatctcccccagaggtccacatcgacggggaggtttggcacctcgatgtcggctaatcgcatccgtgcgtgtagtcggtcccagttgggcggttcgccttaaagcggtacgcgagctgggttcagaacgtcgtgagacagttcggtccctatccgtccgggcgtaggaaatttgagaggagctgtcctagtacgagaccggaagcctggacacgcgcagccgctggtgtatcagttgtgccgccaggcgcatgctgagtagctatgtgtggatgagataaacgctgaaagcatctaagtgtgaaactcgcctcagatgtgagatttcccattcctaatggaagtaagacccctgagagatgatcaggtgtgggctagaagtggaagtgcgcgaggcacggagcggactactactaatcggtcgaggacttaaccacgagtagtggatgttcatcgttgaaaactgtgacaatgttgtcataaagtttattgagatagcaccagt

SEQ ID NO: 706 - DNA, 533402 bp, Unknown
  Metagenome-assembled genome
tcaggggataaaatcccgattttattcagaaaaaaaggtttatcgagaaatcaaattttgatttcttcgataaaccttttttgaaagctatgatttacgacttaagtcacagcctctttttaagctagtattaacgcaccagtttgatcaactgataaatcgcataaattgtgctaatgccacaaattgcattggttggaatccaaacgatgttttctatgagtgtaagacctggggctacttgcagcgaccaaataacaacaaatagtccagcaagtaactctagccaagcaggtacagctttatggctatcctccgttaacaagtggagaagatactttgtttgcagcagattcttaaacaagatgaaattcaaaattgaaaatagcaggcacagtattgctttaacataaatgttaacatctaaaaaaaatgtagccccagctgctactagcaaaccgattagtaggattaaaattctttttattgatatgaccatgatttataagtaccaccttcaaattgaaatacacgttcttttaaggacgtgatgattgcttttcccgccattgtttgttggtaatgtgtttgaaatgagctgctaggcgtgcagaagtagtgctgcgccaacgatggtagttaaactatcgtcaagccttgaaaaagaagggttctattctaaagcagctgaatcgaattcattgctatcaagcggctttttatttccacttaaatcatcggtcatggttcatcttagatagttttctttttttacgagcattgagtacaagtaaacctaaataagctaaaatacttacaaaaaaacttattgaggttaggactgtcagccaaagtggatgataaaaaaaggtaataaatattagaacaaaaccaatcgcccccagagaatcaagacgccggttccatttatcataaggcttaataaatacttttgaaggctttgtaggtttcattgatgtgcctcgactatcttatttctttttcccaccagttggatacgagttcaagtagcgtaaaaaatattagtgtccctggaatcaactgtaatatggtcacagcatacgattttatcttatattgacctgtcgtaaacaaatcgattggtcccttgaataatagcgttattgcaatcatgaataaggtcatcatcagcgtatcaaataatattgttttggcaacttttaaccacataaaatactccttccttagaagaatgcaataatatagaaattctcctaaaattagtaaagctacttatttacatgagcacaaatctaatataacgatagagttgcgttttgaatagaaacgtgttgtttgcttaacggcgtgtaaactagtaatagccttggacgacaggtatcccttttaaacaaattgacacctataaaggctttgtttattaaaaaaattagcattgttatatgttattatcaaatggttaatgctaatgtaacagacaacgtggaggtatgttatgcaggaaactttaggggctcgtttacgggaggcacgaataagctctggattatcgcagaatgatgctgcaaccattatgcacatttcgaggcaatcattttcaaagtgggaaaacgaccgcggttaccctgacattgataacttagtctatttaagtcagttgtacaaagtatccatcgatagtcttttgaaagataataatgacatgaaggctaagattggtgctaataatgctgatatcagtgagaaacaaggacagttaaaaaaagttaatcgagacctgttccaaaatcgtgatgaaggtttgattttagttatgttggctcttatttcggcaattgtcccaccggttgggatactgctaccggtatacgtgatgtggcgaaatagtcgatataacagtctttataagacaatctatttagtttgcgctgtggttatattgattagtctctggggtacctggattatcatatctgacaacttcttccaaccacagacacatgtctatagggtaaactaatccgtaacatagactttggatctagagacgcttattttgatgctgctacgatatcgtattgcttggatgtgtcgtgtaaactgaatatgtgcatcgccaccagaataagtaatggtcttggtatcgatactacccgttggctttattgataagtttttgatggccgtgactttattatgattagccacaacgttataattaaggctccatgatcctaatttgcgttggctcacatgatatgtggcagcatacgctttagtggaaacaagcaacaacaatacaatgactgagctagtaataagtgttttttcataacgtaacctcctgaaatcgaggttacgtttatttttttgcacacataaggaacgcataatttacgggggtttacatatggtttacaacaaaagaggtaatcaatgcgttccttttttaaactgaaatttcagtgtaacttatagattgttagctaacttattcattgcgcgtaatgaacttatcaagcaatggatcaaataaagctgcaaaaataagtttagggaaaattatactggtagttttcatcatcccaaatacggacttgcaacgacaatcatttggattccaaataaagccaatgtaattacagcaatgacaaaatggaaataaaagtaggtggtaaaaaatgcaaaaggctgtatcaaatatcattttttgtttaggactattaatgctgggtttggggttgaattatacgttgtctaccaggttaattggtggtgcactaataatagtgggattaggattagacccaaaaatctggaactatttcaaacaatgaaataatggtaagtaacaaaaaattccttcgtatcgaaaactaaagtagaacattttcttcttggtaaataaaatccccctactctgaacagatgaattatattaattcatctgttcagagtagggggattttaacaatagctagtaagaaggtcgttttcagtttttacaatatgtgtgtttggaggaactgaaactatgtgattaatatgtgtgttgtgaaagtctgatattatgtgtcccatgtataggaaataaacagtttattttttctcaagactagcagatggctgaagattgaagagtttggtaattgcccagctacccaagataccgatcagcatgaatgggaagaagtccaagccttgattgaacagcgggatgaagttgccagcccaagcattgatggctttgaagaagcccatgttagcgaagaatggtggcaaggtgtgaatcgcatccaagaaagctggaatgaaggtcaagatgatcgtggtcttgtagatgaattggttcttgcccatgaatggatgtaacaaacctaagaagattaaggacattgctaatgggtagatgaaactaagtagtggtgtggagtaagtgatgatttgatccaaaccgaagttagcgatgataaaggcaccaatggaactgaaagtcaggaagaagtggtagccaagttttggaaaacggtggccccaatcttctgaaagggcggccatcaagccaatgcatgaagtgatgcaggcgaggaaggtaacggcaccgaggatggcgataccaatcatgccagtgtagtgagccataatgccagagaaggcagtcccaccatcagcacttaacttgaggtagcttaaactagaagcaccaagggcaatcaagaagatgtagatgattgcttcaagccccatgctgatagcaccaactttagcaaccgccttagaacgggcaccagtgtcgttcataccaaagtacttaagcgcggtaatgatcgtaacaccaaaacctaatccggcaagggcgtccatggtgttgtagccttgtaggaacccgttgatcaagttgctgccggcaccagagccagctgggaagattgagatctgacggatgtcgcctttgatgatgaaagccatgaagaagatgaaagctaagagagcaagtaagatggggttgagtaatttgccaacgtaatcagtgattttggattggttccaagaaagtaagagtgaaatgccgaagaacaagaatgagaagatcagtagtcccatttgatcccaagcctttggcaagaatggttgaatcccaatggcgaaggtagtggtggctgtccgtggtgaagcaaccagaatccctaaagtggcgtgaatcatgatcaggaagaagagcgcgaatcctttaccagctggtcttgcaaggtcataagcactgctgctgcgagttaaactaatggcgagaatcgataataacggtaataaaatagcagttaacagaaagccgatagcggaaggtccccagttgccagcggctagctgacctagatgaattgggaagatcaagttcccagcaccgaagaagagaccgaatagcaatgaacctaatataatatattgacgtttcgtgagtgatgttttcatatataaaacctcctgtgaatttggtgaaacaacggggtaataaaaaacgcccctagcttataaaagctaaggacgtgttatcgacgtgttaccaccttaattttcaaccacctcgcgatgattgactttgaaagtacggcaaaccgatgcgcggtcggttcacgatacttcattgctgtaatgggcgcattcccagtgaccacttcgaattattcgtcgcggtcacgacttgtagattactttcatcgctgggtcgattacctcgtcgcactaagtgaggctccctgtgaatcttgccagtgactactcttctacgcatagtctttgaaaaatgatttaaatatgtgtgaaacaaactttgtttatgtggataataatagtcaatggaaaattaaaagtcaaggataaaattagatttttttaatttaatgtgctgattatctcagcggtatttcattttaatagatgtaagaaaccggttgatactagttgtcaaaaaccgaaaaataagcaataatgatgggtaatatagagatggtgttttaatgagaaattatttgagacagaaagatgggataggtatgggagctcagctcagcaaccgaaagatgaatgttaaacgattagtcgttaaagttgggacgagtagcttggtttaccccagtggcggacttaatttaagggtgattgatcaacttgccttcgcactaagtacgttatgcggacagggtaaggaagttattttagtttcgtctggggcgattggtgttggcttaaacgcacttcggctgaaggagcgacccaaggagatcagtgagcaacaggcgctggcttcgattggccaaagtaagctgattacgatgttcaatcagcggtttgcccactataatcaaaccatcgggcaactgttgctgactcatgatgtgttcgattttccggccagcaaccaacacgttatggatacctttgaccggttattagccaaacacgtggtaccgattgttaacgaaaatgactccatcgcggtagatgaaatggatcatcggaccaagtttggtgataacgatcagttgtccgctattgtggcgactcacgtagatgctgacctgctgatcatgttgtctgatattgagggcttttacgatcaaaacccactgaaacatgacgatgctcagttaattccaacgattcatcacattgatgatgaaacctatgctgtagctggtggtcgtggcagccgttatggtacgggtggcatggtgacgaagctgacagcggcggaaattatgcttaaggacaatcgtcaaatggtgttggcaagtggcaaagaccccgcaattattttggatattttagctggtaaaccagttggtacctggtttactcccgaagaaaaaggaggaatgaacagtaactattctgctgtaaaaggatataaatctttgtaaagtggtgctgctatactattccatattcttataagactggcgaaagatatcacaaggctaaagttaggcgtttaattttctgtattagtttatagcttataagtagtgatttatatgaatttcattaaaaggcttttggggataaatccatcccgtataatatgagggacacctcactttggtgattaaattcaataaggcggaacaactgatgttactcacctataaagtcgaaattaagccgactgaaaaacaagcttggctgattgattgtcatattggtggcagtcgttgggcctataacctgtttctggatatcaaccggcagcgttatgaaatgggttattgctacttaaacgcttacgcctttagtaagtggtttaatcatgaatatcttgaagccaattctgatgatatgtggatcaaggaattatatgctaaatcggttaagcaggcttttattgacgctgacacggctatgaatcgatttttcaagaaacagagtggttttccccattggcggtcatttaaacgggaccaaggtagttattactttgttaagaacagtaaaacacagattattgcttgtcagcgtcaccgcatcaagttaccgaagcttggctgggtacgtttgaaagagtttggctacattccgacagactcagaacacttcgttatcaaacaaggccgaatcaaatttaaggctggtcggtattacctgacctgtttagtggaacaggctgagctacccaaattaggattgaccggtgaacctatcggcattgaccttggtctaaaagaatttgccatcttaaatgatggtactctgtatcctaatcagaataaaagtagtcgcgcaagacgcatcagaaaacgccttagacgcctgcaaaggaagttgtcccgtcagtatcttgcactgaaagctagaagacagaaagaagggaaatctgctactgatttaaatctagctaaaactcagcggaaagtgcaacgcttgtatcaacgtctaactcacattcaagctgattatcagaataagattatcgctgctgtggtgagaaccaaaccacagtgggtagccttagaagacttgaatattaagggtatgatgaaaaatcggcatttagctaaggccattagttaccaggggttctataatttcagaatcaaactgattgctaaatgccagcagttagacattccggtacacttaaccaatcgttttgagcctacttctaagttatgccatcaatgtggtcataaaaaagttgatttaaaactacaagatcgagtgtatgagtgccagaattgtaactataccgaagaccgtgatattaatgcggccctgaatatcagggatactgaaaactttgaattcgcctactaaaataggtttcaaagcatgtaccggtggctagccgggaattaacgcttgtggactatcatatcaactgtattagtgagtttcatgcgaggcaggatagggagaagcaagaatgatctataactttttataagttatcagtagcagctgttcaaaatggctaacgaaacgattaatatgactgaattagaaaaaatgggccagcttgcaaagcaggcggagacccagttggcgcaactgtctaatcagcagcgtaacgctggcttaacagccatggcggacgctttagtggcgaatgcggatacgattttagctgctaatcagcaggatttggcaaacgcaacggatctgaaggccagttttgtagaccggctgactttaacgactgaccgaatcagcgatatggctgaaggcatgcgccaagtggctcaattaccagacccaatcggcagtgtcgacaagatgtggaagaatgaagccgggttgatgattggcaagcagcgagtgccattgggcgttattgggattattttcgaagcccggccaaacgttacggcggatgcttctgcgttaagttataaaagcggtaatgccgtgatgttgcgaggcggtaaagaagccattcagaccaacattgcgattagtgacgtacttcgaggtgctttaaaggaattgggcgtggacgagaacgccgtccagttagttcacgatacgtctcacgaagtcgctaacgaaatgatggcattgactcaatatttggatgtgttgattccccgtggtggccgtggcttgattcaacgcgttgtttcaacagccaaagtaccagtcattgaaacgggcgctggtaactgtcacatttacgttgaccagtatgctgaattacaaatggcagttgatatcactgttaacgccaaggttcagcggccatcggtctgcaacgcggcggaaaagttagtgatccatagtgccatagctgacgagtatttgccagtgattgcagcagcgttggcggaccaaggtgttcagcttcgcggtgatgaacgggcttgcgccattgtgccaagcatgataccagcaacggatagcgattgggacgaagaatataacgatttgatcatggcggtgaaggtcgttgattctgaggacgaagctatcgctcacattaatgcacacaatacgaaacactctgaagctatcatcactgacaactatcaaaacggtcagcgcttcctgcagcagattgatgctgcttgtgtttatatcaatgcttccactcggtttacggatggttttgagtttggttttggagccgaaatcgggatcagtactcagaagctgcatgctcgtgggccgatgggactgcacgaactaacgtcgaccaagtacattatctatggggacgggcaagttcggaaataattaaaatgctttaaaggcctcgtgacacctcgtttaacggatgaaaatttgttaaaatgaatgtaaagaggtggtgcgctgtgacgattaagactaatcctgaacaattgggcatgcttaaatcgcaaatggatgaggcaaaccaaaagtctcattttgttattttcgagtctactgaattttctagtggcgataatttgcgattaatcaccgattatgaaagctttaaagaaattcgtaaggctcacgcagatcaggccaagatgcatattctgcaggacattgtcccaatcacggataatctggccaagtgggcaatcgcggaaagtaaagcggcacatcaaagtgatgatccggaagccttagccgacttggaacaatataccaatgcggttttgaaggaaaactttattaaagtgaatcaagaataagagcgtaacataactcggtagattccagaatttaaaacaagcaccgttccgatgggccttatcgggacggtgcttgttttaaattatattctagttaagaaactagatgaaatttttatcaatatagacttataccacaagccgttattttgatatacggtgaattaaaagtttcacgtgaaacaaactttaagctaacttaaagttacttttcaacgctaatttttctaaccgtttagctccccaagtaaacatttcttcaataatgggcattaaactttcaccggttgtcgttaagctataatagacagctttgcggttgttagaaatttcttcacgacgagtgactaggccatcagctactaattctttaagctgctgtgccagcatcttatgagttgcgtcagccaacaaacgttggatctggctaaaacgcatggtaccgtcgtgagataagtgatagatgattacaattttgtatttgcctgagaacgtcgaaagtgtgtattccttggcacaatcaaaatcctttttctggattttctcttgcgtgtattttctaagtgcgtcagtcatgtcgtcctccacaaagtaatttggaattcgtgagcgtgttttgcaggttaaaatcatatctcagagccgagaaagtggcaactaaaacgcactgggattctttcactagcaaaatcttcatgggcacaaaaaagtgcgttattgccggtttgctcgtaagccgtaataatggacttacaaacaaaggaggaagatacgatgaaaaaagttgcagttgtggttactgatttggtagaagacgttgaatttgtggaaccagtcaacgcaattcgtgatgccggtcatgaagtgaccgttattggatttgaaaagggtaccgtaaccggtaaacacgatacagccattaccattgatcagtcgattgcggatgtgaaaccagaagactttgatgccctttatattccaggtggtttttcacccgaccaattacgtgcagaccagcgctttgtcgattttactaaggactttttaataaccaataagctgatttcagcgctttgtcatggtccgcaattaatgattcagaccggcttggttcatggccggacgatgaccgcttatctgacggttcagcctgatctctattacgctggcgcccgtgttgaagatcagcccgtggtcgttgacggtaatctaatcactagccgggaacccaaagatattccggcatttaatcaaacgttgattgatgcactagcaaaatagagtggatatccgcacagcaatgattaggattttactgatgaaataaccgctattcaaacaaatacggcaaggcctaggcagaccatgatctgttgatagggctttgccgtatttgtttagagagaccaataggatgtttttaaattcaaaggtgattagaccagccttttcaagacgataattacggcgaaaaactcctataaattctttaaatctgtttggaaacgactagaacagacgttcaaatatgctatgataaaaccagcaaaatttgaagaggcccaagtacaaaccatttcgcagtttcgtgaatgatgtatagaaaggaaccaacacgatgacgttgcaatttgtaattggaaaagcaagtgttaaccatgaaaatagcctgttatcagagctggcaaaagcgcagcaggaacaccctgatgaccagttttattacttggtaccaaaccacattaaattcgagtctgaagttcaggtattgacacgattggccaaactgtctggaaatgacaatggtgcctatgcccagtcaggggttcaggtgctgtcgctaacccggcttgcctggttctttatgaaaaacgcaccggcttatcaactgccacgaatttcacaagctggcatgaatatgctggtttatcaagccattttagaccatcaagatgaactgcaactattcgctggtgaagccgatcgccccgggttcattagtttactgacccgtcaaatattggagttaaaaacgggccaggttagcgttttggacttagatcaagttgctaaagaaatgacggggaccagtgcggatttagacgccaaactacacgatctagtgttgatctacgatagttttgagcaggcgatgaccaataagtacgtagccaataccgacttgctgaatcaactgagtacatacttagaagaggttgatttaagccacgctcatttctacttcgacggcttttctcagacccagttctcagcgcaggaaatgaaattgttatcaacactgatgaagcgggcagctgaggtaaagattgctttgattcttgatcaaggtacgccaacaactgatgctattaacgaacagagtttattctaccaaccgtcacggacttatatgcggctctatcaaacagcaagggcgctatcagttcccgtgttacgcgatattaaagcaacaactgctcggacaacgccagagttgcagcaactagaaacttattggcaagcaacggctacgggcgtgacgtcaatgaaaggcgagacgcttcagcagactgatcagattcaaattattcaggctgataaccgttatgctgaggtcgctcgggtggcaaccatgattcgtcagttagtggcggaaaaagggtaccggtaccgcgactttttgattttgacccgtcacctcgatcaatacgaaaccatcttagcaccgattatgaacgcacaggaaataccttattttagtgatgtccagcaatcaatggcggaccatccgctggttgaactgattgacgcgatttttgagattaagcgcaagcattttcagtacgccgatattatgcggttactaaaaaccgaactgttacttcctaaaataggcgatggtcaatatatggcaattgatgcctttcgtgatgccctatttaaaacggaaaattgggtgttaaaaatgggctatcagggatcacgctggctgcaaaaggaagattggccttacgcccggcttcaaagtgatgatttaggcacagccaccagcgctgaccaagcaacctcggatcagatcaacggtattcgcagatttattcgggatacgctagtacctttctatcaaaaattggatcacgttaaaaatggccgtgaagcggcaaccttattagttaacttcatgactgaaaacggggtagttgaccagttaatggtttggcgagatcgcgccattgatgctggtgacttggtacaagcaggtcagccggaacaggtgtggcagacgttttgtgacctgttagatgaatacgttaccattctcggtgatcggctatttcagtcgcaggattttttgtcactattgcaggctggttttgagggcgccaattattctcagattccttcaacactggatcaagtgatgatttccgaaagtgggatcatccaaatgaacaaccgtaaaatcacgtttatgattggttccaccgataaaaccatgccggataccactttgccgactcacttgctgaatgaccaagaccgtcaaaaactgacgttgcctgagggtgaatatttaaatgatgatggcattatgaccttacaaggtgagccgtacatcaactatttagcctttatgacgcctagtgaacgcctgatttttacgtaccctatcaatgcgggtgatgatgagcaaaatcagatcagtccttatttggcgcggatacaaaaacattttaacttaccaattatcagtcacacagcaacgcctcaagctgatcagcaggatctgaccccctatctgggcgctaagcgggcaacgttgcgacatctgattcaagccagcaatgacagccgtgatcgtaacattcggttaagtccctcgtggcagtatgtttatcaagtgctcagtcaaggtgacacgcaagcgttaacggaaaagttattaggtagtatttcgtaccgtaacgtgcctgcgcagctagacgcggaaattgtgaccgggctgtacggcaacaccattaacagttcgatttcgaaactggaggagttctaccgcaaccagtatgcgtatttcttgaagtatgggttaaagctgcgtgaacgagacgagtttgaactgtcaccagccaacactggtgaatttttccatgctgccatggatcagttaatgaaacgggtcaacacggaaaaaattgatttagcggacttggatgaccaacagcttaacgagctgatcgatgagattacgggtcaaattctgaatgatcctaaaaacttgcagtacgccattttgaatagcagtcaccgaatggcgtttattaaaggacagctgattggcgtggttcgtcaaatggccgtgacgttccataagcaaagtcagtacaccccaatgcgggctcgaaagactgaagtcctgtttggccacatcggagcagaagatggtctaccaccgctggaatttaatttaccgaagaaaaaacaaattcgggttcgtgggaaaatcgaccgaatcgatacgctgaaattgccgaataacgaatacatcggcatcgtggattacaagtccagcgaacacacagtgaagttcaacgatatttacgaaggtatcgccatgcagatgatgacgtatctggacgtggtgcaaaaaaacatggcgctgattgctgatgatccagatgcgcagctagctggcgcactctacctacatttacagaatccgcggttacgtcccagcgacattaggacggatatttccagtgcgttgttggccaaggagcgctatgaaggcgtcttagttgctgatgacgagttgattcacggtctggaaccgcagttagcagtcagtgaagcggctaaagtttttccgtttaaattaaaaaaagatggttcagcagccaagtcaaactccatcattaccatggaccagctgcaaaatctattacagtataccgaaatgaagatcaccgaagccggcagcagtatttttgacggtcagatcgagttgaatccctataaaccgctgagtggtccaacagcgatgacgaattcgccatatactgctatcatgcagtttgatccaatgctgccggaaaatagttaccgggtacagacggcaccagcaaaagcggatgagatcatgaagcaaattgcggaggaggttaaacgccgtgaaatacactaaaagtcagcagcaagtgctagacacacaccaaactaatttactcgtatcagcttctgctggttctgggaaaactcgagtgctagtcgatcgagtgatcaacatgattttggcgcatgaaagtctggaaaatctcctcatcgtcacttttactcgagctgccgctgccgaaatgaagcaacgaatcgagaccgcccttcgagaacaaatcagtcaagctaacgccacggaacagcggtatttatcccgccagcttgcagttttaccggttgccgacatcagtacattggatgctttctgtcagcgaattgttgagcgttactactatttgattgacctcgatcccgtttttcggatcctgggtgatcaatctgaaagcgcgctactgaaagatgaagtttggaacgatgtgcgcgaacagctgtatcaagatgacgaaaatggggtatttaaacgtctggttcagaacttctccaacgaccgttcagatgatggcctcaccgacaaagtgatgcaagtctttcaatttatgggtgccaaaccggaccccagtgcgtggttaaagaccctagctgagccttatcaggtggatggtccgttaatggcaagtaaaatcgttcaagaacaactcttgcctttgattcagcaacagttggatacggctaaacgggaattgcagcagggacgtgatctggctgaagatgccgcaattgataaagcggtagcctacatggacaggctgctgtcaccattatcagagttcaatatggacgagctatcttggaatggtttgcggttaggactcaatgaatttccgtggggccggttaccatcaatcggtaaaaaatcggctgaatatgatgattatcaagaaatcaaagagacgtttgtttctcaccgggataatgctaaagacgcccttgaaacggcagctaaattaatgccgttacctgaagaagaaacggctgaagcgatgaataatagtcgagagattgttgaagaactagctaagactgtggaaaaattcgccactgcttatgatgctgaaaagcgtcgtcgacacgtgtgggagttcagcgatattgaacactttgcgctgcaaatattgcaaacggaaacgcccgaagcagttgcggtccgcgagcaattatccaaggactatcacgaaatcatgatcgatgaataccaggatactaacgaattacaggaagctatcatgaccacgttggcacatgatcatcctggtaacctgttcatggtgggggatattaagcagtccatctaccgtttcagactagcggaacccaagctgtttatagaaaagttcagccggtatcgagaagatccgaatgcaggtaaagaaattactttggcagaaaattttcgttcgatgaaaaacgtagatgattttactaacttaatttttacccagatcatggatgagcaactgggacagattaaatacgccggttcagctaaattagtgtatggtgccagctatccggacacattgccaaacgtggcttcattaatgatttatgatacagaagctgccagtgaagcgggtacggatgaggcgcctgatggtgatgaaggtcaggtgaccttgatggcacaaaagattcgggaattattatcccgagacactcaaatttgggatcggtccaagcaagagcttcggtcactgcagtaccaagacattgctattattgcttcaacgaaaaagaataatctggaaattcaggatcagtttggccgagctgatattccggttcaaatcaacgatgcgcaaagttactttaaaactacagaagttcaaataatgatgtccatgctgcaaattattgataacccgtatcaggatattccattggctgcagttttgagatcgccaatcgtagggttaaatgaaaatgaattggcttatctaagagtgagcgacaaaacggatgattactattctgccttactgcatttttacaatcattaccacgctgaatatgcaggtaatcagtacgcggatagcttgtatcctaagattgagaagttcttagaacagttgaaccaattccaaaccacagctcggcaaaagcagctggcgaccttgatctggcaaatttatcaaactactggttttctggactacgtcgccggaatgccagctggaccgcagcggcaagctaatttacatgctctgtacgaacgagctgctgactatgaaaaaaacgggtttaagggcctgtttcagtttgttcggtttattgaacggatgcagaaaaatgaccatgacctcgccgaagcaaaaaccagagccaccgaaaatgcagttcaggtcatgacgattcatggcagtaaaggactggaatttccagtcgtcttcttgctgaatgcttcgaagaagtttaaccttcaagatcttactgataaggcaattctcaataaccagctgggtattgggattgattattttgatcctgacaagcgggttgcggcaccaaccttacccaagttagtcatacaggcagctactcgaaaggaagcactggccgaggaaatgcggaagctctacgttgcactgactcgtgctgaacagcggctttacatcgtgggtgagtgcaagggccaagacagtttgctaaaaatttggagcgcagctaatcacgatgattcgctagttttgaatcctaatttacgcgagaagacgcacaatttccttgattggatcggtttgacgctcacgcggcacccaagatttgaactgaatccggagaaaaaggtgctaccagctttaaaggacgataaaacccagtttgatatcaacttctattctgcggatgatcttattggtatgggaccacgattaaaagctgaaacgggcgagaaatggttacaggatttaaaggaacaggcggctatttcagattacgcggaggtcgacgttgataaaatcgatcagttgatgacctttagttatcaaaatcaagctgagacgcagacgacggcataccaatcagtatccgaaattaagcggctgtttgaagaccctgatttgaagcagttaggggattatcagccagattggcaaacggctcaaggcggtaatcggtttgtgactcatgaacttgagcaacctgcttttatgcagaccattaacgcgccaacttccgcagaaattgggactgccactcatttgatttttcaggaattggatctatcaaaacccgttgacctggatgctgttcagactgtaattgatcggttagttgaccaaaaagtcatgcagcagccggttgcccagcgcattaagcaagaacaggtggtgaacttctttgccagcaaatttggtcagaccattttacagcatcaagatagtttaaaacgagaaacgccattttcactgttattgccggcaaaggacgccttcgcaaccgtgcatgatgaagacgccaaaatcttgattcacgggattattgacggctactttgtgactgaagagggcatcacgttatttgactacaagaccgattatttgcagtcaacggatagtggtattgaaaaaataaagcaccgttatgaaggtcaactgcgattatacgcactggcattggagaagatgctgcaacggccagtggctgaaaagtatctttacctactgtcgattaatcagctggttcaggtatgatggtctaggcttgaataaaagaaattgttatgggaacgttattcttgaaagaaaatcttaatcgaattgcaaacggaagcgtctgtttttcaggtcataggtatggcataatggcataatgtgaacagttgattctaaaaacggagagaataattttgagaaagatatttgaaagaattccaatttggttaatttatacggttacttttggctttatcatacttttttcttttggtgctttgcgcctcatgggacaaaccacgatttggaacatggatggtattacgcagcattatccaatattagaagagttttatcgcatacttcgcggaaccgggcatcagtcgttatttagctggtcgtggaatttgggacttggtgctgatcagatgaccaccttctcttactatgtggtgggagatccttttagttacctgattgcgttgttcccagctgataagattcagctagggtaccaggcacttaccattctacgtgtgtatgcagtggggctagccttcttaacttttgcgaagcagatgaagttaaaacgtactggtagtcttatttcaacactgatctatacgttctgcagtttttcgttctacgttgcttatcatcacccatttttcttgctaccaatgatcttcttcccgttactttgtacggcgattgataagatctatcatggtcaatcatttttatggttggtggcaattacagcaatcgttttaatcagtaacgtttattttgcttatttacttgcgattggttcgttagtatttgcgctagttcgttatctcgatcttaaacggaaagatgaattagttcgcacgctaccgaaatcgtttggctattttgtgctgactgtcgtcatggcattactgatttcaggcatgatcttattaccaaatattatgtcaatgcttaactcctcaaggtcaggatctagcatttttgcgaacggcttaaaactttatccggccatttactatatgaagttacctaacgtcattctggattctagcggttccaaaatgtactgggtcgttatgggaaccagtggactaaccctaatcgcaatcatgtggtcactgcggcattttaaaaagtatttgatgctcaatctcaccctaattttaattgcggttggattactgctcccacaatttgcagcggtgatgaacgtcatgagtacgccatctaatcgttgggtcttactggcacagctcccgtttgctctagttgctgggctatttattgatcacctgcatgaacttgttcccgccgactttaaatggtttatgtgggggacgttgctgttactggcattagtttgggtcggtaacgggtttattttcaaaatgcgggctcataatgccgtgatgtacggcatttacttcgtgacgttactagtgcttgcttatgggtttattggcgggcttaaaagtcagcgattaaagcttagtttatttgtgctagtagttgtgaacgctgctagcatgggacttggcttttatagtagtaaatacagtgacacgacatcctctcaactcagtcgtggtgtcgcaccacactggatctcgacgtattatgattatgcaaaccggtatctggcaaagcacgacaagagtttttaccggacaggagaaacgtctgattattacgcgctgaagacagcagggaacaacattccgatgctgttaaatatgcattcgatcagttcctacttttccgttcaaaacggtgacgttgatgctgtcaataaagagttacttaacagtgagaacaccatgaataaccccactcgaaacgttgataaccgaacgacattttcgtctttgctaaacgtcaaatatctctttgttcgtgaagatgaagtgggtaagtcgaaagttccttacgggtttgaaccgatcaaggataaagatgggcaacctatgatattccaaaatcaagctgtttataccctggataaccatactggtacagcgatttaccgaaacaagtacgccttgccactggcatatacccaaagtcagcaacttgataaacagtcgtatcagaagctttcagctagcgataaagaacaggcaatgctggatggcgccttaacggatcacaaagtaagtggtgttaagacggtcaaggctgcaacaacggcgaagacggttccgtatactgttaaaatgaactatctaccaattaccacggaagatcaggcaattgcttatcaagtcaaacatgatactggtcattcagttctttcccaaattaagtcgaaagaactgacgccaaagcaaattgaagcgtatgatcaaattgcaaaaacaaagaaaccgactaaggcaatcgctaatatgatgaagcaaaatcaagcgattgttaaaaaagatagtcaaactaatcaaaatggtttaaagaccatgacaagtgacatccttggtcaaaatgctgattatcaaatcacgctaaagaatccttctgcatataaaaatagtgaactttacattgaatttgatggtatcaaaactaaattcccatcaatttctgatcgtttagattacactgcgcgtcgatcaataatgggcgatgttccgttttcacaaggggctaaattgaactactggcgagactttatgaataaccagtacttcaattcttataatcttcaagtgacaactcagaacaaaggcgctaatatcctgcaattagggattaataatttgtcggattatgagaagcgcgataaagtcctgatcaatttgggatacgctaagcaagcacgaaagaccatcaacgtttcctttactaaagctaatcagatgagttttaagcacgtacgggtaattgcagttccgtttggtcaaagttaccgtcaaaagacgactcaaattcaaaaacaaggtcttaagcagttaaaggtaactaataaccacgtgtcgggaacgactgatcgcactcaggcaagtgtcctaaccacttccattccttacacgaagggctggcacttgacggtggatgggcgtagtacgcctactcaacaagttaataccgggtttgtgggggctaagattcctgctgggaagcatcagattcgattaacttatcaaacaccaggactgtcggctgggcgactgctttcggctcttggactagtgctctttggactaggggctatatggaacatctggcgctggttgcttcgcaggcgaacagatcgtcaaaagcaacaggcttaattcatatgtgatataaaaaggcttgatccttcaacttttattgttgaggaatcaagcctttttgagtatcgtttttacagaagcaataggctgattaaaacaatcagcatgaaaagcgctacgataatgagtggcagcgttgaatttaaagcaattcggtgatcgtgacgaatgctaatgataatgacagttagcagtgcaatcagtccaactgcaaacaaaatcattaatttaatttgcactgcggtatccgcaatggtcataggagttcacctcgctgactatttgataagtaactgataggcataacgaaccgcgttgtctcgttgcatgtgtacgataccacgataatcaaagccactgctggtaatgacgtgttgcatccctttattttccgggtgggtgtcaatgcgaatgtctttgaaccccagtaaaccggaaatcgtgataaggccggtcatcaacgtttctgccaagtgatgtccacgaaaattactggctacggcaattcggtgaatcgctgaataatgatcatcggtaccgctgatccattgaccatcttcaattttaaggtagttaacgtcgattccttggtgtagagcagcggttccagcaatcgtattattatagattaaaacaaaggtgatgccatctttgatatcttgtttaagggttgcgggatccggatagccatcctgccactgattaatgtgctgttcctttaagtaggccttagcgccactaataatggctgtaattgcgggtaagtctgcttgggttgcccgtcttaagtatgtagctgacatgttttgcctcctaatgaatagttagcctaaattctacccctttaatggctttttaaaaaggtctagtacagtgtaaaatgagggagaggtggttggaatgcagtatgaggatgttaagttagcaacgtttattgatcggcctaaccgatttattgcgcattgtaaactagcggatgaaatcgtcaccgtccatgttaaaaatactgggcgaagtaaggaactgttagtacccggcacgcgggttgcgttaaattatcagccaaagcaaacacggaaaacggattatgatttggttgccgtcaaaaagcaggggcgtcactggattaatattgacagtcagctgccaaatcagttagtaaaagaagctcagctgaatcatcatcttcaactaccagatttgccggaattaagccactttaaacccgaaactgtttatcatgattcccggctggatttttggggtcaaacgacatcagggcaagatctttggatcgaagttaagggagtgaccttggaaaataatggggtggctgctttcccagatgcgccaactgtgcgggccgtgaaacacgttcacgagttgacacgtgcggttcaagaaggagcaattgcttacttgctgtttgttgttcaactggattatgcacggctcatgaccatttatcggaaacgggcccctaaattagcggctgcaattgacgctgcacagcaagccggtgttcgcgtagtggcattggattgtcaggtaacaccggatacagtcacgttaagacggcaggtgccttttaatctgtacgctgattttgaagaggctaaatagctagggtagatatcaaaaagtcccacgaccgctgttaggtcatggggcttattttagcgcgtttagtttcggtgaacagacagtgcaatccccattccgccaccgatacaaatggcagccatgccggattcaagttgttcacgctgtaaatcatgaacgagcgttgtcagaattcgggcaccagaagcaccaacgggatgacctagggcaatagcgccaccgttaacgttgagtcgctctgccggaatttttaggtcacgggaaacggctactgattgcgcagcaaaggcttcgtttagttcataacggtcaaaatctgtgattgttttgttctgtttcgccaataactgtgaaatggcgtagtagggtgcgtaccccatgatgcttggatcgatgcccacttcctgatagccatcaagcacggctaaatagtctagtccagcagcatcagcggcttcctttgacatcagtaccaacatactggcaccgtcgtttaaaccggcagagttaccagcagtcacagtaccattagatttaaaagccggctttaagtgactaagggcttcaagggaggtatcgggacggatggcttcgtcttgagtcatctcagtggtagtttttccagctatggtgattggaatcatttcatctttaaagtagccagcttgagtggcagcctgtgctcgttgatgagaacgtagagaaaaggcatcttgctctgcacgcgaaacgtggtactttgtagcaacgttttctgccgtaattcccatcaaatcctgggtaaacgcatcgcgcaaggcatcgtgttcaatgccatccagtacttttttctcgccgtacttagttccctgacgcatatcgggtagtagataagggacgttagacatgctttcggtaccgccggcaagaacgacgtcagcatcgcccataacaatagctgattgcgccaaacgtatcgccttgattccagagccgcatacttggttgatggtcatggcagtgctggtgactggtagaccactattgagactgatctgacgggcaacgttttgaccagaacctgcttgcaacacgttaccaataatagtttgatcgattatttcgggttgaatttttgcttgctgaatagcggccttagcagccagtgttcccaattgaacggatgaatactttgctaattggcggcccattttcccaattggggtcctgaccgcacttaggataacgacttctttcatgattaacttcctctttaaattaaatatacgtttgataaggatacatgataatcgttaaaatgtctttagctttgattttgcttttccataattttaaaggtttgtattatagtagaaactttcatataatgataaaactgaattaggaggtagattatggcacggtttgatgaacagctagatagctggcttgaccaggttgctgaggtgccgcttgttaataatatgagtgaagcagatcagcaaaaagtaatcttaattgattcgctggtgttacaagtatctatagaaggttatggtaaacaaccttccgaatggacgacagaaatgtttgccgacttgttttttaaccgttttgtgaggttattggaaaatcacgaaaagcagcagcgattattcgaattaattccaacggcgatggtggttttattagacatcgttcaaccgcttcatcaggcgaagctagttagttggattaagggtaaccatgatcaacttgtacatttatatgatcctgttgccgataaattctattctcaactgactaaagcaatggcatcggctaatgtaaatactaataataaagaagaagttgcggcatttaccaagcaatatttgcgtaaacacccagcacaaagcagagcgttcttcacaaaggacgatggtcatgagaaatagatgtgggattgttttaatgtgttaactggctataaagctagatgtggcaagtatctagacaggtattgtggctataattcgtaactaataaatgtgattaccattaaaagtgattatttccgttgacacatggttatacggatgatatattagttaagttgcttcgcgaggaaagcacaaacgtgattataaataattataaattgtgtttgacattttccaaacaaagcggtatattaattaagttgcttgcgacagatatcaaaattcaaaattataaaattttaaattttggttgacaagttaaaaacaatgagatatgattaaaaggctggttcataagtgatcagctcagtaggcctttgaaaactgaacaaagttttgtttcacaaatgtgcagggtatgtcaatttcggttgatatcaaatgtaatttgcgaagtcaatttcgctagtaatattaatgagtcacaaacaatcataaattgagagtttgatcctggctcaggacgaacgctggcggcgtgcctaacatgcaatacgaacgcatcccgctgaatgaagtgcttgcactgattttcagcttggatgagtggcgaacgtggtggaacacgtgggtacacctgcccggaagcaggggataacactggaaaacaggtgcaataccgtataacaactgaaaccgcatggttttagtttgaaagatggttcggctatcacttctggatggacccgcgggccgtattagcctagttggtggagtaatggttcaccaaggcaatgatacgctagccgacctgagagggtaatcggccacattgggactggaacacgcccaaactctacgggaatccaggcagcacagtagggaatcttcacaatggacgaaaggttgatggagcaaacgccgccgtgagtgagaagggtttcggctcgtaaaaactctgtgttgaagaagaacacactgagaggtaactgtgtcaggtgttgacggtattttaaccagaaagccacggctaactacgtgccagcagccgcggtaatacggaggtgggcaagcgttgtccggatttattgggcgtcgtttaaagcgagcgcaggcggtttcttaagtctgagtgaaagccttcggctaaccggagaagtgcatcggaaactgggagacttgagtgcagaagaggacagtggaactccagtgtagcggtgaaatgcgtagtagatatatggaagaaaccagtggcgaagggcggttctggtctgtaactgacgctgaggtcgaaagcatgggtacgaacaggattagataccctggtagtccatgccgtaaacgatgaatactaggtgtggagggtttccgccgacttcagtgccgcaagctaacgcattaagtattccgcctgggggagtacgaccgcaaggttgaaacttcaaaggaattgacgggggcccgcacaagcggtggcagcatgtggtttaattcgaagatacgcgaagaaaccttacaggtttgacatactgtgctaacctaagagattaggcgttcccttcggggacgcaagatacaggtggtggcatggctgtcgtcagtcgtgtcgtgagatgttgggttaagtcccgaaacgagcgcaaccttattgtcagtgccagcatttagttgggcactctggcgagactgccggtgacaaaccggaggaaggtggggatgaggtcaaaggtcatcatgcccccttatgacatgggctacacacgggcacaatgatggtacacgagtcgcaaaaccgcgagggcaagcataatctcttaaagccattccagttgcgactgcaggctgcaactcgcctgcacgaagtcggaatcgctagtaacgcggatcagcatgccgcggtgaatacgttccgggccttgtaccccaccgcccgtcacaccatgagagtttgcaacacccaaatcggttcggaaccttcgggagccaaccgccttaaggtggggcagatgtgattaggggtgaagtcgtaacaaggtagccgtaggagaaacctgcgctggaataaaccgcctttctaggaataattacggaaacctgcacatgagacaaaaaattgatgtagtttgagaggtctactcgtcaaattggttctttgaaaaactagataatatcaattgtcttttatataattaatttcattattacagcccgagaacaccgcgtatttagagtttttttataagtttattgacttcggtaatactcaattaatccgtcacgtacagggatgaggttaagttaaaaaaggcgcgcatggtgaatgccttggcactaggagccgatgaaggagggactaacaccgatatgcttggggagctgtacgtaagcttttgatacggagagtgtccgaatgggggaaaacaccaatcatcttagtgcgaggattaacgcttagtgaagacatagctaagtattggcagacgtggggaactgaaaacatctaagtacccacagaagagaaagcattgcgattttcccatagtagcggcgagcgagtggaaacaggcccaaaccaggaagcttgcttcctggggttgtaggactgaacatttagtttaccaaagtaacagatagtcgaacggtttgggaagaccggccagagcgggtgatagccccgtagacgaaatttgttaccctcagtgcaggatcctgagtacggcagacacggtgaaacctggtcggaatccgggagaccatctcccaaggctaaatactccctagtgaccgatagtgaaccagtaccgtgagggaaaggtgaaaagcaccccggaagggcagtgaaaatagttcctgaaaaccatgtgcctaacaattatgtggaaagcccgttaatgggtgacagggccttttgtagaatgaaaccggcgagttacgttaacattgcaaaggttaagatgaaaagtcggagccgtagcgaaagcgagtctgaaacgggcgtttcagtatgttgatgttagacacgaaaaccaggtgacctacccatgtccagggtgaaggtgcggttaaaaacgcaaatggggcccgaacccgtgtacgttgaaaagtgctgggatgaggtgtggggtagcggttgtgaaattccaaacgaacttggagatagctggttctctcgaaatagctttagggctagcctcggaaagagaatcgtggaggtagagcactgtttggactaggggcccgtcacggggtactgaattcagataaactccgaatgccatagatttatatccgggagtcagacgggagtgaataagatccatcgtcgaaaggggaacagcccagaccaccaattaaggtccctaagtgtatcctaagtggaaaaaggcggtggagttgcatagacagctaggatgttggctcagaagcagccaccatttaaagagtgcgtaatagctcactagccgagtgattctgcgccgaaaatgtaccggggctaaggataccaccgaaattgtggatgcgaccataggtcgcgtgataggagagcgttctaagggcggtgaagctagatcgtaaggactagtggagcgcttagaagtgagaatgccggtatgagtagcgaaagatcagtgagaatctgatccaccgaatgactaaggtttcctgggaaggctcgtcctcccagggttagtcgggacctaagtcgaggccgcaaggcgtagacgatggccaacaggttgatatttgtactagtaagatatgtttgagcgatggagggacgcagaagggctaagccgtgcgcacgttggatatgtgcgttcaagcagaagtctggttgttagttaaatgcttcaccgggtagacaagctgtgatgaggaccgaatttaagtagggaagtgtggtgatgtcacgctgccgagaaaaagctctagtgagtatcttactacccgtaccgcaaaccgacacaggtagtcgaggagagaatcctaaggtgagcgagtgaacttcgttaaggaaactcggcaaaatgaaccccgtaacttcgggagaaggggggtgtgcacgcaaggcagccgcagtgaagaggctcaggcgactgtttatcaaaaaacacaggtttctgccaaatcgtaagatgacgtataggggctgacgcctgcccggtgcggaaggttaagtggatgagttagcttcggcgaagcccagaaatgaagccccgtaaacggcggccgtaactataacggtcctaaggtagcgaaattccttgtcgggtaagttccgacccgcacgaaagggcgtaacgatctgagcactgtctcaacgagagactcggtgaaattaaagtacctgtgaagatgcaggttacccgcgacaggacggaaagacacccatggagctttactatagcttgatattgggtgttgacacaacttgttacaggataggtcggagccgtagaaaccggaacgctagtttcggtggaggcaatggtgggatacgacccttgttgtgaacactctaacccgcgcactaagcgtggcgggagacagtgtcaggtgggtagttgagactggggcggtcgcctcccaaaaagtaaacggaggcgcccaaaggttccctagaatgggttggaaatcattcgtagagtgtaaaggcacaagggagcttgactgcgagacagacaggtcgagcagggacgaaagtcgggcttagtgatccggcggtaccgtatggaagggccgtcgctcaacggaataaagctaccctggggataacaggcttatctcccccaagagtccacatcgacggggaggtttggcacctcgatgtcggctcatcgcatcctggggcgagtatcggttcccaagggttgggctgttcgccattaaagcggtacgcgagctgggttcaaacgtcgtgagacagttcggtccctatccgtcgcgggcgtaggaaatttgagaggagctgttcctagtacgagaggaccggaatggacacaccgctggtgtatcagttgtgccgccaggcgcattgctgagtagctatgtgtggatgagataaacgctgaaagcatctaagtgtgaaactcgcctcaagatgagatttcattcctatatggaagtaagacccctgagagatgatcaggtagataggctagaagtggaagtgcagcgatgccaggagcgactagtactaatcggtcgaggacttaaccacgagtagtggtgttcatcggaaaagaaaatgatattgtctagttttgagagcaccagtctcaatagtgtggtggcgatagcctgaaggatacactgttccagttcccatgccgaacacagaagttaagcttcagcacgccgagagtagttgggggatcgccccctgcaagggtaggacgttgccacgcaaactaagacagtcatcgagaaatcgatggctgtctttttcgttatcattcgttatcaaataaaggtttgagacagataatggataattcaaattgaatacaaattaatttaggtcaaagtttattcataaacgttgccaaatcaacgtttatgaagtgatagcttgtgaactcaaaaaatgagacactcaggtattctgagaatatgatagaatagtaaggaagtgcaataattaattagattgaggggctcgaaaatgaaacgttatcgaggttatcgcttaaccttgggctggcagattatgattgggttagtgctagggattattctgggtgttgttttctaccagaataaaacagcgattacagcaatgcagaacattggtaacatgtttattaatttgattcaaatgattgtcctgccaattgtcgtttcttgcttgactgtgggtattgccaacatgggggatatcaagaaacttggacgtattggtggtaaaacactgatttatttcgaattaatgactacggttgccattattctagggttagtggtggcaaatgtttttcaccctggtgatttcattaatattcatcaactacattctcaagatattagccagtatgtttccacagctaaaacagctaaagcacatagtggtatctgggcaacactagtaggaattatcccaaccaatttctttaatgcacttagtaccggtgacatgatgccggtgatcttctttagtgttttctttggattagggactgcagcaattggcgagcagggtaaaatcattattgattttcttaaagccgtttctgaagtcatgtttaaagttacaaattgggtaatgcacgccgcaccaattggggtctgtgcactgattggggttacggttgcccaaatgggattgtcggcgttagcgccactaggatactttatcttcctggcttatgcgacaatggcggttttcattcttgttgtgatgggcatagtcggtcggctgttcggcttgaatatctttactttacttaaggttattcgtgacgaagttgttttggccttttcaactgcaagttcagaagctgctttaccacgaattattgataaaatggataaatttggtgttagccaaggaatcgtgtcgtttgtgattcctactggctatacgttcaatcttgatggttcggcgatttatcaatcgttagccgcgctgttccttgctcaggcttatcatattcaccttagcattggtcagcagattaccctattagttgtcttgatgatcacctcaaaggggatggcgggcgtgccaggggcctcattcgtggttctattggcaaccatttctacaattggtgtcccaatgtctggcttaacctttatcgccggaattgatcgtttagtagatatgggccggactgctgtcaacgtggttggtaattccttggcttcagttgtgattgctaaatcagaaagtgagtttaatgagaagcaatcaacggaatatgcggctacatttgataaaccgaaagcgtctccagctgaaagatagattaattaaataatagtttagttattaaaaagcgctctgataaaaaatcagggcgctttttcggtgccatctcaattggctgataaccgcaagtgaggttgattcccatcaagctatacttgtgattgtcgttaacaatatcgacagcgttatagtaattttatggtgatgattgacgtttcaaaatgacattcttacgctttatcgcgcaagttagccgttctaaaatctccccacgcagttccctacatggtgaagcacattttttagttgaccgacatttcactgtcaactggtcaactcgggcaccgagactcagactgctaacccttgctttcccaattcaatcgaatcataaactgattgcactaacggatacgttcaggatcttcgctaataatcagctgcaacaccgattacgaagaaaaatacagacttcaatcaatttattaatcattctaaaagcgccaaatatagggccgggaaagtaagatagcatagcttgagaatcagaaacggttaccgattactcttaaggtgagctatggcagctcgctttccctggcacgcgtgataagactgcgatccaggatcatatgtttctgttgtcatagatactcacctcccatgatggttgtcatgcgttagagagattaaaaaacgctcagccaacaatcggctgagcgcattaatttgcacacttaaataacctataaaggttgtttcgccaatcgttgagctttagcactatacggcgtagttattggataacagccacattagaccgagcctttttttaactcggacagctgactcattggcgtttttcgacgtttctgagcagtagcgttttccgtataggagcctcacctaacggcttattcaattccatacttaagtatacccgaattttaaaaaaataacaaatgatttgctggctaaatggccattgctttggttttcagatgctataatacagcgattaatgcgtccacttcgtcttcagtagttgaccaactggtaactaatcgaattgccgtatgcgtgctgtcaacgttttcccagaacgaaaaatcaacttgtttttttaattctggtaattgcttgttatcaaccacaataaactgttgattagttggtgaatcgatcaagaactgatagcccttatcttttaaagcttgtcttaatttcattgctaaatcgatggtgtgctggctgatctggaaataaaggtcatctgtaaacaaggcgtcaaattgaacgccaatgaggcgccctttggctagcatagctccttgtcgtttgattttggttgtaaaccgtttagggacgttatgttgagtaaagaccacggcttcacctgctagcgcaccaactttagtgccgccaatataaaaaacgtcacagtattgagcaatatcagctaaacttaagtcgttttctggactcatcaacgcgtagcctaagcgagcaccatccataaataaggttagatgattggttcggcaaactttagaaagtgcggccaattcctgtttgctgtaaagcgtgccaacctcagttgcaaatgagatgtacaccatacctggcgcaaccatctggccgtgattttcatcggcttgccaagcttccaaataagcctgaagattttttgcggtgactttgccgtcttctccaggaagtgtcagcaccttatggccggtatattcgattgagccagcctcgtgaaaattaatgtgaccagagtcagcagccactacaccttcatcaccatctaataagtttgagatgacgacttgatttgtttgagtaccgccagaaataaaaaagacctcggcgtctggcatctggcaggcagttttaattttttgagcggctcgtttggtatagtcgtcttgtccataaccgggttgggcatccatattggtatctaccaacgcttgtaaaactttaggatgcgcaccgcgagaataatcgtttgcaaaaggtaacataattttcctcttttctgttatgtaattagtgctatgtatagtttacgctatttttgacaattaggggactagacgttcagcatcaaccttaccaaaagaccttaaaagaactatacttatattgtggaataaaacgaaaaagttttgattaatttaaggagtgatctttgtgttacaaccaggcgttgttttgtttgatcaattgagcgatgaagctaaatctcgtgccactcacgactttattgatttttatcttagaaaatattctaccaagagtcttgaaatcttgacagattatccaattcaatacgagattgaacaagttaaccatgatattcaacaaaattctaatttccatccggaccaactccgtgattatttgtatcaaaatgatggcgaattatttgatagaattatttcatcacttgaccagtcatttatggaaaatggtgttatgactgaccaatcatatgatgaatggtatcagaaaaagtatgatgaaatttcaaagggcctttaatcatatccctttaaatacaagcaaaaaccgatgaatcctatcaaatagggtcatcggttttttgcttgaatgtaggttgataagtaggttagtccccgtctagggatcaattagagatgtcggttttgcctaataaaccggcttgatgagcaaaaagtagtctcaaaactactgttaaagcgtaacaatgttattttaaacggagcttaaaaatagaatcaagacgatatcatagcactgagcacatatgataggtataattaagagctataaacgagttcagtaattggaggatatttctatgaaagtatttgttattggagctaatggtaatgttggccgattgatcagccaacagctaagtgaaaagggagagaaagttgttgcaggtattcgggaacctgaacaagctgctttttttgaagatcaccaaattaaaacggctcatgttgatttactgggtcgaccagaagaacttggtgtcacattagacgggtttgacgccgttatttttacagccgggtctggcggtaaaacaggtgatgatatgacattgctcgttgatcttgatggcgctgttaaaagtatgcaggcggcccaaattgcaggagttaagcgctacgtcatggtcagcgcgctatgggcggaagatcgtaatcgctggagtgataccattcgaccgtactatgctgcaaaattttatgcggatgaatggttgcgatacagaaccgatttagattatacgattgtggaacccggggcactcacttttgatgagggtactggtaaaatcaacactaatggcttagaaggcggttcagtagctcgtgaggacgttgccagtaccgtcgtcgcttcactagaccaacctgggaccattaataagacgattccactgattaccggtgaaacaccgattgaagaagctttaaaaaacgtttaagcaacgggtatgtgcctatctttcagaatggtcagggtttatagtgatgaacagagaatcagagtgactattaatcatttttgaaagagggtgtttcaatgacaaattattctcaatggctaccgtatcttgcctacgtgtttctagtcatgataggaataggtacgttagctggtcaaaagcgaacggtaggccaaatggtgaccatcgtcacctttggcgtttacctagctattgtgggttatttgacgttaacaccaacttcatacgcatttggtaatgtaccgactatgcggccgttttgggtcggtaatgcgccaactaacccaattccatttcgtggaatcgagatagatttctatctgaatattttgatgttggttcccatgggtgtttatttaaaactgttgtgtaaggctgattttcggcaaattgccatcataggtgttttaattggtctaagtatcgagagcactcagttcattttagacagtttcctgcaaatgtcacggtgggttgatattaacgatatcatcactaacgcaggtggtgttgtgattgggtattcactagttttactgttgcagcattcaccgttaaagaaactggtgagatattttgattaggggcaaggaaacacgttcttttaaggacgtgacgaattgcctataatcgtggtaacgattataatgaacttggtagcgaaagccaagctatcaaagatagaaacacaactggcgcggaacatgccttagtaaatagccgtaacctctgtatatcaatcaatgattgatgtataagtaagcggtgttcctagaagctcgttactttagtgacgagtagttcaccaattagtatattgatattaactaaataagacaacaaaaaagcgaatggccgaaaatcgaccattcgctttttgtctaactaagttttattgttcttcataccatggatagtggaacataccatcgcggtcgacacgctcgtaagtgtgggcaccgaagtagtcccgttgtgcttgcaagaggttagcaggcaatacagctgaacgatatgaatcgtagtaagtaattgcggcactgaatgatggtactggaacacccatcttcacagctaaagcaacgacttcacgcgttgattcttgatacttcgcagcaatgtctttgaagtagtcatccaacagtaagttagtcaaatcaggtttcttgtcgtaagcatcagtgatgttttgcaggaactgtgcacggataatgcagccggcacgccagatttgagctaattgaccatattgtaagttccagccgtaagcttctgaagcaaagcgaagttgttcgaatccttgggcgtaactcatgattttactgaagtaaagggcctgacgaatcttttcgaccatttccttcttgtcaccaatttgttcgttagcctttggtgcggctaaggtcttagaagcagtcacacgttcgtctttcatcattgagatgtaacgggcataaacggcttcagtgatcactgattgtggtacttggacgttcaaagcatcttctgaactccacttaccagtacccttgttgttaccacggtctaagatcatgtcaacgattggcttagtcttgtcatcgccaagatcatccttacggctcaaaatatcagctgtaatttcgatcaagtaactgtcaagttcacccttgttccattctttaaagatgtcagccatgtcatcaacagaaatgcctaaaacgttacgcataatgttgtagctttcgtcaatgagttcctcatcgccgtattcgataccgttgtgcaccatcttgacgtagtgaccagcaccattagggccaatgtaagtgacacaaggcttgccatcttgggcagcttttgctgaaatcttttctagaattggggcaaccaaatcgtaggcttctttttgaccaccaggcattaatgatggtccttggagagcaccaagctcaccaccggaaacacccataccgataaagttgatccctgatttatcgagttttgcgttacgtgccatcgtatcgtggaagttagtgttaccaccatcaattaaaacgtcacccttgtcgagtaatggaattaattcatcgataacagcgtcagttggcttaccagctttaaccatcaaaagaatacgacgtggcttttctagtgaatcaacgaattcttcaatcgtgtgactaggaaccaagttcttgtcgctgtgatctttcatcacctgatcagtctttgaagctgtacggttataaataccaacagtgaagccgcggctttcgatgttaagggctaagtttttacccataacggccattccgacaacaccaatgtttgctaatttatctgccattacaaaccttccttttaatgaaatattaattgtagcacagtcctagtttaacatttcacaattggaatgtgaagaaacagcttcgatttgagaaataaaaaagtaagtgataaacataatgttttgttgaagtgaagtgctttcatataattaatagcagtataaaactaataaaatttcacaagccactatctactttaaacagcgttaagttactacgctttcacgcgtaattaaagggtgatttaattgttagatttctccagctgcaattaaggcatcaacagctttgacaacggccgtttcacttgaactgattggttgccagccaaggacttgttttactttttgattgctaacgtgagtcgtaagggccatcattaggcgaccttctttagcggcatcgttaaaatgggcgccaagcttgatcacaaaatccggcagcgtcttggttggtaatttggctgccaactctgggtggtgtttacggatgatcttaaccatgtccatcattgatagggcgtcgctatcctcaatcgccaagaagcgttgcccgtttgctgccggtgtcgtcatagcacgaacgtggatatctgcaacgtcgcggacatcgaccacattaatatgaatgtttggcactcgtttcactgatccatcaagtaaatttttgacgattccaaaactaccagaaacgtgattatccaaggatggaccaagcatcgcgccggcgttacagtggtaaattctaaggcgctattagtcgtttttagataattccaagcggccttttctgcgactaattttgaacgttcgtacagtgagagacctggttcatcagggtcggtccaatccgattccgttgtaatatgctgaggatccttattgctgaaaccgacagcgccaaagttaccggtcatgactacccgcttaacaccggccttttcagctgatttgatgatccgcagtgtcccatcggtagcaacttgtgccattgcatcggttccttgcttgccgttgacgaaaacgggtgccgcgacactcattacgtacgtcacgtctttcatagcagcaggccaatcagcgtcctttgttaaatcagtttgaacgaatgttaattgatctaaatgaggtgtttggttgttctctaaagttgttttgacttgatctttgcggtttaggttacgcagagtagcacgaaccgggaagccagcagttaatagttgttgaataatgtgcagtgctaggaagccgttgccgccagtaactaatacgaggttattatgtttcattgtattcatcctttgcttgtgttctttagtgacttaagttagtatggctatactaaactctagacattactctagggcaagggtaaaaaggagttttttaatgacttaggcaaattctataattaatccgaacagaaattaaaaagcccaaagcaatcacttacaatggtagtagctaattccaaccaatatagggagtgattactttgggtacatctactttatcacgtttttcattcacgtggcgcactagcacaactggtcaatgaggggaataaatcttaccagtaatggctgacgccttaggcgtcgccaaagctacgattagctatgagttggaccgggttaaaccttatgatccagaattagctcacaagatgcaatcgcaaaagcggaattgcggtgtcgttcgatgctgacggcagattacgactttaattaccaatcacttacgattacctggtcaccagaaaccattgcggccgcttatacttgagcactgcgtcaatttataattggcttaatcgtggctggctccccttcaaattgactgatctacccaatcggaatgtccgccagcaccgagtgagcgaaaatcgtgggaaatttacaagtgggacttccatcgaacaacggccaacaactgttaatcaacggttagcttttggtcattgggaagtagatacggtgctttctattcgaagtgagttccgatctgtctggttacattcgagaacgtagacccgacttctatgggccatcaaagcccctaatagaacggctaaggctctaaacaccgcctttggcaagtttatgggggccttcggtcccaagtaaaatccattactgttgatcatggtaaagagtttgccattatcaggccttagaacggatttcagatcaaagttatttttgccatccatattcaccatgggagcgaggttccaatgaatattttaatagacgtgttcgctggttctccgaaaaaccaattttagccaaacgactgatgagatcctagcagcacttgaactaattaatcaacgaccattaaaaatacatcatcaacagactgccattgaaagattccgggcttgttcggattaaacttgtaatttgccttatacaattaaagaagtatcagagaaaacagaaatttcaatttataccttgcgattctatgataaacagggattattacccttcgtggcaaggaattcgtcaggctaccgggcatttactgacggtgatttaagtctgattcatacgatcagctgtttaaaaaataccggtatgacgattaaggatattcgtcggtatattgattatgtgatgcagggtccggctacgatccagcaacgaataacattattatcggaacacagagaaaaggtggaagctcggcagcggaaaattgcgcaaaatttgcaagaaatcgattacaaactaaatgtctatcaatcaccgaacgcagtggctacggttaccaaggagcagcagtttgttcagcaagaaaagactattaaccagttacctaatccgtatgcgaaaaccattctctcaaagtagctgttttttaaaattcggtacaaaaaaactcgtaattccaatcacggaactgcgagtttttgatttaaatttgattaattacttgtttaagcgatacacccattgacgatgatcacgttgaatcagttcgtcagcagatgcagggcccattgaacctggggtgtagttagggaactgtggttgttgcaagtcccaaaccttacgaatttggtccacgaagcgccatgcgtaggaaacttcttgccagcttgagaagttggtaccgtcacccttcataacgtcatgaagtaaacgttcgtatggttctggtgttgcctttgaatccttagcatcaacgaagtagtccaaattgattggttcagtttggaaaccttgaccgttagtcttagcgttcagacgtagtgagaaaccagcatgtggttcgatgtacatcgtcaaaacgttagcttcaagcggtgcgttgtggttttgtgggaatgagaagatgtcgataagtggctttttgaagacaacatccacgcgagtgaacttgtcagccaacatcttaccagtccggatgtagaatggggtacctgaccaacggtagttatcaaacaataacttaccagcaacgaaggtatcgttgtttgaatcatgaggaacattgtcctcatcacgatatgcgcgttggctatcgccggcaccatattgaccacggacgaagttagttgaagcttcagcaacgttgtaaactcgaagtgaacgcaatgccttcactttttcagcacggatatcaacatcggtgaaggaaacgggttgttccatggcaagtaagctgacgatttgcataatatggttttgaaccatgtcacgtaaggcaccagagttgtcatagtatgaagcacgttcttcaacacccagtttttcagataaggtaacttggatgttgtcgatgtaacggttgttccaaagagattcgatcaaagtgttaccaaaacgaacagcttcgatgttttgaatcatttccttacctaagtaatggtcgatccggaagatttgtttttcatcgaatgacttgcttaaggcatcgtttaattgtttagctgagtcaaagtcacgaccgaatggtttttcaatcacaacacggtcgaagccgtcagtatcagttaagccttcagtctttaagaaaccagcaacagtgccgaagaatgaaggtgcaagtgaaagatagaagatccggttgccgttcaattcgtacttcttgtctaattcttctgcacgttttttcaagacttggtaatgttccttgtcggtaacatcatgtgcttcatagacaaagtgtgaaacgaacttttcagcatctttatcagttttagcggttccaagtgacttacgcacttggtcccggaattgttcatcggttaatttttcacgagaagttccgaggacaccaaaatgttctcttaaagttccctttttatataagttatacatggaaggataaagtttccggtaagctaggtcaccagtcccaccgaagaagataaatagtgaagttctttctgcagccaatacagtcactccttaaattttatgaggtaaagtagtcattgacgaatgcgccgtagacaaaacaatatcgtctagaccactcgtgtcgaaattattatataacaaattcctagtaaaaaaagggaattaagaaaagtttcttgaacaagttcatcactcaaatgaaatatcagctataaagccttatgaaaaaagatttcatataaaacgacaattttgaaagaaaattttagaaaacaaaatatcaacttgtaaatgaccttcattttacctgaaacagctcaacaagccaattaagaactctcactttaacgacattgtagaccattaagcatatttgtgggctagtttagcacccgcagcagctgcgatagccgcaataatatcgtctaagaaggtattgactcccttaccttgaactgtatctaatcgctttagaataccgtgtttttcacgatcgaggtagccaaaattagtggtcgcaatcttaccataaataccggagatgcccccttcagccagcagttcatctacaccgaagacccccgcgtcgttttcaacgatgctttgcaacggttcgggcagttcttttttagttgctaattgatccagggcaatccccaccatggcattgttcatgacttcccgtttatgaagcacgtcgataacggctgacatagcttcttcttccttcagttcggggatgaattgcaactgcatctgataggtgatcgacgcaatgtcctcgagcttgatatttttgctttcgaagtaagcgatgatactgtcataggcggcagtatctggatacttaaagtttcggttattcaacttcatcatcctttcgaaaagacgttacttccagtgtaccaaaaaagggagctgataggtgtttaaacctgtaatagatggtaaaatagaaacaatttagtcgcatttagagaaggggtggcatcatgggcgttattcgaattaataatctaaagtttcatacctttaacggtgtatttcctgaagaacgaaagaatggtcagcaattggctattgatgttgccttgaactatccaattgaagctcgggttcaacatgatgagttagacgaaacaattagctacgcggatgttaatactaccattgataagtttgttcatacgcattcttataagttgattgaatcacttgctaatgaacttttaaagctgttgttaaaggattttccaatggcgaccaagatcacgcttaaaattcgtaagtacagtgttcccatgccaggaatttttgataatgtcgaaattgaagtgtcaggtgaaaatcgtgagtgagcaagtttatttaagcatcgggtcaaatattggtgatcgattggccaacttaacgcaagcagttaacttacttcaagctgacccagctgttcaaattaaagccgtttcttcggtttacgaaacgcagccgtggggcaatttgaatcaagctaatttttataatatcgctgtgtcactcaccactgcgcttgatccgcaagcgttattgactttgcttcatgacattgagcaagcaggtcatcggcggcggttaaagcattggggaccccgaacaattgatttagatattgtctattggggtgatcgccagattgagacaccggacttaactgtgccgcatccacgggcatctgaacgtaactttgtattactgccagtacaggaaattgctggtcatgatttgaaagtgaaggtccaagtagaggctgccttacagcaaaaagcagatcagagttggattaaaaaagtagaaggggtcaccataaactatgataaatgacgcaaatcagaaaaaaattgaacaagcagtaaagatgattttggaggccgttggcgaagatcctgatcgtgacggtctcgttgaaacgccgggtcgtgttgcccggatgtatagtgaagtcttttcgtcagttagcgcgccggcatttgataactacaaactctttccagtggacgaaaccaccgaaatggtgctgatcaaagatatttccttttactccatgtgtgaacatcacctgctgccatttttcgggacagtagacgtggcttacatccctaaccatcagcgagtaatgggacttagtaagattcctcgattgattgactactgtgctaagcggccaaacgtgcaggagcggatgacggtcaacattgctaaagagctgacgcggattcttgacccacaagggattgcagtctcggtctcggctcggcatatgtgcatggaaatgcgcggtgttgaaaaaacgggcagtcaaaccgaaaccagctattacactggtgcattcaagactgaccatgaattaaaacaggaattcttgcaacgaattaacgggtgatggcaatgaatcaaaacactgttcatgatatgtatgttcaattaattgatcagttcaatcaagcgcggttagtgggcgataataaccgggtaccgttactgcggaaaattgtggccgctctggacaatccggatcagcactaccatgtcatccacattgctggcaccaatggtaaagggtctactggcgcaatgttgagtgctattttggaggcgcaaggttatcaagtgggccggtttaacagccctgctattttaaacgaccgggagcaaattcagtttaatcatcagtggatcacagaagctgcctttattgatagttataacgaaattaaaccggtggtgaagcgacttggaatggccaccactgatatttcaatctttgaatggcagtttttgatcagtcttatttggtatcgcaatcaacgggctgactacgtgattttagaagccggtctgggcggtttaacagatgccactaatgcaattagtgcaccgcagctgacggtgtttacgaagattgccatggaccatatgcagattttgggcgatacgctgacgaagattgcaactcaaaaatcgaagatcattaagtccggaacttccgtggtaaccctttatgatcagaaacctgaagtcttcaaggtgctacaaaatgaagcgcaaaatcaaggggtttctttgaccgctcccaaaacggaagctgccgttttagctcgtagtttcactggtatgacagtcgatctacatagcgatttatttaactggtcagcgcttaaactcaatctggccggtgattttcaggtgcagaacttaaccctcgttttaacggcagtcgcagtgctaaagcgacatcatgttcgcataacggatgaagctgtgagagctggtttgcagcaaattcagctgccagatcggttaacagtcatctcgcagcacccactaattgttgttgatgtggcccataatcctgatggcatgacggcgttgacaaatagtctaaagcggttagcagaacagtattcactgacgtgggtggtgggttttttagccgataaagcagtgacacctatgctgcagctgctattaccattggcaaaccatgtgttgacggtcacaccggataatcctaaacgagcgttacccggcgatgagttggctagtcagatacggatcctttctcctggggttgatgttcaggtgatgtctagtatgccgcaagccatgcaaactgctcgggaaacactgccccaaaacggtatgatcgtggtggctggatccttttacgtggctcgcgaactagcagtgatggaggctgagtatgactgaatggctgattgcatcaaataatgagtttaaaacacgcgatttgattaaatgtttggcgttctatgggattcaggcaattccctatacaaatgagctacctaaattgaagtttccagcagaacaaactgacagttatgcggccaatgcattacataaagcccaatttttagccaagcaaacgactaagggtgttatcgctgatgatagtgggattgaagtcaatgcgcttggtgagcatttaggtgtcaccaccaaaagggaactgcatcaagacgtgtcccatagcgataatcaaaccattttaaacgctatgcagggtcagaatgatcgccgagcgacaatggtcagtacgttggtggctattgcgccgggtcaagcaccggtgaccgcagttgggcgtgttagtggtaccatagcaacgcaaacccgcggaacgaattccaccggatttgataaactatttattttaccccatcagcaatgcacactagctgagatgtctgatgagaaacgattaccactgacccatcgaggtcgtgcagctaagcaattagcggcagaattgagaggagtttaattcatgcaaattcgagaattgactgaccagtttcaagaagcgactgattttcagagtcaggccttgtttcagctggcccagcagcaacgattgattgcgctgttttttacgtcacttgcagtgtcagaacagacggaactgcaaaaacggttacgccaattagatgctgtgatggtggtgagcgacggcgatatttttggactattaaaactaccggcactgcgggtgttgactcagcattggccgacttggttttcggatgatcatactggtgaacaaaccttaaagcgaattttgaccaagcacgatttagattggcaggttgctggtaaacggtttaaacttcgtgatacctcaatgatttacgggattatgaacattacgcctgattcattttacgatggcggtcggtatacgaccatggatacggtgctggctcacgtttcggaaatgctagaagcgggggcagacgtcatcgaagttaatggtcaaacaactcgaccagggtacactgaagtgacgcctgaagttgaaatggaacggacgattccgtacattaaagcgattgccagtcattttcctgaagcggtactggctattgatacttataaagtacccgtaatggcagccgctattgatgctggagtagcgattattaacgatgtgaatagttttacggatgatcctgccaagttaaaattgatgacgcaatctaatgtgggcttattgacgatgctgaatggccgcaactttgactttaaaatcatgacggatgaagcccatcagttttttgaagataatttaaatactctcactgcggcgggaattgatcgtgaccgtatcgccattgaccaagggttaggctacgctaacgttcaggttaaaaatgacgatcaagattacgtcatcatgaataatactgatcagttcaatgaccttgagcggccgatgatggtggccgtttcgcggaaaggttacatggctaagttgttgggcctgaagaaggatgaacgcttaccgatgacgttagtgagtgaagtggccatgattcaaaagggtggtaaaattattcgtgtacacgatgtgaaagaaacccgtcaaatggtaaccttgcttgatcacatcaatcagggttactggttagcctagcaatctcgactggcttgttgcttgtcaggctaaaagttcacaaagtgagaatacaataaaatgttgactaaaatttctcaatatgttttaatgaaaacaatctaaatgagaagggatcaatgacaatgacgacacagttagctcaagttaatgcgtattggtacggttattactttagttagcgtccgcaactttaaatgcggacgctgaagcaatcgcgttcgcgtctaaagcaagccgtcaatttgtcgtgccagctagacgtgaagatactagctggaccatggttgattccataaaggaagcaatgaagccagctaggttgtctagctggcttttttcgtacccaaattaaggagtgactaaaatgatggaaacaaatgaaaatgattcaggcgcgtggcaacccaatgaattaaccgccgcccgtcagcagatcaacgatattgatgaccagatcgtgaaacttttagcacaacgctttgaggccgtcacgaaggtaaatgaagctaaggcagctgccaatctaccgattatggatcacaaccgggaagaccaggtactcgaccgggtgacaagcatggatcctaatccggaaacgaagctctatatgcgcaatatttttgcaaccatcatgaaaaactctagggactatcaagactacttaacaaaaactaaccaaacacactaaaaggggactataagatgaattatttaacagcgggagaatctcacggaccgcaactgacagggattattgaaggtttaccagctggcttattgttgaatattgacgccattaacgaccagttagctgctcggcaaggcggctatggccgtggcagtcgtcaaaaaattgaacacgatcaagtgaccattgttggtggtgttcgccacaagaagaccatgggctcaccaattgcgctagtagttaacaatcgtgatcatgcacattggggtaaaatcatggacccggtggcggatgagacggcggaaaattcactgcgaacggtggaacgcccacgtccaggccacgctgatctggttggtgggatgaagtacaaccatcgtgacctgaggaacgttttggaacgctccagtgctcgagaaacagcgatgcgagttgccattggtgccatctgtgaacagttcctgcagcaactaggaatcgacattgtgggctacgtccagcagattggtcccgttgctgcggatgatcaatcaccattagatgttgctcaaatcaaggacttaatcagtcaaaatgatttacgtgtggtgcaagcagataaagtcgacgaaattcacacgctgattgataaaacgaaaaaggatggcgacactctgggcggtattgttagagtcgtagccaccaacgtcccagcaggattaggcagctacattagctgggatacgaagttagatggtaagattgcagccgcggtcatgggtgttaacgccatgaagggtgttgaaattggtgatggcttcaaggcggccactagttttggcagccgagtgatggatgagatcgactggcacgaaggtgagggctttacccgtgaatccgatcacttaggcggatttgaaggtggcatgactaacgggatgccggtgatcgttaaagcggcgatgaagccaattccaacgttatacaagccactgcaaagcgtcgatgttgaaaccaaagaagtcaagaaggccagtgttgaacgctctgataccacagcaatcgtacctgcttccatcgttatcgaaagcgtggttgccattgaattagccaaggccatcacggataccttcgatggtagtaatatgacacgtctaaaggcccagttgaaggcttaccgagaagaactgaaaaactactaagggggatcagccttgagaacactaaaaagtcaaccagcaaagggattgcatggtgaattgacggttcctggtgataagagtatttctcaccggggtattatgttaggggcaatcagtgaaggtgccactacactgacgcattttctgacttctgcggactgcctatcaacattagctgcttttcagcagttaggtgtaccgatcgaacgcgaagggactacggtgacggttcatggtgttggtctgcacggattaaaggccagtaaggaaccccttgatatggggaattctggtaccaccactcgactgattatgggcctattagccggtcagccatttagtacgaccttgattggcgatgcttccttgtctaagcggcctatgcgacgagtgagtgatccgctggcggccatgggcgctgacattaccaccacagatgggcatttaccggtgaccatcagcggtgaaaaattgcacgcagttgattatcagcttaaagtggccagtgcgcaggtgaagagtgcgctgattttagcggctttgcaggcagatgaaccctcaacattgacggaattgttaccgactcgggaccatacggaacggatgttgacagcttttggcggcgagattactacggcgtctgatgggttaaccatcaccgttcagccacagccgcagctaaagggccaatcgatgacggtgcctggtgatatgtcatcggctgccttctttatgacggcggcgagtcttgtgccagaatctcaaattacgttaaaagatgtcgggctgaataaaactcgaactgggttactggatattttaaacgccatgggtggggatatttcagtcgaatctgagcctactgacggcgaaccgattggtgatctcacgattcgatcggccaatttaaagcccatcgatattggtaaggcgcaaattccagcggtgatcgacgaattaccactggtggcacttttagctgccaaagctgatgggatcagccgaattactggtgctgaagagttaagggtcaaggaaactgaccgtattagtgccattgtgactgagtttaagaagctaggcatcgatattgaagaattaccagatggcttcgttattgatgggcgcaaaccgtggcacgtcgttgatccagttctagatgctcatgatgaccaccgaatcggtatggtgcttggaattgcagcgttactggttgatcaacctttgcagttgaagggtgctgacagtgttcgaatttcctatccagaatttttcgatgatctagacaaactactgtaatgaggtgattggcatgacaacggtattgataagcggtttggggctgattggcagttcattggctcgaatcatgaagaaaagtgaccttcagcctacaattttgggggacgatcccaacgacgataccagtcagtttctgctgggtcaggggatcattgatgaacgggtgacgctgttaaaagcagcttcacgcgcggacatcattgtgctcgctggcccagtttcagtgattattgatcaattagcacgattagctaatgtaacattaaaaccaggtgtgctggtgacggatgttggtagcaccaaaacgcaggtcatggtggcgtcacagcccttacagcagcaacacgttggcttcatgggtggtcatcctatggccggctcgcataaaacgggtggccgagctggccgggaagatctatttgataacgctacatattttatcgtcgacggttcccagaccgcagcccaaactgcgcaatttaaagcctgccttaagccagcaaaattacgctgggtgaatgtgcctgctaaggcacatgatggcttagtcagcgaaattagccacgtaccgcacgtgttagcagctaacctggtcaacactgctgatcatcagttaaaacatgactcagttggactcagtgccgctgcgggtggctttaaaagtacgactcggattgctgggtctgacccgaccatgtggacagccatcatgctaagcaactctgaggccgttagtgaacagctaacaacttatatggatcagttaaagcagattcaagaagccattgaaacgcacgataccgaaaaaatttaccaattctttgcgcatgccaagacagttagagaacgtttggatcaaggggagacgaaacaatgagagcaattttagttggtttcatgggtagtggcaaaaccactgtcggcgagctgttagcccaacggctgcacctcactcatcgagatttggatgacgtgattgtggaacgtgctggcaaaacaattcaacaaatttttgacgatgaaggcgagactgcctttcgccaactggaacacgatgttttagccgatacgctggtgaacagtaagggtattttatcgacgggcggcgggacaccgattcaaacggcgaactatgagctgttacgtaaaagcgatgtgccagtcattttgctcaacgttaagccggagacggttttgtcccggctatcggatgatgggcaacgaccgttagtcaaagaacttggtgtcgatggcttacttggtctgaaacaaaagcgggatgccaggtaccatgaagtgagcgatgtggaaattgatacggatgatctcacaccagctgaagttgtggatgaaattttagcaaacgttcattttaaaagtcacagtcacgatgctgtataggtgatttcaagatggaattaattagtatttcgttagctgaattggaccagatgaagcgtcagcattacagtgatgggacggggatcaattatctggtcaataaaagcccatttcgagaaaatcagtatggtgttcacctagagctagtagacagcgatggtaaagtgtatcaaaaaattgaagtgtattttaaacctgatcagttaatttccgaaccctttgaggccaatggacggcagtatcgaataacgttggttaagtaattttggtgcggataatggatttgcaaaggtaactaaaaaacggctagtcatcgattcccattccggaaaccgatgactaaccgtttttagttgctattagtctttgactgcgttaaccataaagagctgtgacttaaaatcaccctctgaagcgccttgcatcgcgtcagggtgaagcattaggccagcgttcattaattcagcgccataaaactgttccgttaattgattgacggtatataactgatcaggaatcaatccccgaaacttcaaccgttggtatggaccgttaggatggttcaagatttgataccagccagcaacggccttttgctgatccgcactgacgacttcccaactgacgatattgccttgtttttcgaagggactatcaattcgataaaacttgccaaattggaataactgccggtattgtttgtaaaaagcaacttgtgaggcgacctgctgctgttcctcttcggtcagcttggtaatgtcgagttcatagcctaagtcgccaaagaaggcgacgtttcctctagtatcaaatggcgtttttcgtcccgtttgttcgttaggtactgctgaaacatgagcgcccatcatagtttgagggtagccgtatgaagttccaaactgaatctttaatcgctcaacggcatcggtatcatcgctgacccatgcttgcggtgcataatacatcatgcctaggtcataacgaccgccaccggctgcacaagactcgattaaaacgtctggaaaggcggtagtcacacgttcgtatagctgataaacacctaacatataccgatggcccatttcctgttgctgatgaggtggcaatttttgaccaaacatatcagtaatgtttcggttcatgtcccatttaatatagtctaagcccgttttcttgatcatattacctaccatctggaaaacgtaatcgacaacttcaggacggcttaaatctaaaacaaactggttgcggctaggtgtcttttgccgattaggagcggcaatcaaccagtctggatgctgggtgtagagcgtgctgtccatggaaatcatttctggctcaaaccacaagccaaatttcatgtccatgtcgtggacctgggtgactaagtgcgctaaacccttcggaaatttcttcgggttttcgaaccagtcgcccagtgaactccggtcattattccggtggccgtaccagccatcgtcgaggacaaacatttcaatgccaagctgcttcgcttttttcacaatttttagcagtttttcttcatcaaaatcgaagtaagtggcttcccagttattgattacgattggtcgctgcttctgcgcgaagcgggggttaaccaagtgtttctgatagaaatctgccatttgctgactcaattgattcatcccgtttgacgtataactcatgattgcttccggagtttgaaatgttttgccagcatcaatttgccaagaaaactcgtttggattgatgccaactaaaatccgggtggtatcatagtgatcaacttcaacttgatccataaagttaccagagtaaaccaggttaaaaccgaatgcttctccctggtcatcagttgtctgtggtcttgctaagatgaagaacgggttttgttggtggctggatgcgtaacgcaaactgctgatactttgaacgccacttcgtaatggtgtccgaatcagctgacgttcccgagtccaagcacctgaaaactgaatcatatcgtatgaggcatctggtaaatccagttcgctgctgtaagcggccgtcagagttaccggctgctgaccattattttcaaatttgctgctacgtaccagaatgtcctgatgcggaaagatagtgtagttcagttttaaagtcattgccgttactttatcagttagaacaatagttaatgtctgagaatcatcgctggtgtcatcaaaggtcgatggcatgtctggtaagcgtttctttccagctgtcagttcatatttactaaacctgaattcagagatccgactgccgtttgcttcctctacttgataagccggatacctaaaatcaccagtacccagatccgcatactcctgcttgagcatttccagttgaaaatcgggctgatcaagtgatagagcgggcattgagccgcgttcttcacgtgtacttaagttaacatagtttgctttaaccgggatttgcttgccgcagtatagctgacccagttcgccattcgacatgacataaaagatgtagctcatatttgccgtttgcaagtgaaatacgttgtcattaacaaagattgccatgcgttaagcttcctttctaatgatttacctaaagtttaagtaatttaaatggtttattcggtaggagcagaaaggttcagaacttcgtcgccatgtttaacactgccactttgctgcgaataagtgaagttactgatcttatcgccattggtaatcacggccattacggtatcatcatagccggccttttttaaaatcagtggtgagaattcaatcaacaagtcaccttgtttaacggtttgccccttcttaatttgactgacaaaaccagttccacgcattttcactgtatccacaccaatgtgaatcagactaagcgtgccgttcgcagcttttaagccaaccgcatgccgagtagggaaggtcgcttcgatcacaccgtcaaaaggtgcataaacgtgaccatcacttggtttgatggcaaatcctttacccatcttaccactggcaaagttggtctcgccaacgccgtttagagaaactaattcaccatcaactggtgcagtgtatgatagtgtctgactatcgacatcctgacgaatttgactcattgattcgtcatcactactcaaatgctggtgccaagtcttttctagttcatccacaatttccgcgtgtcctttttcatcaagcgttactttcttccaaaaagtaaacgtgccaagcagaatgagaatggcaggtacaccaaacatcattaatttaaagaccatttgaccatgtgttgtgatatcactagcagatgcaccactggtcatcccggcccaaacggcagttaaaccaaccacaccgttagaaacggcaccaccaaatttatctaataatggccgaactgaaagggtcagcgactcgtctcggtgcccattctttagttgtccatattcaacggaatcagataaaatcatcagtacaactaagaagatcaaggtttgaggaacgtagaacaaaacagcggcggttagaactaatggtaatgaactgccggcaaaaaagaatagcaaaaccccaaatagcatgacgataattgagaggaaaaatacgcgtcgacgactaaacttttgtgccaatgaagggaaggtcaatactgagaaaatcccaataattgcatttaacgaagccaaaaaactaaactcagcaggcttccccaagatatacgtaaagtaatatagttcgagtgagttcaaaatagcgatgcctgttgtatataagcagtaagttaatgccatccacattaattgatcgttactcaacaaaactttgaagacacctttgaaggtagttttttctttgttttcacgtaattcagaatgtttttccttagtgcctaagccaacagcgattgctgaaatccaagaagttaagccaatgattacggcgaagaagaaccagcctcggttatcaccttgaccgttgttagagttaacggagaagaataatacaagtggcataacgatgattccgacgatgttagcaccaatgttagagccaacacgagcgaaggtagctgttttttcacgttcagcggaatcaaaggagatcgctgggatcattgaccagaagccaacgtctttaaacgaataaaaaatatccatcgtgatatagaaaaccgcgaataagattaaatataaaatcgggttggaaacgtttaggcctcccatattagtaaacaggatgattaacatcacggaaccaaccgttccacctgtgaccacccaaggtttaaagtgaccccaccgggtattcgtgttatcaatggtgttgccaatgaacggatcgatcactaattcaacgaatcttaaaatcatgatgatggttgtaatatagccaatcatccgagcgttttgtccgccactgctcttatcaaataaatgagaagtaacaaacataatgaaataagttgataatgttgcataaaacatatcatgcccaaatgcaccaaacgaataagatagtctggacgtgattcgtttacgcttgtctgacggtgacatcgtagtgtctgccatgaaaaagcctcctaataaagttaaaagtaagtatctacatttctaaaagtaagcgttttcaaacgaaatgtcaataatatttattaaatttattatttattgtattatattttaaataaatttattaaacttaacttgagagttctcttattggcagccaacatactggatagcattaaaaaaggccgaagcaaatggttaacttcaagccttttagataatctcttgtttctataactcattttctgttttttcacgaatagggtaagtgtcgcctgttcctaatcttccgggtatttcagttcgaactgaccagtcacgattcgtggtgactagatttttgatttgattaatagcagtaatgccgagttcttctttcggcagccatatgcttgttaacactggcgttagaaacgaggctagtttaataccatcaaaactaatgatcgatatgtccttaccaggcatgatgttttgttcccgcagacccttcatcacaccaatagctagtgggtcagaggcaactagtaacgcaccaatttttgtctgagattcagataataatgcttcaactgctgttaagcccgcctggctggaccaagacgttaatttaagtaattctttctgccgcttgattgccgcccaatcgtggtaagccgatgtgcgtggatcatcgacgacttgttcaaccgaaccgttactccttaattctaagcggttaccgccaataaacgcgattggaccatcagtatctgcacttaacttatccaaagccatgcgtgttaaagcatataaattagtgccgatggtatcaacatgactgtcatcgcttttgacatcgtcaatgatgacgatatttttgttgtaggccttaaatcgcatgatggcgtttgaggacagcgaacctaagatgataacagcatcaaagtcggcaacgacatttggtttaataccgttttgaattcgaaaaatgttttgaatggcaaccgactctttggcggcggtttcgtaaattccctttcggatgaagtgccaatattcatcctcggtttcttcttgcaatgttagtgttgtaatcagagcgcacgtcaatacgtgctgactggtctctttgtgctgaactggctcatagccaacttcggcagcaatctttttaactttttcgattgtttcagaggcaactgcttgctttttgtttggatttaatgcccgtgaaaccgttccaggggagacattagccagttttgcaatttctctaatagttggcatttgcaggccacactttctaaaaattaattaaacaaattaaacggattaaacatttgctattattatacaacgtttcttaatctggtaaaagaaatacctttatttgccttgcccattttgggtatttgatactagtaaatgggacaaggagtgtcgccgttttcaaaaagatattaaaaactcctaaaaccttttaataatcactagcaacctagtggcgaagaggttatactcgtcaatgctattagaattcgctagttaaagcgaatatacacaaggagagactcaaatgaagaaattagtcgttttatcaggtagcttaattgctgcatttagcttgctaggagctggcgccattacgcagactcaagcatcagctaagacaactgttgttgcgggcagtcctagcctgtcaatcaacaaaatttactcaagttcaacatcagtatcaggtaaggccagcaagggtgttaagatcactgttgaaaacagcaagaagaaacagattgccagttcaaccgcatctaaaactaccggtaaatacactgtgaagttaccagctaagcaaaaggcaggtaccaaactttacgtttacgccaaggcttctaatggccattacttctaccgaatcatgacggttcaagcaactgcgtcatcaaagactacgactaagaagactacttcaaccaagaaaacgacatcttcaaagacgacttcaaaaacaacctcaaagaccacttcaaaatcaaatacaccaagcacaccaacaggtacttggaagtcaaccagtaacaaaggctggacgatgaagtttactttcagtcaaaaaactggtttgaatgaatatacttaccaaggtaagaaatcaactcacgttttgaagaatgcacgttacagcgttgatgctaagacacctagcttctggaagatcagtgccagtgctaagggcggtgccaaatcgaccttctacatgcgctttagcagcaagaagcaatttgtactggtaaacagcaagaaccaagtaattaacacttcagttggtaaagcaccagctggacactatacatttaagttacaataaacaataagagtgtacaaataagcaccatcccgacaaaacgggatggtgcttatttgttagtaccaggtagcctacgctagatccctaattacttgcttacacgtctttgtttggtacaatcagtttaggtcaagaaattagaggggagcgtatacattatgaaagctattggcgcaactgcagatcagcagttaattaatatcacgttaccaaaacccatcgcaaactctaatcaagtgttggttcaggtggatgcggtatcggttaacccagtagatactaagctgaaagaggcggttaacgaagctactgcgcccaaaatactgggttatgatgcagtcggcaaagtggttgaaacgggtaaagaggttaccaagttcaaagttggcgaccgaattttttatgccggcagttctcaggttgctggtgccgatgctgagtaccagttggttgatgaacggcttgccagtctagcgccacggtcattaactgcagccgagattgctgccatgccactgacagctttaactgcttatgagctgttgtttgaaaaaatgcagtttgtgggtaaggctaaccagaatcaaaaacgcaccctactaattatcaacggtgctggcggtgttggttccatcatgacgcagttggcacactgggctggtatcaccgttctggcgactagcagtcctaaacattttgattggctaaaacaaaataaagtcgatcaccccttagattaccatggtgatctgttaaagagcattcacgatttaggctatacgtcacttgatggtattgccattttatataatcccgcagattactttgacttagctgctgaactagtcaaaccatttggacacattggctcaatcgtcggtagtccggtggatttaccgctatacaaaattaaaaataaagctgccagttttgactgggagtacatgtttgcaaaaagcgatgcggattataacgttaatagtcaggggaagaccttgcagttgattgcccgtctgcttgatcaaggcgttttgacttccacgctcactaaagttttaacggatgggatcaacgcaaagagtttgactcaagctcacgaactggtcagccaaggaaaagttcacggtaagcttgtcttaacgggtgaatttaatgcatcagcagagggtcggagcgatcagaaatgattgcgactaggaaagaagttcgtttaccttcattattcattgctaacctaatgttgaataccggtgcggcgtttatgtggccgctaacgacggtttacatgaataaaatgctaggggaatcactcactactgcgggtgccgtgttactggtcatgtcgttaatgatgatggtgggtaattacattggcggtgttttgtttgatcgttggtcaccgtacttaacgggaatattgggtgctggtatatcgcttgtgggaatgattttgctgatctttttccacggatggccgatttttgctattctgcttgtgatcgtcggctttggtgatggtatcagtttgactgttggcaattcgtttgccgcaaccatcaagagtacgtcgatccgcaaagtttttaacttgatgtacattgctttaaacgttggtgttgttatcgggacgttactggtaggatacttgctggattatggtgtgacgttggtttttgcggtgacaacactctgctacatcttgctttttgttctcatgctgactgaatttaaagttgacgtgaatagtacaaagagtgagcgtcaagaaaacgggcaggtaccaaagttaaacttacaagtaatttggtggatctgcataatggtttttgccatctacgctagttattcactctgggaaagcgttctgtcagtgcacatgacgaatctgcacattcagtttaaggattatagtttcttgtggaccatgaacggttttttgatcgtgtttggacagccactgatgaaccggttatttagtggtcatcggttagctacccaagttagacttggcgtttcaatttttgccctgtcgttttttggcctgatttttgccagtcaatattcagcctttgtgattattatgattgttttgacgattggtgaaatgattggttttccaggtttgccagcttggattgatggtctagcggaaaacggcagtaagggaaaataccaaggtatgtataacgtggcgatttcgcttggcagagcaatcggaccgctattcggtggtttgatgattgattatttcagctatcaggcgctgtttttatgcgtgggattagccatgttactgtcacttggctgtgtattgatcagtcatcggcggctgtctgaataaaaaatgagtgtgcgacaaaactcggtagtttccaaaatttaacgcaaatcatgcctatcccggcaactttgttgggataggcatgatttgcgttaaatggccagaatataagtttgggcgcacgattaggctatatcaacgtgtcgaactcacggatactcatgatctaaataaaaaatacttgccaatatagatttatgtcacagttttaatttcaaataaattttcagcactacaaatctaccttaaatccctgttgtttaattacctggaggagttcggcccgcagcttagggtcacgctgcagttcctggacaatgtgctgactgaaagtggtgtttttcaaatgactgttgcggtgagcgtagtagtcagccgttgtcgtgtcataggaagctaattgtgaatcaaaatcatctggcaacgcgtattgattactgaagtgcatgagcggttgcggtaatcgtggttttagaccaggttgttctgccggatgaccaatggcaattcccaacagtggaaaagtcagttctggcaagtttaataacgtgatgacccgctgtgaatggttcaaaatactgcccatgatcgtgctgcctaaacccatactttcaccagcagtaacgatggcctctgctgcgatagcaacgtcgaaggtgctggcgagaaacttgtcaaaggagcgtaaaatcgttgtatcggcatgggtagcttcagcaattttcaaattccggtgctgatcggcaaccagcataaagtagtggccgcttttttccagccagtggtgaccagtaatatctccaagttcttgtttgatagctgggtcagtaatactgatgatgctgtattgctgggcgaaggtactcgtagccgcgtgttgagcagccgttactaaggtggtaacttcctcggcagtcagcggctggtcggtaaactggcgaatactgcgatgttgattaagtaggtttaaaatattgttagacaaaatgtcgtctgctactgatataacttataaaaagttatagattattcttgcttctccctatcctgcctcgcatgaaactcactaatacagttggtatgatagtccgcaagcgttaattcccggctagccaccggtacatgctttgagcctgttttagtaggctaattcaaagttttcagtatccctgatattcagggcggcattaatatcgcgatctgcagtataactacatttaggacattgataggttcgctcacttagctttaaatcaacttttttatagccacattgatggcataacttagaagttggttcaaaccggccagttaagtgtactggaatgcctaactgctggcatttagcgattaatttgattctaaaattatagaacccttggtaactaacagctttcgctaaatgccgatttttcatcatacctctaacattcaagtcttctaaggctacccactgcggtttggttctcactacagtagcgataatcttattttgataatctacctgaatgttggttaatcgttgatacaagcgttgcaccttccgctgagttttagctagattaaaatcagtagcagatttcccttctttctgtcttctagctttcagtgcaagatactgacgggacatttttctttgtagccgtcgcagacgttttctgatgcgtcttatccaactacttttattctgattgtgatacaaagtgccattgtttaaaatggcaaactcttttaaaccaaggtcaatgccaatggactcaccggtaagttctaattttggtagttcagcctgttccactaaacaggtcaggtaataccgaccagctttgaatttaatccgaccttgtttaataacgaagtgttctgagtctgtaggaatgtagccaaactctttcaaacgcacccagccgagcttcggtagcttgattcggtgacgctgacaggcaatgatttgcgtcttactgttcttaacaaagtagtaactgccttgaccgcgcttaaacgagcgccagtgtgggaacccactctgtttcttaaagaaccgtttcatggccgtatcagcatcaataaaagcctgtttaaccgatttggcatataaatctttgatccatcggtcatcaggattgctctcaaggtactcatggttaaaccatttgctgaactcataagcgcccatatagtgataaccgcattcgtaacgctgccggttgatatccaaaaacaggttataggcccaacgactgccaccaatatgacaatcaatctgccaggcttgtttttcagtcggcttaatttcgactttataggtgagtaacatcagtggttccgccttattgaatttaatcaccaaggtgaggtgtccctcatattatacgggatggatttatccccaaaagccttttaatgaaattcatataaatcactacttataagctatcagctaatacggaaatttaacgcctaactttaaccttgtgatatcttctaccagacttataagaatacagaatagtatagaagcgccactttacaaagattgatattcttttataacaaaatagttactgttcattcctccttataaattcaaaaattgaagtcgttcaactagttttttgtacacccgtgcttcatcagcagggaccccacgtagttcgtagtcatcgataaatggggcgtcaaatttttcacagtatcgacgcgcagtgagacaatattgttcgttgaaatttttattgccactgccaacaacgccaattaactgtttggcattatcatggtaatcaatgtactctcccataacatttgtcatcagttctttaacaccattatcgataccgttaccaccatccaaataagttggcacaaaacagaagaagggctttgtttcgtcagcaaaatcagtctgttccgaaatttcggttgcttcaatttctggcaagcccttatttttaacgtgttgcgcgaatgcataatgggtcaaattttcaacgaaattacgcgtattacccgcaattgaaataaataaaattcgtatggaatccatggtgtttttcctccgatttatcgatataatggtagatgttgtgttaatcgtacagatgatacatactggtagtattatcagttaattttagccatatatagggttgaaagcaagcagcagaagttttgtgatttgagtgcttgtgatatatcatagcggagatagttaatgattatagaggtgagagaatggcagagaaacaggatttaagagttcggcgaacaaacgaacaaattacacgagctttctttggtttactcaaagaaaagggatttaagaccatgacggtgcaggatatcagtaaacgggcacgcatcggccggtcaactttttatagtcattattacgacaagtatgatttgctagagaaactggtagcagaatacacggaagttttccggaaaattgtggatcagcggtttagtatacatacaccagaaattggctccaataccgttaaagtattgattcttgcgctgactcaataccgcgagattctgttgcagctatttgatattcacactgaaacagcagatctggaacgtaatttcaaacggattttacgaacaacagcctatcagtatttccagcatgtggacttgccaagtgagattgatttaccgttagattatttgagcgatctttacgctagtaacgtgatgttatttttactttggcagttacgccacggtaaaaacgattccgttattcagtttggcgatcgtttacaagaattcgtactgaatccaacccagggcattcaataaaaaaatagcctgattatcatttgaagtggtaatcgggctatttttgtatagctattcatcgttatcggtattattttcctcatcggcatcatctgccggagcaggttcattaaccgttacttcaaaccagttaataaacgagttttcataatcaacgactttaaagtcaaagttatcaatgtgaaggacagttccttgtttaatatcagggtgattatccaagattgacccggcaagcgtcaccacatcattggtttcaaactctttaatgtcaacatcaaagtaacgttcgaaatcgtaagtggtcatcttaccgctaacttggtaggtgccgtttggctgtttaaagatatcctcgtttgaagaatcatcaatttcatcgtggacggtgccgaacaattcttcgtagatatctttatcggtaatgataccggaagtcccaccatattcgtcaactaccaccacgataggggtctgtttatggatcatttgctgtaagacctgcgtgattggcgttgattctggggtggtagaaatatgccgcagcaaacggtcaatgtgaatcgttgggtcaacttgctgctgacgaatcaaatcatagttgtaaacatagcctaagatcttatctttatcgccatctgccacaactggtaagcgagagaaccgctcttgcagatacatattgatggcttctttaacatttgctgtaatatcgatcacgaccaaagcagttcggtcgatcataatgtctttagccactttatcgttcagctcaaaagcacgctgcatgtaaacgtagtcgtttttctccaattcaccaccagcaacggcgtttcgtgacaggctgagaatttcagcttgtgaaaagacctcttcactttcgttggcaacggggaagcctaatactttgacgacgccattggcagaatggttgagtaaccagacaaagggatagaacagaatatgacagtaatgcagtggcgttgtcacgtagcgcagtacctttaatggcatgtcgatagaaatgtttttgggcacgatttctgtgaaaaccacttctagataagtcagcaggagaacgccgaacacggcaccgatcgcatgagcagtagcgccgcccggattggtgtgtgtgatgttgagtaaatcaagcaaaattgccgagatcgttgattcacctaaccagcctaagataatccctgcgactgaaacacccacttgagtggttgaaagatactcgttcaggttagtcaccatttttaacgaacgggttaatctctttttggatccttctccattgtccaaggcctcttctatggcacttggccgagattgtactaaagcaaattcgcaagcaacaaaaaaggccgcgatgaagaaagtgattaatatgacaatcaaattgataattatctgaccactatccaagaattcattcctcatttcataataaaatcaacatttagagtttactctccattataacgcttgtcggtcccttttttaactgttgtagggaaattaaagggattcaacgctattaagcgtcgtgagaaacctcaatgctggtctagtgaatggaagcggatgtgaccgtatcgacaatttcgttgacggctgatttagcggcaatgggaccaaaagtaaagatgtcagctaatgagttaccgccaagtcgattaccagcgtgaaggccaccagcgacttcgccagctgcataaagaccattgatacgattaccatctttatcaagaacgtgagcaccgtcatcaatggttaagccacccatggtgtggtgaatggctggtttccgtggtgtcgcatagaagggggctttttcgactttcaaatcaaagacgcttttaccaaagtcaggatcgctgccttggtcaacgtaggaattgtacgtggcaacggtgttttccaatgtctttggatccacgttgatttgagtggctaaatcagctaatgtgtccgctttgaatagccggccatccttaacttgctgttccaactgttcatcactagtattgtaagccgtttttttgatttcattgtcagcaatcaggtagaagagaccaccattatcgaaagctgccttagctaagacatcacgttcggcatattcgttgacgaatcgcttaccctgctgattaactatcaagaagttcgcaggtgggcactgaatacctgagaaaatttcaccggtttttggatctgaaacgggcatcatttgaatgaagcccataccagtgacgcctgcgtgagcctgttgtcctagcttgataccatcaccagtaattgtcggagcattagtggtagcaatgtcgtcatcaatattgctccaagcagtgttatatttttgaactagagcggtattggcaccgaagccgcccgaagctaaaataactgcttttgcctgaacggtaaaggcgtgatcatcgggcttttcgactagcacaccatcgatgtgacccttggcatacagtaatcgtgagactgggctatcggtcagaataatgccaccattgtgtttgacgtaagtgctaagtgctgaaatataagcatacccggcagtttccactggcttgtggccacgacgccaaagcgcgccaacaggcatagcaacttcagaagtatcgaatttgacaccaattttggccagccatttctgggaagcaagtgcgttatcggtcagtgttttgacgagtttatagtcaccgtgaatactgttgccgttcaaatcggtacgtttaccgcctaaataagtttgaatacgatggagttcaactgaatcaaagaggtagggctttttgtccttgatgtcagcaaagtaagctttgatttgcgattgcaaggttttaaagtcgtcctggtattcagaatcaatgtcgtcaacactcatatcaagcaagttttgcagcgtttcgcgttcgcctggtagagcatcaaaggtattttgccaatcaggatcagcagcgttcatgggaccgcctgcacgaactgtattaccacctaatgagggtgctttttctagcacgaccactttgcggccctgatccaaaacggttgcagccgccgcgagaccagcaccgccaccgccaatgatgacaacatcagtttgaagatcgctattttctgtcacttttggggtgtacttatcgcgggactgccattcttgagcatcgccgcccgcttctttgacagcttcagcaaccccgttcaaaatgccacggctagtttcagaagcaccggtaacagcgtccacgtttagcgtttgaccgtcgacgatagcgtcaggaatgcggtcatagaccacgtcactgataccagctgtttcagttttttgaccaatctcaattgattcaatgcggttttctgaaaaagtgacgtccattggaaacgtcccgttatgaccttgagccgaaacggtatacttacctggtttaaatgtttgcttatcgtctgccatgtgataacttccttttcaaaattcatttttaaaataaatgttagcggatacattattaattctaccatgaatcagcaaggtatggtgggtaggggtttaggactaagcggtgatgattaataagcgttgtaattaaccactataggccccgtcacgtcggtactcaagcagtatatttgcccattctgatgggaatagtgctaaaataaaattgcaacataaatcaaaaggagatcttagttatggcaacaaaaagtgcagataaggataagaaagctgaaacaaccaagccggcttttgaatatactgatgaaatgattcaaaaggctgccgacctgattgccaaacaaggttatgtcacccgtaaggacattccagaaatgaaggatttggactgggcttacggtttgggagaagctgtcgacaagtattttaacggtaaaaatgctggtcgttacatttaccatgaagattttgattttgctggtggcgatattgctgacatcatcttcgatatggatcaaattaagactcgtaatgatgcacttcaaaagttaggcgaagtgttaggcgataagattattaacggtcatttggacgaaatcgaacataacattactaattagacggatatttatatatctaagacaaagggtatcaagactgaaatcttgatacccttttattatttttacttatgtacaatcttaagacaataaaatataaatataataatataatttatgacatacttgtttatttttgttttgagattgtaatctctttttaaggattgataatgatattaaatttcataattcaaattgttacttaaatatttccaaaattcattaaatcaaaaagcgctaaaaaagctattatacaagcgaatgatggggaagaaagctgcctaattaaaaagggaatttaatgattggaaacctcatattggttttacaataaatgagaaagctatagagaaatagtacaaaattatgctattaagactaaagaggacaatttatcgtgaattaattgttctttcttgatgattgtgtgcttaaaattgctaatcattcttttatcgagaaaagccaggtgattgtaggatagaataattagaaggtaatatatgcacttatttcattactttataaatgaaaacgctaacttaaaattctaacaactaaaagttactgtttttgtaggggggatttgttgagatttaggaaggttactactgggagaatctgattcagacgttggtttatgggtgaagtaagcctgtacctagtacctaagacgtctgtcataacgattgaatagcgagtgtaataggaggattatcgtgtctaaacgaaaaataacaatgatcgtattgagtttattggttatcattggcttgggatttgctggctattcagcaatgaacaagggtaataagtcggccaataatacgtatagcagcgataaaacatcggctagcagcacatcaaaagcgcctgctaagagtgccagtgcggccagttctacgtcagcgacttctaagccagaaaaaaaggctactggcaaatcgaaaagtgaaactgcagctttaaagaacgaaagtcaggaaaaaaataagtccaaggcaaaaattgcaaccatcaagaagaaccatcacagttctgcttctgcttcgaaagtggtagcaactgccaaagcaccagctcataaaagtgcaagtgcaagtacctgttcgttgacggtacgaggtcccattagtaaaggtaataaagtcatgcttcggggcagtcgagttgagattaccaggggcgagacggttgcttcggtattgaaaaaagtcgctaaggaaaaacacgtttcgttggcttatcaaggaggcggcggtagcacatatattcgcggaattggcggcctgtttgaatttgatcacggttctggtagcggctggttatactcagtgaacaataaattccctggttatgcggctgggaagaaaaaggttaaaagcggtgacaatattcagtggctttatacggagaatttaggtaaggaccgtcattccccagtagcaagtcaacattaattaacgaaaggatttgtgactaatatgaaaaagatgaaagcactattgttgatgcttgggactgttggtctagctgccggttttatggcagggactgctcacgcatctaccccgtattatacgaaatcaattaattccagtgtcagctatattaaagggcacacgaaaaaaagtgaacttaactgctgggatgcgctggctgtgaaacgttcaccatacggtatgagttcggcagctaaaaaagtattcgtaaaaagcttgtcaggacagtttagtgatctagatggtcattatgcggcagtcgattacgaacgtacgctgattggtgcggtatcaatcgggtataatccaaccaagtatcgtggcaaaaacttagtgaacgggattattaaaacagcacctaagtcaaacgcgggcgtgctggcaaaagtcttcggtatcattgcgctcagtacaaaaaactatggcagtaaaagtaatgcaaccgtcaaaaccctagtttctcaagtcgttaaagcccaagattcaaagggtggctgggaaattagtggtcacaccagcgatgttgacgttaccggtatggcattgatggcattaggaatgcataagaactatagcggtgttaacacagctatttcaaaggcagttaagttacttgaaactaaggcattttccaaaaaaacgggtgactttgtgattgctggttcattttctaagaaggctaattcaaactctgacgccttggcaatcgcgggtctttctgcagtgggtgtcaacccagaaaagctgaagacaaagagcggcgtcacaccaattaagcgtttaattaaatatcaaaagtcgtctggtcaattcagatggtggatgggaagtaactcgggttccctgcagatggcaacgcaacagtctgcttatgctctggagcagtacagttacttcaaggccaacaagggctccatttttaaattctaatctgtctaaggaggagtcaaaatgaaagttagcaaaattgccaaacttgctgcggtgggtatgctggccgttttcggctttgtgggagcgactacagttacctcaaatcatgctgagattgctcacgcaaagacgaccaaggtggtcaaggtatcctacagtaaggtttccaaaaaagcgtatcacgttaccagtggtagtttctattccacaagtcatctaacgaaggtgaaccactatggaaagaactataagcacaccactttttattcgtataagaaagcaactattaagaaaagtaaccacaagagctattcctatgtttacgttaaatcttcagacaaaaaagtgagtggctggatttggcatagttaccttaaatctggcaaagcaccggctgttaagaagtcatcttcaacaagttctaagagtggaaataccaatacgggtgtcacgaaaccggtaactgtaaaaatctatggcccgattagcacaggcgataaagtgattgcttccggtaacatttcgtataaaaaaggcgcaacagtctttagtgttttgcagacactgtcaaagcaaaaaggctttaagatcggttactctggtagtggcagttcagcatacattacgatgattaatggtaaatatgctggttctggtggagctggcggtggctggctttacagtgttaacggcacttattccagttacagtgctggtgcttataaagttaagagtggagatgtcgttcaatgggtatggacacaaggcagcggcgaccgcgggtggaacgggtaagtcgttctacacttgtttttgagcagcttaatccgtgggtgatgtttacctactatgtcgtgacgattgcatgttcaatggttttcttgcacccaatcttcttattggttgaattgcttttagtcatttgtgtggattttgtcgcacatacgggtaaacaaatgctaatggttctggaaggcagtctgttcatgactgcctttatcatgattttgaatcctttggtcaataatcgaggaacccatgttatttggacgtttggagggaccatcattaccgctgaatcgattttttatgggtttatgatggcattatctttgatcatcgtgctgttaacttttctctcatataacaaggtgttgaccagtcaaaagttcatgtatttattttcaagaatatcgcctaagctaacgttgctaaccatgataacgttacggtttgtgcccctgttcatttcacggttaaaaaacatttcgcaagcacaaaaaattcgtgggattgcagttacgaaaggaaatagccgccaaaggggacttggcgtggttaaaatgatgcaggttttgctgattcaatcttttacggatgcacttcaaacagctgattccatgagtgctcgaggctatggcagcggcaaacggtctagctatcagcgctatcgtttttcaacccgtgattttgtgtcactggcttggtatttgccattaactgggctttgcttctatgcagctagtcgtggtattggtcgaatgacggtttatccgagtttgggaacaatcgcattgacgcccactggttggctggtgctacttggtgtggtgttgctgttcagttttccattaattctagaagcatgggagtggctatggtggaacttattaaggtcgtagattttaattttgaatattcactggcaaagcacaaaagtctgtcagatattaatcttaatgttaattctggcgattttatcacgattgccggggattctggtagtggtaaaacaactttgctacggcagatgaaaccagaactgtggccggtgggaaaacggacaggtgagatttattttgagggtcaaccaatctcaaagctacccaaacgggaaagcgcgcaaagtattggcatggtttttcaaaaccctgacgatcaattagtgatggataacgtgattcaagaattagcgttttcgttggaaaatatcaatgttccaactgatgtgattcaacagcggattgctgaactagttagttttttaggccttcaagacattttgtatgaaaacgtacagaatctatctggtgggcaaaagcagctagttaacttagctgccgtcttgattttacggcccaagttactgattttagatgaaccaacggcacagttggacccgattgccaccaaagaattcatttcgttgctgagtcgagttcatgatgaacttggaatcgccattgtgatgagcgaacatatcttagatgatgtattgccactctccaataagctctggattctggaatatggagaactgaaagctgaggggtcagtagccgaagtcttgaaaagcatctcgaaagattctcatctgaagagcttcattccagatgtgccctatcttttcttacaggaagacttaccgaataaattacagttggctgatctaccgctaacggtggctcaaggtcgcgaagtattgcaggctaatcacgttaagctgaatggcaatcttcaggtcagagcggatgagtctcaacagccagttgtcgcaaaactatctcaccttgcatttgagtatgataaaaacggtaattatatcttaaatgatttgaatttgaccgttcataagcaagactggcttgccattattggtaagaatgggactgggaaaacgaccttattaaagtccattatgggcttgctgtcattacgacgcggacgggttcagttactgggtaaaaaattgagctattggcttaaaaatacagatcagttttacaaggaagtttcctatctttctcaaaacccaagcgactattttagctatgatacggtacgtgaagaatttgttgagcgtgcaaagcagctaaaaatagatgatccagagtctgcggctgaatcaatgctcaagaaactgacaatcgaaaacattgccgaccgcaatccgtatgatgccagtggtggtgaacaacagttgattgctcttggaatactgcttttttccaacccaaagttgctgtttatggatgaaccaacgaaggggttggatcccattcggcgccaagaattaggtaatattttagagaaactgcaagtagaacaggaactgaccgttgtaatggtgagccatgatatgaattttagcgctcagttcgccactcaatgcgcgttgctgtttgatggcaaacttgttgctcaagcggagccgcatcaattctttgcggataactttttctacacgaccacggttaaccgaatgttgcgctatcagctacctaaagtgattcaacggggggaggtcacgccttgaataattttgttgataaaattaagcaccgtagtgggtactttgtttcaatcgcaatctttattgttgcgctagtatggatcactttttttaacggtgatcagcactaccttttgctgagtctaatctgcctggtggccagtatgctgccattttattggcacttcgaaactcggaactcggaagccagagaaattgtctttttagcggttttagcgacgattgctgctttagggagagttgctatggctgcgatacctggcgtgaaacccaccagtttcgtggtggtcatgacggggctgactttgggacctgaggctggctttatcgtgggttcaacgtcagctttggtctctaacctatttttgggtcaaggcccttggacaccatggcaaatgtttgcttggggattgatgggaatttccgctgggttgatccggaactttaagtgggcgcataaccgaaagttcttagcggtacttggcgttttctatggctttttatttggttggatcatggatctttggtatgccatggtttatgttcagcctttaaacatcaaaacgttcatagcggcttttgccaccagcttttactttgatctaacccatgggattaccaccgctgttttattgttctttttctacaaatcgtggtataaaattattattcgatttaaatacaagtacggtttggctaatgtccagcaggaaattgaccggcaaagtttttagttgtcggggcaataatttaaacgaattaaagggctcaattctacggtgaattgggccctttgtgaataggtaatctcatattaaggtggtgaaaagggttatgaaactgtatttcattcggcacggagaaactgattacaacgtgcaacggaaattctatggtacggatgatgtttccattaatcagaccggtcaaaaacagtgtgagcttgttcatactaaatttaaggggcgagcaatcgacaagattctggtcagcagtcgtatacgaactcatcaagcagcggaactgatcttccctaatcgacaatatgaagtggctcattttttagatgaatggggatttggcgaatgggaaggtttagatgccgatcaaattcaggccaagtttccggttgaatgggaacgttggttagctgatccctttggctatacaccgcctgcttctgaaccatacgtgaaacatgagaaccggattaaatcgggctttcgagcattagtcgatcacacactcgataatagttcggtagcgctggtgactcatctggggacgattcgagtgatcatgcatgatttattccctgaaaagcccttttgggagattcaactgactcagggaaactatacgtgcatcaattatacaaatcggcatttttcagttgatacttggaataaataattggatggacaaaaaacgactgtgtaagtctataattggcaagtattacaattaatacgttaaccgaaattaggtatcactgtacttaatccttcaacatagtctaatcatgcgccaaaactcagattccggccatttaacgcaaataaggcttatcccgaaaagttcgtcggaataagccttatttacgttaaattctggaatctaccgagttttgtcacacactctagattttatttaattgtgtaaactgaccggtgcagttgcggactcttgtatgaagcaagtgctaagttaacttgaccgacaccatatacggcacttgaagatcctttgatggtaccatcatggttaatgtaacccaacattgcaaccattggtgatgcggtctgtgctttttgagatgccacactgttcatgtatttgtttgtacttgatcttactgaaaaggcaatgatggcctctgcagttgaattagcattaagataagtctttccgaggtagttgtagccgtaagcaccgtttgttgatgcctgtgaccttacgaaggcttgtcctttagacaagcttgttttaaccgttttagcggatgatttggctcgggctagggcagtgactgccattgcactagtatccgtatcaacgtcggcaagtttgttatcatatgcccaaccgttgttgctttgttgtaatttagccaaactgttagctaaactggttttgctgaatgttgcgttctttggccgactgtaattacctgttgataaggcaatcagaacttggctaagggtactggtagtttgtgaactgatctttgatttgtagagctgatccacaagattaacgtcttttttactgccgtatggacgatattttgctggattataaccaatactcttcaagccaacaatggctttagacaggatggctgggtcagtatttgatttaagcaccaagtttttgcgaatcagtgatttctgtgcactggtaaacttgtaaccattagcttttaagcccaacagaaagtctgagtatccatcggccgcaccagaagcggggtaagcttttttgctgaaaatggctgctgcattggaatcaaaaccgttcttgtttttagccagcattttcttagcataattgtaagttgtgctagtcttagacttaatggttttgcttgaagctttttggaaagttgcagcatgtgcaaccgtgtgttgcgaaacaccaccaaaaatgaataaagttgctaaagatgtggtcaaaatggctactttcgaattgatcttcatgtgactacctccaataattaataccttaattctaacattgaaagctgtttcattcttgttaattttagagataaatgataatttttatgcaaaataacgatagtggaaatattcccagttagaataatcgattttaattaaatcagaggtgtgatgggcaggttctaaagtttagtagcatttgtgaaaataatatattttaagactgtcaaagtcaccaattttaatctgtgcaaacttgtgaaacttgtctattaaagacgctaaattactagtatatagagaacagtggcaatttttaagattaacctaagcgtaaaaacaaacgtttacactacattgcattggtgttatatttaaagtgaattgtgtaacatataaatttaaaaataggagtgtagatcatgaaggaaaactttgatttcttaatgccaagtgttaacttctttggtaaaggtgttatcaagaagattggtgaccgtgccaagatgttgaacatgaagaagcctttagttgttactgataaggttttggaaggcatggaaaacggtccagttgcccaaacattagcttctttggatgcagcaggcgttgattacgttgttttcgacggtgttgaaccaaaccctaagatccgtaatatccaagcttcaaagaaactctacttggacaacgactgtgacagtatcatcactgttggtggtggttcttctcatgattgtggtaaaggaactggtatcattttaactaacggtgatgacatcactaagctagctggtatcgaaacacttgaaaacccattaccaccattgatggctgttaacactactgccgggactgcttcagaattgactcgtcactgtgtaattactaacgaagagactaagctgaagttcgttgttgtgtcatggcgtaacgtaccattggtttccttcaatgatccaatgcttgaattagatgtaccaaagggcttaactgccgcaactggtatggatactttcgttcaagctatcgaaccatacgtttcaaccaaccgtaacgaaattactgacggccaatgtgttgaagccatcaaattagttgaagaaagcctccgtgaagctgtttcaaacggtcacaaccttgaagctcgtaccaagatggttgaagccgaaatgcttggtggtatggccttcaacaacgctgacttaggttacgttcatgctatggctcaccaattgggtggtcaatacgatgctcctcatggtgtttgctgcgcaatgctgttaccaatcgttgaaaagtacaacatcccagcttgcccagaacggtttgctgaattagctaagatcatgggcgaaaacaccgatggtttatcaactcgtgacgctgctgacttggcaatcaaagcaatgcgtcagatgtgtgacgatgtcaacattccacgttcaatcaagtcaatcggtgcaaagccagaagattttgaattgatggctgaaaatgctttgaaggatggtaacgccttctctaacccacgtaaagggactaaagaagatatcgttaagttattccaagaagcttacgaccaaaagtaatttagtgcaatgcaaagagggcctgacaatttgtcaggccctctttgcattgcttaaaacgaatatttttgtaacaaaaaaagacatgattcgtagcgtggatcatgtctctttcagatttctgatttattttcccgcagctgcctgaatttcagctaattttggaattgagggcattgcacccatacgttgaacagtaagtgagctagcatgttgagcgaagttaatagcttcagtcatattactgaaatcaggctttaattgtgaactcaatgcgccgataaaagtatcaccagcggcggttgtatcaactggttttactttaaacgcaggtaaaaattcatggctgttatcgttagcgtagaaggctcctttatcgccaacggtaataatcaggtttgcaacacccatcttcttaaaagcttggtagttggcgaccatagaatcctcatcggtaacttcaattccagttaaggtagcactttcagtttcattaggcacaattacatcagttacttttaaaagctctggtagaattttagccgcgggtgctgggttcaaaatagttgttacaccgttatccttggcaattttgaacatttctagtgcagctttttgtggtgtttcaaactgcgctaccacaaaatcggaagtttttatttgttctgctgcagcgtcaatatcttcctcggttacccgttgattagcaccaccataaacgataatgctgttttgaccctgtttatctaatagaatggttgccgcaccagtaccggccacttcatcttcagtaatatgagttgtatcaacatgatcttcttttaagcaatcaatcataaagtgaccagcatcatctttaccaatttttccaataaagttaactttagcacccgcacgaactgcagcaatagcttggttagcacctttaccaccagctgcgctactacgactcaaactagaaatagtctcaccaggtagtggaattttttcaatcttagacgttgtatcaacatttaaacttccgagtactgtaactgtgtttgccattataagggttctcctttaagtaatgattaatgaactaaatgagtaatatctcgttaaaaggttttactacttagacttccgcttgttattaatttaacaacagaaatcctaacacgtttagaaatcgttttcaatacttttttattttttaggtaccgttacacttttcctctcaatcagtcttacaggcagctcaatgacctgacgatcaatattgggtttttgaattcgattaattaaaagttgggctgctaattcacccattcgagaaattggttgttgaatggtggtcagttctggttcaacataagttcctaagtcaatgccatcataacccattattgaaatatcagttggaacatgaatacccttattttttagaccacggtataacccgatagccatttcatcatttacggtgaatacagctgtggtctcactatcaataacagctccagcggctgcaaatccaccagcttttgataaaggagaattgatcacggtaatgatttgctgtggatccattccttgattggtaacttcctctctaaaccctgttagtcgtaatctgatattgcttgtggcgtcggccggaacgacaattgcaatccgtttatgccccattgagagaaggtagttggcaaccaagtgaccaccagtttcatcgctagtccgaatttgatcgccatctgataatgggttttgatccattagcagatatggaattcgatttttctttaatataccatcgatggtttctttggtaatggaagaactggcaatgatcagtccattggttccacgtccgattaactgttcaacgtagtattcttcaagctgagaatcattatcaccgctgaagttgaaagggagatagtcaaagtcatgagcaactttttgaatcccgtcaataaaactactgaagaatggatttccaatattgggtactaccacgccgatagatttggcttcgttcaagattaggttcctagcattgaaatttggaatatagtttaatttgtcttgtaatttgtgtactcgtgcaatagtgtctgaactaaatcgattactttttccgttcaatatttgagagactgttgtcactgatacaccggcttttgcggccaattctttaatggtcactttatgtgtcataattcactaactccttaaaaaaatcttgcaagcgatttcaacatgtgctagtgtaatagtcgttgttgatttagtgtttttagtaaatggttttagcttatgatttaattatattccaaggaggtactaaaatctattatgaaaaagacaactgttattaattccgaattatctacggtaattgcaggaatgggacacatggactggttaagcattggtgatgctggtatgcctgtaccaatgggaactaaaaagattgatttggcgttaaccaaagagattccgagtttcattgacgttttgaaaaatgttttaagtgaactggaagttcaaaagatttatttggctgacgagattaagactcaaaacccagatcagctgaaagcaatcaaggcattattaccagatgttgaaatcgcgtacatgccacattcagagttaaagaaggatcttgctcagactcatgcctttgtacgtaccggtgagatgacaccattttctaacatcattttggagtctggcgtaacgttctaggatatattttctttatttaaaggtaaaacgttttaataaaacctttttgcaggttatttggtattttttaatttaaaggagcgaaaaattatgcaaacaacccaatcaaaacatgggtggacacagctatcagatgggtatttgagtaaaacaccaatttttcagttcattgttgtttcactgattttcccactttggggcatggccgctagtttgaacgatattttaattactcagttcaagaccgttttctctttgaacgatgcttcgaccgcctttgttcaaagtgctttctatggtggttatttcttaattgctattccggcttcacttgttattaagaagaacacatacaaatttgctattatgaccggtttgattttttacattattggttgtgcgctgttcttccctgcatctcaagttgcaacttatagtatgttcttagtcgctatcttcgcgattgcgattggtttaagtttcttggaaacctcatgtgatacttacagttcaatgctcggaccgaaaaagtattccacgattcggttgaacatctcacaaaccttggttccactaggtgatattgctggtattttacttggtaagtacctgatctttggtaaggtcggtaacttgtcagataagatggctggtatgcatggtgcagaacgtattgcctatggtgaaaagatgcttcaaatgaccctacgaccatacaagtacatcctgatcgtcctagttgttatgctgattgttttggctgttacaccaatgccacgttcaaaggcgactaaccaagaagctgaaaaagccgttgaagaacaacctagcttaggtgaatcaatcaaatacttgctaactaacggtcgtttcatgaagggtgtcggtgcacaatttgtctacgccggtatgcaaaccactgtttggtcattcactattcggttagcacttaacttgatgaatatctctgacagtgccgcttctaccttcatggtatggagttacgttgcttggttcgttggtaaattgattgctaactcatttatgagtcgtttttcaagtactggagtcctgacctggttctcacttttgggatttgtatctttggttattacatttaccattccaaacgtaaccgctgtttacgcagcgattgcaaccagtttcttcttcggtcctgaatggcctaccatttactcacatactttggatacgattactgaaaagaaatacaccgaaactggtggtgctttaattgttatgtctcttattggtggtgcggttattccactgattcaaggtattgtttctgatatgactggttcaatgcagttctcatttatcgttccagctatctgctttgccgtcattacaggttacttctggtcagaacatcgtattgatgccaaggctggtgccttgaagtaatttaggaattaaagattcctttgtagtaatttattttgatgtcaaaagtgacctactaaggaattagcaggtcactttttgtttaaaaattatcatttaagttagtagtaatgcttgtgctgagtctatatcggtgattagcacgttggcatagtgagcccttaaagctactttcattggtgcgattttagcttcaccacctgcaacaaggatggaatatgtctttttttgcaattgtgccagcgaaattgctacggttcggtcatctaaggattggtcaacaatttgagcattttcgtcaacaaagtgggaatcaatgtcgccaacagaatgcttacgcaaatacgatatttcagcttctgtgaggtatcctaggttaaagagcatagcggtaggtcgagtggtccccacagtgtaaatagcaatgttagcgtcgtaacctttttgaagtgtatcagcaataaagcggtctttgatcacgattgatttgatttgaggtcggtcaaaaattactggtagaggcagaatcaatgcatcagtatggaaagctctactaaaacgggttgtgatgtctgctgagaagttgtcatgaccagcatttgccatacttccttttaaatggacaatgctaacattttgcttgtcggaaggttttaaatgaatggctaccgcatgaagtgtattgccccaactgatgccaacggtatcgttgtcttgaacgatagtatttaaatactctgcagctttttcaccaagtttctgagtaatgatgttctcatcatcattagtatcagtggaaatgatgacatcttttaaatcatatttttccttcaactgtttttgcagtgtggcggtgctggtgagaggatcattaatcttaatttggactaatccagtttcctttgctgtctgtaacgcacgtgaaatcgtcggtctggacaagtgaagttttttagctatttcaacttggctaagtccgtcaatataatgatacttactaatcttaacgagctgattaatttttttctcagtactgttagttaccatatgaacatctctaatctgtaattttagggtaagtatagcataacgaaattagttttacataatttcattgaatgcgtttacatttgtaaaaaataatgttaccttaaagttgtagttagaaaaacgacattgaagggtagatggatgttttatgaatttgaatgaatatattgatcatacattgttagcgccagaagcgactaagtctgatgttgatcgagttattaaagaagcagttgataataagtttgtttcggttatgattaatccctactgggtttcttatgtacatgaaaaagtaagcggtaccaatgttaaaactgcaactgtaatcggttttcctctaggggctaatacaaccgcaatcaaagttgcagaggccaatcaagctatttctgatggtgctgatgaaattgatatggtgatgaatatcggtgaattcaaaggtcagaattacgatgctgttgagaatgatatcaaggcagtcgttaaagtcggccatgataataacaagattgtcaaagtcattattgagaatgctttgctgacgccagaggaaaccgctaaagcttctgaaatcgttgccgatgccaaggcagactttgttaagacatcaaccggattctcgactagtggagcaaaagttgaagacgttaaaatcatgaagcaagctgttggcgataagattgccatcaaagctgctggtggtattcacacagcggatgatgctaaagccatgattgatgcaggtgctactcgtttgggaactagtgcaagcatgaagattattggaaagtaatgtagtttccaatagagtattggaataaatggctaatgagccatttattttaagagaataaatgaaagcggttactcgaagttcttaggcaatcgtttttgaactataaggagtgtcaattttgaaaaaattcaatttaagtcatgacatgtttagcaaagcagaatttgaattatacaaagatgacgactttaaggtgaccacctttacctatccttcgggaattgaagcaatgaacgttgaaaattcacgtggtcatttgaccttgttaccatttcatggattgattatttgggatgctattttcgatgatgtttcattgaagatgaaggatatgttcaaacaaccattgccaggtccaggtattgctgatacttatgggtgtttccagttcacttcagggctattggctaacgggacaccagggccagaggataattatcagctgcatggtgaattccctaccagtgaaatggatcattcctacatcaccttggcagatggtgaaatgacgattcacagtgattatgaatacgttaaaggttttggttatcactatttggcagaaccttctgtaaccatgcataaagacagtgggctgttcgatattcggcagaaagtcactaatttatctcattatcagccaatgccattgcagtatttatgccacatgaattatgcctatgtagataatgccaagatgagttcaaatattccagatgaggacttccagttacggcagaccattccaagtcatgtccacccaacaccagaatggaccaagtataacgatgcgttgaaagcttcaggcaaactcatcaataaattggatgatcctgatcactatgatccggaaatcgtcttcttctcaaaagacttgagtaaaatcacacctgaagcagaattccgtgttgatattggtcacggtaaaaacttcttaacgaagtttgatactagtgaattcccaattgcaacccgctggattttgtataatgcggatcaacaagttgatgcgtttgctattcctggtacaagtaccccagaaggattctcagctgctaaaaaggcaggaactttaatttcattgaaggcacaagagagtcgtagctttaaggttacaactggactagaaaattaagaggagtgacgaaaatggctaaacctgatgtattggtaattggttcaaacatggtcgatctaatcacttatgttgatcggatgccggttgaaggtgaaacgattgctgcacctagctttgaaatgggttgcggtggcaaaggtgccaatcaagcagttgcggctgctagactaggttcgagcgtttcttttgttactatgcttggtagtgatgatttcggcaagatgcaacttcaaaactacaagaatgttggaattgatacgtcaactatcggtattggcaaggctaatagcggtgttgcgccaatctttgttgatccgacttctgataatcggatcatcatcgtcaagggtgcgaacaacgaacttactccggctgttctagaaaagtacgaaaattacatcaaagaagctaaaatcattgtgttgcagcaagaaatacctttggaaactgattatcgcgccattgaactggctaatcagtatggtgtgccggtattacttaacccagcaccagccaataaggacttagacattgattatgctcgtcgagtagactattttgcgccaaacgaaactgaattgtcttcattaactaaaatgccggttgatacaatggaacaaatcaaaaaggctgctcaaaagatgattgacatgggtgttaagaacatgattgtcacacttggttctaagggagtactgtgggttaacaagcaacacagtgaagttatcccagccatgcatgttaaagccacggatactactggtgctggcgattcatttataggatcatttgctcactatgttgctgctggtgattccgttgatgatgctattcgtcacgcaaatgaatacgctggtgtgactgtgacacgtaaaggtacacagaagtcttatccgtcagctgatgaattcaatgtattaaaagaaaagttgtttgctaatcagtaaattgttttgtttagaagaagcgtaaaatacctatttagcggtatttttgcttctttttttatgaactgaaaagaaaaggaattagcactctcaatattcgagtgctaatttcttgcattcctgaccaatactgactaatatagacaatgtaaggttggtaaggagataagaaccacatgtccactaaccttagtttaaaattctgaaaggggtttttcactatgactaactatttagcaaacagaaactttaacgatttggatccaatgaacttcttcaacgattttggtaactttggtcagaaattcttcggcagtgatgatatgaaaaccgatattaaagaaaatgacaagagttatgaagtagccgctgaactacctggcttcaagaaggatggtattcacattgattatcgtgacaacacgttacggatcaatgccgttcacaatttggataaagaagacaaggatgaaaagggccgtgttctccgtcaagaacgcagctcaagcaacgttacccgcagcttctatctgccaggagttgatgaagataacgtcaaggcaacctatgatggcggcatccttaaactgactctgccaaagatgactgaagataagcaagatagtcatcacattgcgattgactaatcactgaacatgatttgattgcatccactaaaaaagcgtaccgaaaattttcggtacgcttttttctgtctatttcttgtaaaccttgtattgtttaccagtttcataaacaatttcaggatcatcgccagttcgttgattgcggttcagtaaatcaatcatgccactttcatcctcagatagctcaaagtccagctgatggttctcaataattcgactgggtgttttagactttgggatgactgctacgccattttgcaggtgccactttaaaatgagctgcgcaactgaaacgtggtggtgatccgccattttctttagcatttcgttatcgagtgttacaccgcgtcccagtggactccacgcctgtgtcacgatattttgcgctttatcaaatgccaccaatgcccgctggttcaagtaagggtgccgttcaacttggttaacgacgggcatttcctttgcctgagtctttaatagctctaggtgtgcgacgctaaagttagaaaccccaattgattttacttttccatcggctttaagtttttccaatgctcgccaagtatcgaagaaatattcctgtaccggccagtggactaataatagatcaaggtagttagtctttaaccgttctagtgagccatcaatacttttaatcgtattctcgtatccttggcttatttcagcaatttttgaagtgataaagacctggtcgcggggaatctgcaggttgactaatgtctgtcctagaaaatcctcgtttcggtaaagctgggcggtgtcaaacaaccggtaaccagcgtcaaacgcggttttgatggacgtatccatcaactcttgtgtattaattaagtaagttccgaagccaaccagtggcatttcattgccatcagccagtttaatcgtcgtttcagccatgaattggtgctccttctctgatagtcttctcttttattatagcaaaagcgcttacaaatattggcttttctttaaagaaatcggtagattagcccaagttgcttgtaaattttgtacaatgttagcaagagatatggaaggtggtttggaacatgccgatttcacaaggcttaacagctaaacaagtgcaacagcgaatcgatactggacggcaaaacgaaccagcaccgtcactaacgcgttcaattaaggccattttccgagacaacttactgacttggtttaatctgattaacttggttctcggtgctttggtgctgattacaggcagttataaaaacgagctgtttttaggggttgccatcgtgaatacggctatcggcatcttccaggaaattcgctctaagcgtcaaatcgataaaatgagtctgttatctgaatccacttatgaggttaaacgggctagtggaacagtggagcttcgccaagatgcaatcgttcaagatgatctgctggtgatgcaccggggtgaccagctgccagttgatggcctgattttagagactaagggtattgaagtggatgaatcacaaattaccggtgaagcaacaccgattgctaagacgactggtgattcggtgatttccggcagctttctggtcagtggccaagccgtagtccgagcaacccatgttggggcaaagagttttatcaatactatgtcaggcgaagttcagtcaggcgaaagtactaatagtcagctgctgaataccattaatcggattattaaaattctgaccgttgtgatcgtaccgctgggcactgtcctctttatttcgcgtctattaaaccacagcagtattaaccaagctattttagggacaacagctgccatgattggcatgattcccgaaggcctagtcttgttgacgtcagtttctctggcagtttcagcaatgaatcttgcccggcaccgtgtattggtccgagagctaccagctatcgaaggcttggcccgagttgatgttctgggactagataagacggggaccatcacgagtggcaaacttcagttgagtaaaattgtgcctttgcatcagcaatctctagatcaggtgaaactgattattggcggtaccattaacgccattggggacgataacgaaactgcccgtgcgttgaatagcgctttaactaatccggaatggcagccgacaaaagtggtgccgttctcttcggctcggaagtggagcggtgtcagtgttcaacagggtaactacgtcattggcgcaccagagtttgttctcaaacaggtaccggccaatttggcaaagcagatcgaaggatacgctgcggaagggtatcgggtgctttgcattgcccagactactgaaatgaatgctgatgatctaggcaatgtcacggtacttggcctaatcctaattgaggatgagattcgcgaaaacgctgttgagacctttcgttattttcagaatcaggatgttgccttgaaagttatttccggcgataacccaacgaccgtggccaatattgcgtcacgtgccggtatcaagaactgggcgcaattaattgatatgagcagcttagagggtgacattgattatgatcggttagtcgctaaatataccgtttttggccgcgttactcctacacagaagaagcagttagtcatggcctggcaacgggcagggcattcagttgcgatgacgggtgacggtgtgaacgatattttggcgttacgacaggctgattgcggtatcgccatggctagtggcagtgaagcggctaaaagtattgccgatttcgttctggttgattcaaattttgatgccatgctcaacgtgctgaatgagggtcggcgagtggtaaataacattgaacgggtggcgtccctatttttaatcaaaacgatgtattccgtggcattaagtatcatttttatttttatgcgaaatggatatcccttccagccaatccagctaacaccgatttcagtcttaacggtgggcattcccaccttcgtattggcactggagccgaattatcaacgaatatcgggacagtttatgaaacaagtaatggtgattgcagcacccgctgctatttgcgtggtggcctatattctagtgatagatctggtgggtggcgttcagttcaatttaaattacaccgagacttcgacgctttcagtactgttaaccggcgccgtttgtttggtggctttattgatggttgccagaccgcttaatcggctaaaacttgcattagtgctattgatggcagggtgtttcgccttgatttttattttctttggcaaactgttttctttggaaggtatcttcaactggcagatggcactgttttacctgccactgttagccagcatctaccccttcttttatcttgttcaagaagtggttggcaaacgaatactagcgcgaataaattggcgttaatccgataattctaggtccgcggtgagattaaccagcgggctttctttaactcttttaatatctagtttataaaactaggtaaacgtgctacaataattataaagtagttgaatatactatataagggagtggctaaaatggcagaattcgatcaatataatcgctgggaagctcagattcgtcaggttaagttaccgcattggagtgaattacccaagtttgatttgtatatggaccaggtcgtggcctttgttaatgacgccattggtcagctaggtgttgaaccaatcacaccagcaatgatcaataattacgttaaacaccaggtgattattgcaccagtcaaaaagaaataccagaccatgcagttagctgatttattgttgattgggctattgaagccgctcttttcaaccgaaacgattcgtcatggaatcgatcaagtgacggcgggggacttccctaagcaggcctacgataatttcatcgatgttttgaacaacgcactaaagaatttaggtcaagggcagccggaagcaccagctaaaaccttgaacgataagctgatgcaggttgctgcagatacgattttaaaccgaatccaatcagagcagttgctgcggatgattcaaaagccaatcaaacccattaaaaaagtgaaataatttctaaaaaagtcccgtttttgcggaactttttttattttgctctgaaatgccggtatcatcggatccagaagagaaagaaaattattttcaggaaaaatttcactttattgccttatagtattttatttcacaaactatatatttaaccgcttacattgctagtaaatcagtgaaaacacttgtatatactggtggaacaaggaaaaaattaagcagaaaacgtaaaaaaataaatttattttggctatttacatttaaaaaaagtatgatattatagtctttgtgaaagagataacaaagaaattagccagtattttcatgatggagggttaagaatgttaaaagaaatgaattcaaaatcaaacaatgaaaagcctaaaaagcctgttagcatcaatgatcagattgatgaattagttaataaagcacacgatgctctgtgtggaatggataattttgatcagaaaaaagtcgaccacattgtgcaccaaatggcaatcgccggtttggaccaacatatgcggttagctaaactagctgtggacgaaactggtcgtggtgtttgggaagataaagcgattaaaaacatgtttgccactgaagaaatttggcacagcattaaaaatgataaaactgttggtatcattgaagatgataaggaacgtcaattaatcaaagttgcagaaccacttggtattttagctggtgtgacaccggtgactaacccaacttctacgactatgttcaagtcattaattgccgttaagacgcgtaacccaattatctttgccttccatccacaagcgcagaagtgttctgtagaagctgccaaagtggtccgtgacgccgctattgcagccggtgctcctgaaggtgtgattcagtggatcgaagaaccaagccttgaagcaaccactgctttgatgaaccacccacaagttgcctcagtacttgctactggtggtcccggcatggttaaggctgcttactcaactgggaagcctgctttaggcgttggtcctggtaacggtcctgcttacattgaaaagactgctaacatcaaacgtgcagtcaacgatatcgttctttctaagacctttgataatgggatggtttgtgccactgaaaacagtatcattattgacaccgacatttacgatgccgttaagaaggaaatgaaggatcgtaaagtcttcttcattaagaagtctgaacaaaaagctttagcagatgccatgtacgatccaaagcgtggcggtgttaaagggccaatcgctggtatgtcagccgtcaatattgctaaattagccgggattgaagttcccgaagacactaaagttttagctgctgaattaaacactgttggcccagacaactggctctcagctgaaaaactttgcccagtgatctccgtttacaagtcagccaaccatgaagaaggtttcaagattgctaacgacttacttcacttcggtggcctcggtcataccgcagccattcacaccttggatgaagaccttgctacggaatacggcatcaagatgaaggctagtcgtgtattggtgaacaccccatcagctcttggtggtattggtaacctttacaacgaaatgattccttcattaactcttggtactggttcatggggcaagaactcggtttcacacaacgtttcatcgtttgaccttttaaacattaaaacaatcgcaaagcggcggaataatatgcaatggattaaattacctcgagtttactttgaaaagacatctgtacgttaccttggcgatatgcctggtattaagaaagccttcattgttgctgacccagccatgatttcacttggctacgttgacaaggtacttggcgaactgaagcgtcgtccagacggctttgaatatcaactcttctcagtaatggagtcagacccaacaactgatacggttgaaaagggttatgctcaaatgaagaacttccagcctgatacgatcatcgcattaggtggcggttctccaatggatgctgctaagtgcatgtggttattctacgagcatccagatgcaagcttcttcggtgcaaagcagaagttcttggacattcggaagcgaacttaccagtttgaaaaagcaactaaagcacaattcgttgccattccaactacttcaggtactggttcagaagtgacaccatttgccgttattacggatgctaagacccacgttaagtacccattagctgactatgcattgaccccagacgttgccattgtggactcacaattcatcgaaagcctgccaaagaagaccatttcatacgccggtttggatgttttgacccatgctattgaatcattcgtttcaaacatggcatcagattacacccgtccatggtcactgcaagcgattaagttagtcttcgaaaacttaacggcttcatacaacggtgatttacaagcccgcgaagaaatgcataacgcagctaccattgctggtatggctttcgctaacgccttcttaggtgttaaccactcgattgcccacaaacttggtggtgagttcggactccctcatggtttagcaattgccatcactttgccacacgttatccggtacaactttaaggaacctcgtaagctgaccacttggcctaagtacgaatacttccgtgcggatgaggactacgctgaaattgccagatacattggtttaactggtaagaataaggaagaactcaaggaagccttggttaacaagattattgaattagctcactcagtggacgttaccttgagtttgaaagctaacggcgttgataagaagcacttcgacgaaacggttgataaattagccgaattagcatacgaagaccaatgtacaactgccaaccctaaagaaccattgatcggtgaattgcgtcagattatgatcgatgagtatgatgggaaaggtgtagaaaagtagagagcgtaaaaaaaggcggttaacgcccagaatataagcaaaggcccccatacagtctggttttggactgtgtgggggcctttgcttatatggccgggcgttgcctttttttgcgcgtttcggcaatgtaacagtgatgcgtctggttttggactgtgtgggggttcttcttatatggccgggcgttgcctttttttgcgcgttttggcaatgtaacagtgatgcgtctgattttggactgtgtggggttcttcttatatggccgggcgttgcctttttttgcgcgttttggcaatgtaacagtggtgcattacagctagagtaaaaaagctgatgggtccgccttcggcccccagcgtctccatcgctgtggggaccggcgaaagccaaggtctttcgcctcgcatctaagccacgcaaagaacgcgcgtcttaaatgtcgtcccgtgctgtaagggcgaaacgccctaacaccaccgacacagcagatggagacgctggcgacctacggctaaaatagtagctctaatgtcatttgctagagaaagttaacgtgtatctttatctgcctgtccagacctttacacattcgatacgtaatccatacggaaacgataagaatattctttacacttagcgttgtagtgtaatgccactactaaacttatttgagcaggtgaaagggattgacaattacattagagcaactgtcaaaaacgtatgaaggaagtaatcaaccagttctcaaagatgttgccgttcagatcaacgatggtgagtttttcgttatcgttggtccatccggttgcggtaaaagtaccttattaagaatgattgccggtttaacatcgatttctagcggtcggttgttaatcaatgacaaggtcgcaaatcaaatgccaccaaaagatcgaaacttatccatggtgtttcaaagttacgcactatttccattcatgaccgttgccgagaacgttggctttggtcttaaatctcgtcaattatcagctactgagattgaacatcgtgttgatgatgcgctagcaatggttagtctatccgaacttcgggatcgtaaacccaaggaactttcgggaggtcagcggcaacgagtagctttagcaagagcaattgccagtgaagcaaaaatttgtttaatggatgaaccgttatctaacttggatgcgcaattacgtgccaaaatgcgtgtcgaattaaaacagctgcagcgaagtctaggtttaacggtcatttatgtcactcatgaccaagttgaagcaatgaccatggcggaccgtgtattggtgttgaatgataaaaaggtccaacaagttgatacacccgttaatttgtatcagcatcctcaaaatgcttttgtagcacaattctttggcacgccgcagatcaatttattgaaggcggatgtagttgggcatgacctaatagttgactcggtattacgcttgccattgacccaaatgaggctcaacgatagtaaggttcttgtggggattcgaccagcagatattcaaattaaaattggaccccaacaagcgaatgcacgagtggtcacggtttcgtacttaggagatcaatcggtcattactgcggttctgaacgattcgcaaaggttccgtattgttgctgacagtcaactgcaggtggctgcagacgatttaatcagaattgtgggtgtgaaggagtttgacgtatttgatatgaactccaaagaactgattgcgagtcaaaggggggacgtaaacgatgctacagtcgctgccacggaattctaattcaaaggatccaggtgcacagtcagcgccagttcgcttgtccacaactgctcaatggagtaaggacaatctttatgtggccatatttcttgggccgtcgttactgattttgtctgtctttgttttctggccgatgattaagaccctctatctcagcttgtttctaacggataatttgggccatgccagtgtctttgttggcctaaataattatatgagcctttttaacaatccagcctatctatccagtttgggtgctaccttgatgtacgtcatagcggtctcagttctgacgattattctggggatgttattagctgttgcagctcagcaacgactacgagggattcggttcttccggacgattttttcttccacaatgggaatctcagtttcagttgccgctattttttggctatttgcctttaacccatcagtcggggtatttgcccagatatcacaggcgttgcatttaccggaaattaactggttggccgacccacattttgcactactagccgttattatgacaacggtctggatgaatctaggtttcaccttcctgattttatttggtgcgctgcagcagttaccggccagcttgtttgaagctgcagaaattgctggtgtgggtaaaacgacacagttttttaaaatttcattgccattaatttcaccaacgttattttttgtcctgattgtgacgttgatcgatgctttcaagagctttggtttgattgatttaatgacggttggtggacccaataacgcaacaaatcttctagtttatcgggtttatcaagatgccttccttaatggtaactatggtcttgctagcactgagtcggtggtattaacggccatcattgcggtgatcacgttgattcagttcaaacttttaggaaagcgggtgaactactaatggagatgagtcaaccagctactacggggaccaatgttgccaatgccaaaaaagtaggtcagtacgtactgctattgttcctgacattcttagttcttggtccctttttacttggattgtggactagcttaatgcctacagcggatatttctaaaggtgccttgtggagttcacatatttcactggataactacgtagccgccatcaccacgacaccgattctcaggtatttgctaaacagcttagtcatttcaacgctgacgatgctgtttcaagttttgctctgctccatgtcagcttatgcgtttgttttcctcaaattcaaatatcgcaagcagctcttcgtgctgtttttaatgaccatgatgctccccttcgaagcagaggtcatcccaaacttttctactgtacgtagcctaggtcttttgaaccactatgcggccatggtgattccgtttctaaccgcggcttttggaacttttatgttacggcaagcatttatgcaaatgccggttgagttgaaggaagcagctgatgttgaagggctttctcactggcaattttactggcacctggcgttaccttacacgaaggtcactttgatgacgttggccgcatacagtttcctaagtagttggaatcaatatctttggccaatgctgacaacgtttagtgattcatttcgaccagttcaagatggcctccgccaacttcagggacaggaaagctttaacaactggggcatgattcaagccagtgccgcaatcgtggttattccaacactgattattctatttgtgggtcagcattattttaaggctggtcttaatgaaggggcggttaaatgatggcattcacacataaacgttggtggttcacattaggcatgttgttactgatattgccactgggagcttgtgcgagatcagaagcggccagtcgaacccgagttgttttttggcacgaaatgactggaccggggcaggaacaactcaagcagtttgctaaggagtttaacgctagtcaatcgaagtatcgcgtggagcctcaatttgagggtaattataacgaagcggtgcagaagattctgcatacccatggcacttcggcatcacccgctgtctttcaatctatggatgtttctaccagtcagttatatcatgctaaggttgccacaccaatgcagcactttattgatgcggatcattacgatattaacaaaatttcaccggtagctcgggccttttattcacagaaagacagtcaaatttcaatgcccttcaatacttcccaaccggttctttactacaatgcatcgttactgaaacggttaggaatcaaggcaccaccggttgatccttcctatagtgatattacgcgcgttgctaaggctatttcagccaagtcccatggcaaggtaaaaggactgactgttgaagagtatggttggttatttgaacagtttatggcaaatagtaacgagcatttagcgaaccatgaagatggtcgaacggggattccgactaaggtacatttgaatactccaggaacgcaagccgctatgaaatgggttcgtgagaatattaaggctggtgactttattgattatggtgccggtagccaagccgagtccaacgaaattgctgcttttcttgctggtaaattaggtattttcactcaatcttcagcctatatcagtcaacttttagctggtacaaaagacgaactagggatcacctattatccgcatcaagatggtaaaccgagaaacggtgttgcagttggtggcgcatcgctttggatcagtaacgataaaccaaaagcagttcagcaaggtgcctgggaattcgttaaatacgtgatgacagctaaagcacaggcgcaatggcaggctgcaactggatacttagcgcttaacaaggattctcaaacccagcccattttgcaaaagctgtacaaacagcacccatctgcacaagtgccaagtcagcaactggcaacgatcaaagctaatacggctaactcaggtgtcttcatggaaggtgtcattcaagaacgaaatttggcacagactgccatggcacaaatctataacggcacagacattaataaggcactagcggttgctgaaaagggattaaacgattcagttgcaaatactaatcgcgcgaaccactacaaataggggggcacaacatgtcaactttaatcttcggtcatcgcggaattcccgtaaagttcccagaaaattcactgcagggatttcggtacgctattgaacataacgttgaaggacttgaatttgatgttcatttgacccgtgaccgcttaccggtgattatgcatgacgaaaccattaaccggactacggatggtaagggccgaatctgtgattacgattttgatcaattaaaggaatttaaattaagtaacggtgagtccatccctacgttatatgagttattggaactagtgaagaatgttgatgtcttactcaatcttgagtttaaaacggatcaaattcattatgaaggcattgaagaaatcgtgttaaaacaagttagccaaacctatttacgccatccagtaatttactcttcgtttaatttagatagtttgaaaatttgtcagcaattagatgatagtcaaaattactgctttttaacggagcaaacgatccgcaatccattagcctttttgagaaaagaacgtttaaacgggttgcaccttaatcgcgctcaagatgatgaaggtttgattgagcgaatatggacggttaacgatgaagcacggatgacaaagcttttttcgcaagatgtagatggcatatttacggatgattttgaaaaggcgatggcaacgcgcaatcaattacttgttgggtagttaaaaagtttttgaacatcattcaaagtagaaaaatagcggttattactcaaacttgagtaatagtcgctatctttttgaaattaaatccgtcattccttttcgtacccatcactattctttggctgcttatcaggaaacaatttatacatccacttggagaagtaattagagccgatgataatcaggtaaacgccaagatacatggagacaatcagttgaatcaagaatactggccagcttttgattgtaatattggtaatgatcagcatggtagtcccccaagcgagtaaccaggcaggaacttccgcaaacttcaggatagtaccttgcaggaacaaaactaagaacgtcaaaaagccgaaaataatggcacttggaatcacatcacctaaatgtggaaagctgatgatccacagacagaaacaacctaaggcaataccgaataggaaactaacggaaatatttaacaccttatgcattggtgcaccggcaccaaagaagtaggaggcagcgatgaaggctgcaccactcatccagaggtgaaatgaaccggaaatcaggcaaaagatgagggtagtcagtccaacaccaatggatgagatccagacgtctttactaattttcatgatgccactcctttaacgaaaagccagtcaactgaacgcatatgtcgtttcagtggctggctttttcagcatagtagcagtttactatattaatgcttagcgataaagcttaattaagtcgttgtgaggcaacatcaatcttcgatggatcgcctttctttagtttttgttaaaattaagttttatgggtatttttagttgtttgatacatcaatcatatcatgtgttataggtaaagtaagcgatttcatcctgtttctttcaatcttattttacttgtgttagacttaaagaaaaatgagagaatcataaatttaaattgagagtggtggtttgaagtgaacgacagtatctacttgctaacgcctgaagataaaaatttcatttctcatgtctgccgtaatctacagacatttacactatgggtaaatgaatctggacatgctgaagatttcaaattaaaagaagcacgagaaagtagtgcggactatttattaaacacgttattagaaaagtatcatattgaattaaccgataaggcaaaagccgaaaaattactggcaactggcagtttagccgtggatgacattgatgttgttgcagtgattaaagaaattgcacggctaatcgatacgtatgctgccagtgtgtcttaacaggaccgtttatttagaatatgattgcgtgtagctagttttctatttgttgaagactagtttttttgcgttgtcttgaaagcgaactctcaaacagtagtgctgacaatttggtatactacaggtaacaaaatctgtatttgggaaacaggaaagaggattaactatgctaagttattttgccttgattacacttgttaaattatcagggttattgatcccgtttatttggttcttgtggatcagtaaccgacgatggcgaatttggggaaccgtagcgattgtggcattatttatcgtcagctatgtcaatacgtattttaatctgccagatttagcctatccgtctttaattgacggttggctattatggctgattgccggttttgtggtggtagcaatcctgcgtcgtttcgttttcaatcctaacgccgtaaaagaacgagcagtccacgaggataattttttcagtcgtttactgcgtagttttggtattactatcggatggattggccgcttgattggcgctgcagtagttgcaattgttgccgtgatcgttctaagcggtgttgcttcagtggtcacgacgatgaatcctaagccagccgtgaactcgattaagacagacatgaataattctacggatggcgcaccgatgccagtcattaaaaatagtgctgagacaccagtagttaatgcaccgcaaactgtttctacagatatgaataactcgttaaatagctttaaaaactccaacgtttatgatttgaatcatatgcgtgttcagatgtataacggcaaaatggtttacgtcgcacccgttgaattttctggtggcttctggcggtatattcattaccaaaaggtgccagggtacttcatgactaacgctacagataagaatgccgatccaaagtttgtggcaaaatctatgcgatatacgccaagtgcttactttaaccgtgatgcggatcgccggattaatgcttacagcatggggtataccatggttggcgatacctcgcagttggaagttgataataatgggacgccctattacgttcggacgttggctaaaccgatttcttatttcaaccggaactatgactttaagcactacaaagtggctgtattaaacacagtcagcggtaaggtgaaggtctattcaccaaataaggtaccgaagttcgtggatgtggcagctacgccagaattagtccagcaagaagtttcaatgtttggccgttatcgtcatggcttttggaacgctaccagttttggtggacataatgatgtgatgaagccaactgaagccggaactgagggtggcaagacattgacgccatatgcttataagggtcggatttattacttcaccgggatgaccagtgtgaatagtcatcaaagttccattcttggttacgccttcgtggatgcgcgaaccaacacccttcattattatcgtgagcacggtaacgtcatgacccctgagcgtgcgatttcatacgcacaacaggatattaacccgcaaaactataaagggacgttaccgttactatacagaattaatggcaatccaacctgggtggtttcgatgcttgaccgggataacaactccttcatgaagttcgtgtacctgctggcggatggtaacaaccaaagcggtacctatgcggttggcgatgatgcgcagagcacgctggagatcttccagcaacgtgtcggcgctaagacggggacaaccgttgagcctaaagtgactggcaagacgatttctggaaccgttgaacgggtggttaaacccgatgataagcagatcctgtttatcttgaagggtgacagtcacgtttaccggatggacacttcagctaagtccttccagccgattttccagtttatccaagcgggtgataaggttagctttaaagccactgcaacggataagaaccaattagcaacggctaatgttgggcttgaaacttataaaaatcagtcgataaagacgcaaaaataaattttaactaagcggtaaaccttgtgagcatgaagggttaccgctttttttaatttagtagttgacttattttttaatgtcagtgtacgggtcaatgtaatatagttagccggctaatcaaattataaaggtctgaaataaatggaaaaaggaaattttaaagatcgtcctactgctgctcgtttagccttaagtatcggtaaggcaaattcagatatcaacgttgacacggttctgcaatttttgcattttcagtattcttatcgggaaattcaacgtcaatatgatgcaatgctagcaaaatatcaattaacggaatcgcgattcgttatcttgatgtttctgtatcaggcccccaatcaacagttattaccactgcaattagcagaaaagttaggtgcaacgcgagcaactgtcagcaaactcttacgtgggttggtggaccaaaaacgggtcaataaacagccgtcaaccactgacaaacgtgccactttaattggcttaactgctgaaggagagagggctttactagactttctaccgcataattttaatgctgtccagaccttgtttggcgaattgtcgtcagatgaattaagtacattgtcccagttactagaaaagattaataatggcacacagacacttgaaaaagaaatggagaactaatcattatggaaaacgaaaaaattaacttcttaaggacttatatgagcttatacatcgggcatgacgaaattttgccaattgaaccagtaggctaatagcggttcaccgaagtatcaataacaaactaaaaaggagaatccatagtcacttgtttgagtgatgacgaattctccttttgattgttgtagttgttgatttttaattaacttattttgccgctttttcagccgcttcaatttcggctaaagttggaattgaagggtgggcacccatgcgttgaacagtgatggatgaagcccggttcgcgaagcggattgcttcagctaagttactgaagtctggttttagttgagaactcaaagcgccaatgaaggtatcaccagcagcagtagtatcaacggcgttaaccttgaaagcatcaacgaaaccgtagttgccatcagcagtgtgatagaaggctcccttgctaccaacggtgatgatgacacctttggcgcccattgcgtggagcttttcagcccccttgatcatggaagcttcatcagtaatctcaacaccagttaaggtttggcattcagtttcgtttggcacaaccaggtcactaacagctaagagactagcagggatggtttcctgtgcaggtgctgggttcaaaatcgtcacaacgttgttttccttggctactttgaaagctgcttcagcaacttcaagcggggtttcaaactgagtaatgatgaaatcactcttagcgatagtgtccttagcgttgtcaacatcttgagttgataagacttggttagcaccaccataaactaagattgaattttggccatttttatccagtaaaatgaaagcttgcccggttttagcatccttagtaatggtgatttggtcaacgttgatgccagaatcagtcattgatttcaccataaacttaccgttagcgtcatcaccgatcttaccgataaagtaagtgtcagcaccagcacggccagctgcgattccttggttggaacctttaccgccgccagcaaaagattgatcacccatagccaacgtttcgccaggttttggcaagcgggggatttcaaggattgtatctacatttaaactaccaattacagtaacacgattagtcattttaataggcctcatttcaaagtgtgagtgttttacaattaaagttaagtaaaacgttttacgtatcttgcactaataatatagcagatagtgtaagccgtttcaataattctggtaaaattctcatttattgggcaatgattttcaaaatttggcgagtttgatccacagttaattgtccgggagctgacactgccgacgttgttgcgaaggtcagtacactgttaaaagtttgacccgcaacccttgtgacggcgccaagtgaacccatggccatggtaataattggctgtgaaatattctgactggcatcatgagtggccaccattaagtttaagacatcatcgttgctttcgggcattacggctagtttgaccacatcaccatttaattgggccatttttttaagttgagccatcatttcactcttagtaggcgtatgttcgaactcgtggtgactgataatcgttcgaacctggtgagcgtgcgcaagagtgattaactgatccgtgatggttggatctcggcgccattcaatatcgatggcagtgacgtccgttcgtaacatgatttgagtataaagccttaaataatcggcgtccgcaatctgtcgtttaccgccttccgcacggtcacgtaaagtaacgatcaatggcaaatcaccgagaatctcaactaaccggtttgccgtagaaagaataccagcagtatcttctaaatcgttaaagtaatctaagcgccattcagcaatatccgctgaagaagaaacggcttctcctgcttgaccaatgacagtgtttgaatcaacgcccgtaatgggaacgcatattttaggaacaccgctaccaagcgacagccctttgaaagatactggtgtcatatgtttgatgacctcctataattaatctatttctcatctgaatttagcatgtttccgaaggggaagcaagcaaagatataaaaccagcaaggtggtatagccacatgattgtggaacatatttagataaatgttaggatgtaaaatgataaatgaaaattttaaaatggaaatttttctaatgaaattttaacagaagtaaagtatcatattttctattattgagaaagattaggtgagcgacttggaagcaactgagcaattagctgcaattagtaaatatactgcgcaaaaattagcgggtgatgtcacgggtcatggtgttgaccatattaaccgggtagtgaccaatgcgaaaatgctgttggcagaagagccttctgctgattacttgattacgctgagttcagcttatttgcatgacgtcattgacgataaattggtttcggatgtatcagctgcgcaacaagatgtggagcagtttttaagttcgattgaatttacgccggatcaagtgcatacggtgatgttgattattaacaatatgtcatttagcaaatctctgacggatgatcagcaaccactaccattggaaggccagattgtgcaggatgcggatcgtttggatgcaattggtgcaattgggattactagagccatctattatggtgggcatcataatgaaaaaatttatgatccgcagatagcgccgagaacaagtatgacaaaggcggagtaccgcaatttgaataacgaaacgatcattaaccatttttacgaaaaattgttgaagttaccggacagtatgaataccccagtagcgaaaaaaattgcaaagggcaggcagaagaccatgaccacttttctggaggattttaaggcggagtggaatggaatgaagtaaggtgcggaaacgagcggttagagagtgaaatataaggcaaggcccccataaatcccgaacttggatttatgggggccttgccttatatacaactctctgctcgttgaagcccgattaggctatatagaagtcgagagcccaattttgaatttatgggggccttgccttatatacaactctctgctcgttgaagcccgattaaaaaggtgtgaaagcaggcgttcagagaacgaagtgtaagacgattctggtaaaaatcccggttttggatttataccagaattggcttacatgcagttctctgcctgctgaagcccgattaggctatacaaaatcattcctcttccagcaagtccgtaaattcaccatcaaccaacttgcaaaccgcctcagcattaactttcactgaacgcccaatttgtcctgaagaaacaatgatttcgccttgttctttagctgtattatcgaagtaaattgggtacttcagtttttcccagataccgatgggcgtgttagcaccatgctcgtacccggtagttttgactagctcctttaaaggaaccatattgaccttcttattgccggaagccttagctagtttttttaggtctaagtgcgtatttagtggcaggacgcccacaacggggccggttattttgccagatgcaaccagggttttatagatagtatgctgatcaaaggtactttcatcaacatccatttgttgaacgtctccagcttcgtgagtagcaaacgaaagttgttcgtagctgatcttagctttatcgagaatctgttcgactaatgttttatgtaattgtccttttttcttcttttttgacatgatgatcattccttacttgagtaatttggtgcagtccagacaaacaattaataaggaccaattttaataatagtgcgtttcaatctatccgaacacttcaaaatctgttatactcgatttaattattaaatcagtgaactggttgcaagggagattggaatggcagatttagtttacagaagagtattgcatgacttgaaatcgcgaattcacgataatcagtttccagacaaacgactaccggatgagcgaagtctgagtgaagcatacaacgtcagtcgtagttcaatcaagcgagcacttggtgttttagcaaatcaagggattatttttaagaaacgtggttctggcactttcattaatccattatacatgaagaaccaaacgatttttcattatgaaggctcaaatttagggattacggacagttttaagagtgatgggcagacccagggaatcaaactgctgtcctttaaagtggtgcctgctaacgaagaaatgcaacaggatctctttttggaaaagggcgattttgtgtatgaaatcaagcgcctacgattattcgatgatcatccgtttatgattgaacgaggttttatcccgattaagattgcgcctgaactatcgcaaaaggtagtttcaggatcgatcttcaattatctggaagacgttcaaaataaggttgtgaccaagtcgtttatgacgatgaaagttgcaccttccaacgaagaggatcaggagctgctggccttaaagccaacggaaccggttgccatcatggaaggcattttcttcttggacgacggcacgccgtttgaagtctctaatatgcgtttgcggtatgattactttaattacaatacgtttgtgacgctggatgaagagtagtagtgagactgaattaaactttaagtggatataggaggctagcggcgcatatgccactagccccttttgcaatcgggttaatctgacaacagataatgaagtaaaggtggttctatgagaataatagaggcagtcgtccacgtgatggacaaggattcgggcaacgttgtagtatcacataaggcagttgatcctagtgacgtggtcatggaggaataccttcaaaaagtcatcgaaaaattgatgaaaactgagtatacggaaacacctctcgataattgcgagcttgtcaaacaactcgttgataatccgagtgatttcatcgatcattctgctcaaatcagtctggatttttttaatgcaattaagggtgcaacgaagattaatggcggtgatctgctcttcttccgtgctcaaaatgatgatttggttgatttaactggcatggtgaaactggactatactgccaagtatctccacgcagttgagtatgataatgatacgctggttaatacgattattcagaataaaaccattttgccatctccggttcagacggttaaagatggcttcttggtgatgggagatacgattcgagttcaatcgaaaaagtatgataataacggggaagactggagcttcgcacagaatattttaaagcttccggtggttaaaaaagtttctgaggaaatcaaaacgattgaaaaaacggttaaggaaaccgctaagaaatatactgaaacagatgtattaacggtgccacagacgcataaagcagtttatgagagtatcaaaaaagatgaaagcatcgatagtgaccatattgctgaaacggtttttcaggataatccagaagctaaggtcgcttttaaggaaaaacttaaagagcgcggagtttcggagacggttcgggtacccaacgcaccaatttttgagaaaaagtaccaaaaacagaaaattaaacttggaaacggcattgaaatgacggtgccagtagatgtcttgaaaaataaggacgtagttgagtttcgaaccaatccggatggtaccatgtcagttattgtgaagaatgttgagcgagattgatcaaacgaaaaatggctagccctgttaataacgaggactagccatttttgattatctgttagctgtttttaaccgtcgcgcctgaatatcatcaacgatttgatctaacgtaatttcagccatacttttctcagcttgtgcttgaacctgattgtaggcatcggttaaggcgccttgaatgttagcaccaactgggcaatcgacgttagtggtctcatcaacatgtagcaagtgatgatcttcttcaaccgcgttataaacgtctagtaacgagatttcagaagtggccctagccaatgatggtgcagccacaccaggttgactgaccagtaagccagctttaaccagagctgacatcaagcgccggactaaacttggatttgagttaatactgccggcaataccattactggataagtcgcctttatcttgaaaaatgtcgatgaaagccagtacgtgcaccgcatcgcttaacttatgagaatatttcatattaataacctcgattaaatagtggttctattctatagcgattcagtgacgcaatacaagcacttttacttatatgatttaatgacgtcggctaaatcggtttgtgggcgtcccagcacatctggtaaatcgctggtttgttcatctaaatcaccattgctgatgaaggtctgcattgatgtgatagctgcagctgtgccagcatctaagccgtgattgatcaacccttgcttaaactcatcatcgctctcagcgtgaacgtcaaatggcacatcgctcacttgtttaacgattgcggccaagtcagcatacaataatggggcacccgcaaattcgtaaacgtcttttggatcatcaagggtcagcactttggctgcggcgtccgcataatcagtttcggcagcccaaccaatgtggcccttaccttcaatgtagccgaatggctgtccctttaaagcgccctgaattgtgccaagttcgttttctaaataccagttattccgtaagaaactatggttaagaccagccgttaaaatcgctttttcagtgtatttgtggtctccgctcagcggtgacttagctgtttcaagttgcggataactcgtataagcgatgtaactaacgccagcttctttagcagcatcgatcacattttggtgctgttcttgccgtggcatatcaccaccaggtacggacgaaacgaagagcagtttgtcgacgccagtcagtgctgtgatcagactagacttgtctgtgtaatcaccgtttcgaacttcaacgccggctggaaccgtttttgaagccttgtcagtatttcttgctaacccgatgatgtgtgcgtctggcactagttgtgctaatgttgccagtgcccgcttgccaaattttccagtagcgcccgtaattgcgtaagttgtcataagtttattttctccttttgatgttactttaaaagtaacatgttatttaaaatgtaacacctggtgaagttgttgtcaaataaattaacaattaacctcgctcacagttacagcaaagggtgtatcttttgacaactaatcggttaattaaaaagaatcatttttttaaattttcattttttaatgattaatgaaagtcagtgaagcgggcatataagcctttaataacaggcgtactggttatttcgtgggctagcgcaatgacgttaatagattggaccgcatcaattttcaaagcggttgacttttatgtaaatgggactatcatagtgggtgtaaattatcgatacaattcgtacctggtaattaacacaccatttcaactgcattgaattacgtcgtgcagttatctttaatcaatcaaaggagtgttactctaatggcagaagattacgattccgaacaatatttggaaggcgttgacacgtactggcgtgcagccaactatttgtctgttggtcagcttttcttacgggacaacccattattgaaccgcgacttgacttcagacgatgttaaaattaagccgattggtcactgggggacgattgtttctcagaactttatttacgcacatttaaatcgggtcatcaagaagtatgatttgaatatgttctacattgaaggttcagggcatggtggtcaagttatggtttctaactcatatcttgatggcagttattcagaaatctaccctaacatttctcaagacgaaaaaggtcttaagaagttattcaagcaattctcattcccaggtggcgttgcttcacatgctgcccctgaaacaccaggctcaatccacgaaggtggcgaacttggttactctctttcacacggtactggtgcaattttagataacccagacgtaattgctgctgttgaaattggtgatggtgaatctgaaactggtccattagcaacatcatggttctcagacaagttcatcaacccaattaaagatggtgctgttttaccaattattaacatgaacggcttcaagatttctaacccaactatcctttcacggatgagtgacgaagacttgactagctacttcaaaggtatgggctgggatccagagttcgttgaagttaagaaccctgacgatcataaaccagttcatgaagacatggctaaggctatggacaaagccattgaaaagatcaaggctattcaaaagaatgcccgcgaaaacaatgacaattcattacctaactggccaatgatcatcttccgttcacctaaaggctggactggtcctaaggaagactttgatggtaaccccgttgaaggttcattccgtgctcaccaagttccactaccaattgctgcaggttcaatggaacatgctgatcaattagttaagtggttgaagtcgtacaagccagaagacttctttaacgaagacggcactatcaaggaatctgtccgtgatatggcgcctaagggtgaacaacgcatggctatgaaccctatcacaaatggtgggatcaagccagaaccattgaagttacctgactataagaagtatgccgttaaggtcactactccaggtgctgttactgcccaagacatgattgtttggtctgactgggttgctgacaccatgaagatgaatcctgacaacttccgtgcattcggtcctgatgaatcaaagtcaaaccgtctgtactcaatgttggatactggtaagcgtcaatgggaagaatctatcaaagaacctaacgatgaaaacatggctccccaaggccgtgtcatcgattcacaactttctgaacaccaagctgaaggctggttagaaggctatgtcttgactggtcgtcatggcttcttcgcaacttacgaatcatttggtcgtgtcgtcgactcaatgttgacacaacacatgaagtggttgcgtaaagcttcagaacaatcatggcgtaagcagtatccttcattgaacttcgtggatacttcaactgtcttccagcaagaccacaatggttacactcaccaagatccaggtatgttaactcacttgtacgaaaagaagcctgagttgattcgtgaatacttgccaggtgacgctaacacattgcttgccgttgccgatgttgcattccgcagctatcagacaatcaacttgctggttacttcaaagcacccacgcccacaatggttctcaatcgatgaagccactaacctggttcacaatggtttaggttacatcgactgggcttcaactgatcagggtcaagaacctgacgttgtcttcgctgctgctggtagtgaaccaacttgggaagtcttcgcagctgtttcattgttgcatgaagcattccctgaattgaagatgcgtgtcattaacgttgttgatctgttgagacttcgttcaccaaagaaggaccctcgtggcctgagcgacgaagaattcgaccgttacttcactactgacaagccagtcatcttcgccttccatggttacgaagacttggtacgtgacatgttcttcgatcgtcacaaccacaaccttcgtgttcacggttaccgtgagaacggtgatatcaccacaccatttgatatgcgtgtcttgaacgaacttgaccgttaccacttggcaaaggatgctttgttgagcatgccagaatacgctgtcaaaggtgcttccttcgaacagcatatggatgacatggttgctaagcacactgcttacattcgtgaaaatggtactgatatgccagaagtcacgaactggaagtggacgccacttaagtaatttaattgcttaaaagcattttaaaagcacttcgagatttagttctcggagtgcttttttgtggaatcgattaggggagggggttggttaagggggcatttcgttgcgtgaaaccaggcagctcgttgtggcttgctttggagctagcacttcgcttcgctcagggcggatctcctccgtcttcgcaaagcagtaaccttccaaagtacggaagctaactgctttcgacaccacgatctgcctggtttcactccactgcatttattctggcacgtttaatcaacagaactgttaggttgctgtcgcaaatgctcatatatcatttaaaaaggccttagccagcatctgattggatgttagttaaggtctataatttaaagattaagcttttagtgtcggtgtataaaagtagttcttgctgctgccaaccgagtaactgattgataggtcgcctgaaacaaccttgtttttccgaactgttaagcgatactggtagttaccctttttactgatccgtttgtcaggtaattttagcatgttcttcttggcatagtagtaagtcacattgcctttttgccttgtttttgtaatcttagttgaagaagttggcttctgattaaggttaccatttgcgaagtattcaacataattatcagtagtgaagtttagtttaggtgtcttggtccatgtattagaggcatacttgaacccttttcccaaagataatgaggctggatcattactttttagttttttcaaattatgactgtaaggtatcgtgatggaagttgtcttagtcgtatgacgaatgccatagctcatttgcgttagatcaatggaatcatattgtttgtgatttttagttgctgtataccaaacggatacacgcgtattagccggcaaagttacctttcccgatttaacctgtcgggtcgtcgttgcataaaaaggtttactagtagcagcgctggcttgcgttgacaggcctactcctgcagctgctaacaatgttgccatggcgagtccaaacattttgctgaatttcatgtgaaatcccccctttgatgctatcatactacaaaaatgggagggtactagtgtttgaagtgggattaattaaagctatttagtgatatttgtcaacgcaatcccagacgcctgtttagtcagcattttcttaatcacactagcaatataggcgccagcttccacggcagggacaccattcggatgaatgttggagataactgttcggcgggcttcaggcatgccaacagtgggccggtatgcgatgtaggcactcattgatttggcagttgctaatccggggcgttcaccaattaataggcaaacgacgtcggcatgagtggcttcacctaaatagtcttcaactgcgacccgtgcaaaacgaacgaaggggatcttgccaatcttgatttgtgatagcgcaagtccttgcttgatagccggaatcacttcggctgcgttggcttcaatggcagaagaactgagaccgtcaccgacagctaataaaacgcgaggcggtgtcggaaaagctggcctgagtttatcaagctcagtttgtgcgactattctgccgtgatcaggacgggttaagtattctgtttcagttttacaggttgactggagggctaaccagcccattttttgaataaacgtggtactgacatcagtccagacagcatctttagcagccgcatgatccgcacgtaatcgcagaacggatcgagtcgtataccgtgtgccgattcttcccagtcctaaacgagcggttgtctttttcttcatcgccaaataacctttagcgttggcaggttctttaaccgtcagctcctgttgctgatcaatggcacgtaaatctgtgatgctaccggtttcgtcaacgggtaaagcttctatacgaggtgcgattaatttcatttaaagagcctccttggttaaaaataatgatgcatcgccagctttactagttaactgaccgttacggctaatccccattttctccagccagccgtcaaactcaggcgtcggccgtaagttgagcaactggcgaatcgtggcggtttcttgatagcccgtagactgatagttcagcatgatgtcgtcagcttgagggacacccataatgtacgtgcagccagcagtggccagtagaaccgccaagttttcaatgtcgttttgatccgcctgcatatggttggtatagcaaacgtcgcagcccatggctagtccactgagtttacccatgaagtggtcttctagtccggcacgggtgacttgcttcgcatcatataaatattctggaccaataaagccaacgacggtgttgacgatgaaggggtcatagtggcgggcaaaaccgtagcaacgtgcctccatcgtgacttggtcggcatcaaagttggcatctgaagagagttctgatccctggccagtttcaaagtacatcacgttagggccactgttatgtaagcgttcgtgaccaagttgattagcttcatcaatgagttgacggttgatgccaaacgctgtgttggctttttcggaaccagcaatcgattggaaaatcagtccagccggtgcgccctgctcgattgccttcatctgagtggtgacgtgcgccagtacacaggtttgagtaggcacctgccaagttgtacagaattgatcgaacgctttaagaatctgagtgacgttatcaacggtatcgtttacgggatttaaaccaataacggcgtcaccgattcccatgctcagcccttccataacggaagccatgatgccgttgacatcatcggcagggtggttgggttgtagtcgagaagaaaaggttccgggacggccaatggtggtgttggccgttttttcgttggtgatttttttagcggtggtaatgagatccatgttggtcattaacttgcaaacgcccgcaatcatttccgaagtcaaccccttagaaatgtagtggatcatctgattagttgtttggggctccagcagccattctcttaattgctcaagggtccagttcttgatctggttaaaaacctcgccgtcgaggtcatcgatgatcatgcgggtgacttcatcatggtcatagtccacagcgggatgttcataaatatcggttaacgttaactgcgataaaacgattttagcggcaactcgttctgcggtatttttggcggcgattcctgctaaagtatcgccggatttctcttcattggccttggccatgacctctttaacggattgaaactggtagtggacgccagataacgtgacttttaaatgcataagaaaactcctttcaactgaagatcagtgttttaacgatgacggggacagcttcaccaccggcaacggggagaccaacatcgagatagtcaccggatgatgcgctaatttggtccagtacgacgaccggataatttggaggaagctggcttctaaggctattacctaaggcttgggcgacattttcctgcgtgacgatgatgagcggctgtcggtctttaatagaagcattcatacttttaaggataaccgccacccattgttgaaggccttcaaacgttgtggtgacgggacctaacgctagggcgataactgattgctcaaacagggataattgttgctgaatatttgcgaccactgtctctggtggatattcttttagcgattgagaaactttgacgactggtaaatttttcagtggcagcgttgaacgatcatagttgatggtactgccactaagcatcattgattgcgagccggcaccaatgacggtggcctgaatagtttcatctgcaggacacacgaccctttctttaaagagcaacgactgttttaaagtgtgtcccagaagaaggccgatgtcgccgtaacggaagggatctactggtaactgatccactaggcaatcagcaaccccgccagaaaaggttaagcgaactgttgacggcaccggttgaagcgatttgtccgttacaaattgattgaaataggcaacgggatcgccgaggccgatcgtattttctagtagggccaccatggcattaattaatggttgtaactgtgacacgctggtaacggcacctaaccggatcggcaggtctaactgggtaattaattgttgaattttcggcgcaatataagtgatcacgttgctgtcatgatcgagtcggatcaatcggcccccaatatcgaaacaggcggtgtcctgacagtcgccattgacgaagtaagccaggttagtagttccaccaccaatatcgaaattaatcactggctgtgggtcgggttgcgttagtagggaatgggctgcactcttgccagcaataacactttctaagccgggaccagctgttgcacaaacaaagtcaccagcgtattcactaagcgcgtgaaggacccgatcggcgtttgctttccgagctgtttccccggtcatgataatagcgcccaacttaaagctgctcttcgtaacatgagcacgatgatactgagaagtgacaaactgtttaagctgtgcagcatcaatttgggtttcactcagtaacggcgtgaaaatgacggggcttctatagatgatgcgtttatggctaatcgtcaattgtggcagcgaaaagccggctgagacatcggtaatcgtcagttccgcgataatcaaagaagtcgttgatgtaccaatatcgatgccaactgttcgaagcttttcaaccatgatgtcaccttcttttttgacttccatgttataaataataacattgattattttgaatgcaatcgttttttaatttttaaattagttgtattcaatttattttctgcttacattgtcgtgtaacgttgcattatcagcatttataacatggttatgtaaaattaaaaataaataagagaaattcgtgaaaacgtattgaaaattgttatttatgttatataatctaacatgtagtttcgatattcccaatggcaggtagagaggaacgtggttagatgagttttttaggtattgcaattttaggattaacattagtcatgatgggtttcattggtgtcaatgcagcacattcagtgcggcaatggcaactgaaccatgatcaagcgaaatcatcagccaaatcatttggctatcaacaagaactaattcgagatatgggcggtttttctaactttgcggtttcgttttcaattatttccattttaactggtgccgtttcatactatggctacgggttcagtcaaggtggtcctgcaatcatgggaattggctggccgctagtaacgtttttcgtcttgttcgtggctgctgcaatggctgaactaacctcagcagttccgacatccggagccatttatcactgggcagccattttaggtgggccaacgtggggctggtttacagggtggttgaacattatcggccaagtgacgatcgttgccggcatcgattatggctgtgcaacgtttgcctctaacttactaatggcgcatcctaataaaatgcaatttttgctcacttacgccgttatcttaacaagccacgcgctactgaaccatttcggaatcgatttagtttcaaagttaaattcactttccgccatctatcacgtggttggtgtcttgctgatcattggtgttttgatggttgccggtcctgaacatcatgtgagttatctatttagcacattttcaacccagacatcttcgtcaatgccttactggggtgcattcctgattgggttattacaggcccagtggacgttgactggttatgatgcctccgcacatactagtgaggaaactttgaatcctcgagtgcaagcaccatggggcgttttcctatccgttgctatttcgggaattttcggttttgttttattagcattagtgactttatcaattaaaaatccagcagcagttgctgcagctggtaacaacgcctttatcgttgccattcagcaggccgttgggagtcgcttcagtggtgtactgttgtggctagtgacgattgcaatgtggttttgtgggtgttcatctatcacgtcgtcatcacggatggtttacgcgtttagccgtgataacgggttaccattttcacggtatttgaagcgaatttccactaaatttcatacaccagcagttgccatttgggtgattgcagtcatcgcgtttcttgccggcatctctgatggcatttatgcggtaattggcaccatgagtgttattgggttatacagttcctactttgttccgattgcactgaagctacgggcacagtttcgaggcgcttggacagctgatgataacggaccatggcacttaggtaagtggagtgttcccgttagtatcgtcgcttgtctatgggtcatcttcttaatcggcttgatgatcttatcaccaacagacattcagttaacggctcacgtgatgctgcattatgctacgggtaagattatgtttgtggtcatcgtggtcttgatgattgactatgttctatcagcaagacgccattttgcaggacctaaattaggttcctacgagaagctgagcaatcgtctgatacaccacgttgccaaacggtcgacagtggaagccattcaactgaaaagtccagtggtgaaccgtccagttgtaaatcatagaaagtaacatccatagtcccgtgtcaagattcaactttctgccatttaacaaaaacaatgcgtattccgacaaaacttgacggaatacgcattgtttttgttaaattctgaaatctaccgagttttgtcactcactgcatcaagagaaaatatgcttgctaaagacgtaattcaagccaatgacgacgacttgatcaacaattttgacaataattggtgaaccgtgcatgagggtcagtcccacaaataggatggcggtatcagccagcaatgaagcgccccgaagcgcgaagaaactcatgccttctttaaaaacgacgctaggagccatgtcagttgaaacaaagacgactttcttgttggcgataaaggcaaacaagacacttaagaaccaagcaacaacgtttgcccagaaccagggaatagcgatatgcgtcaagctaaaaaagatgacgatgttgattaaggttgttagtccgccaacaacgagatagcgaaaggcctcgccatatttagtgtagagaattttgatggttttatccaaagttacagctcctttttaatcagacaatgttaacgggttttaagttatttgtagaacctacagctacgtgtgaaccatgcattagggtcatccccgtggtaaataaaatagcggtattaaccagcagtgaggcaccacgaagtacgaagaaacgcagtccctccttaacgacgactttaggagcagccattgcagaatcggcaaaaacaatcttattggcgataaaggcgaatagaacacttgcgaaccaagcaatcatatttgccaaagcccacgggacagcaatgtgagtcaaaccgaagaggaagacgatgttgattaaggtggttccaccgccaacaacgaggtaacggaacgattcactacgcttgatgcaggctattttgacagttttgtccattaaaagtaactccttttagaggtgtagtcggaaagtgtaaactagagaagcattttgattagcttgcccgttaacgatgaccgggtgatcagctaattgatagtggtaggtttggaccacatcgactggctgatttttgctggtgccatttcgaatcgtcatacgatattttccagctgtaaggtgttggtgaagatgatagtttcgtgttgctggcgttagatgataatttacatgtgttttgagattcattaagctggcgtttacctttgacccattatgaatctgtagggcaaaacggttggcagctcctgatagagtgacatcttcagtaatcgtctgttctggttgtattgtggtcggtttagcgtgatattgctcggaaagctgactacgttgtgcagctacgacgatggttttaaactgcgagtgaccaaagatgccagcaaagccaagacccattaagaaagtcactgccatactcaaaggtgccaggcgtttcggtgcattattagtcacccgttgctggtctcttgcgggaatcggcgttgcggctaataaaagccagatcaagggtaatgcagcttgaccataacgaggttcaacttcccatagcagtgtgtggaaagcaaaataacctagggtggtcacgattgctagcaacgcggttacctgatgactatcggtaagatcaggtcgccaaacgcatagcctgcgaatcagggtcaaccaaagtgccagagttgcggcagcgtaactgataatggtgagttccatgaagaaacgagcgtgtcgctggtaccaaacgggtgctgaacggaagccgccattataccaatcttggatacctctaacattcagtagaatcccaattttgactacccaaagtttgattaatcccaacgcgcctaattttttaactcgctttgaaatgtgctttaagtcagagtggcttcgagcggttttgttaggtagtttaatgtcttgacccacatcttgacctgaataagtcccatagtgagttgaattaacacccatcagcatccagtgagtgaccgggaaggcatacttggcttcaggtgtatagttgctggcgtggttgattgcttgagtagcaggaagacttaagccaaaacttaatgcaatcaaaataatgggggctaacaaccggctctttttaaataatttctttttcatcagaataagggcaacaacagctaaagccggcagcaagacgataatatttggtttaagtaacgcaccgattaagacactgataactagaccgataccagacaaaaagtggttcgtttttgagccctgtggccagtccatgacgactctcataacaatcagaaggactagcatggtagtcaaatccgaataaaaaacttgtaaatagtaggtgtaggcaaatggcgttagtgccaagaaggccaagacaccggctaccaaactttttcgatggcccattttccaaatagttgatagcagtaagacgataaagctatcaagggtgagaatgcttaataaatgtacggataagttagtcgtcaatccaaataattgagtgactctcaaccaaagcgacatcaggtaggctagtgggacgttattggcataacgccagaaatacgtaatgtcccaagtcatatggccggctgccatttgatccgcctgagaaagaacgcgataggggtcatggtagactgttaccggcatggtgcccaggacaaaaatttgccctgctagcatggctagtaagccaataccaattgcgagacggaaatgggtaaactttaatgtgttgatccgattagcaagtaactgggtactgatgcagatgagaacggctacgattagcaccgcgatgccagtgtaatcagttaaattgccaaggataccaattattaaacagccaattaacacagctgataaaaaagttggaaaggccttgcgagtcattattttcacctactctaagatggtttgaatcgtgtatcttggacggtcctttacttccgtcgttagtttgccaatgtattcgccaatgacacctaaactgatcagctgcacaccacccatgaaccacattgaaaccatgagggaagaccagccgtgaacggtcagacctaagatctttaaaataacagcatacgcaaccatgcccattgctaagagacaagcgattgttccgaggatcaagatcaaacgtacgggcgcgatggtaaggctcgtaatgccatcccaagcgaaggcaatcatttttttaagcgggtattttgattcaccagccattctcggggttcgtttgtattcaacgcgccccgttttaaagcctaactttggaataatgccacggatgaacatattgcgttcagggtagtctaggagagtctgtacggcccgttttgacatgaggcggaaatcagcgtggttggggactaattcgacacctagcatatggagtgttcggtagtagccttgagccgtagtacgtttgaaccaggaatcagagtcgcggttattgcgaacaccgtagacgatgtcgtcaccaccagcgtacaattcaaccatctctgggattttatccggatcatcttgaagatcagcgtcaatagtgactaacatatcagcagttttaacggcttcgtttaagccggcaatcaaagctggctgatgaccgaaattacgggaaaaacggagccccttaacgcgagaattttcttgatgtaactgttcaaccagttcccaagtgcgatccttggagccatcgtccacaattaaaatatcagcacggattccttggagtccttgtgcttcctttgctgcaatctggtcttcaatatcgattagacgatggactgaattaacaagaatttcttcttcgttataggctggaatcacgatagttagtttttgagtgttcataatgattgaatcctttccggtaaacatttaccgattaaatttttaatttgagtttcgtaaggcgtaatcagcagccagtaacctgatgctaacaaggcgctgccaatcacgtcagaagcaaagtggtctcggaagtaaacacgggagattgcgacaaacataatccagataatgccggctatgattgctacgattcggcaattacgttttttgattgatggtagaacaagcatgaggatggtaaaaacgaaaatagctgtgcaaaaggtatgaccgcttggaaaactgaatccagtgtcaggaattaattggtgtaacggtcgaggtctggcaacgattttcttgattatttcagcgatagcagaaccaaacagttgaagaccgccaatccaaaggctcaagattacgctgtgcctaatccaaagccagagacagaggatacaagtgataccgatcaccgttgctggactacctaggaatgcaatggctttaaaaacgattgagttcgctggggtcacgattcctgctaataatgttgcggtagctgaatcaaattgctgtagccaaactgcgtgagtaaccacgcaataggctagataggtgaagacaatcaggaaccctgcaccaacgagatttttttgcctagctggcatttgctgcacctccacgatgccgcagaactgaaatggcggctggaatcattgaaataccgacaaccgcaagcatgatgagctcaaagtgggttttgacgatcacgttattgccaagtaggaagccagaaccaagagtgattaagatccatgacactgcgcctaaaacgttgtagataataaaatcgcgatgtcgcatgctgctcatcccagctgtgaatggtgtaaaggtccggatgatgggaataaagcggccaaggaaaatagctgatttaccgtgtttttgatagaatttttccgagcgagtcaaatattcgggtttaataaaacggctaagcaaccgatgttgaaacagttttttgccgaaatgtttaccaatttcaaagtttagggaatcacccaggatggcagcaaggccaagtgtgagtatgaggataccgatattgagtgaatgggtactcaatgctgcgagtgatccgcatagaaacagaatcgaatccccaggcaggaacggtaggacaacaacgccggtctcgataaagattagggcgaataggccaacgtagacaaggctgccaaattggctgatcaggtgtggtaataaggtggtaagtattaatatggacataaatgagtcccccttcttatccagactttcgtcggttgataatgtaatcagaatagacggatttgtatttgctgcccacctataaaaactcaattaaaactcaattttttttagttaaaggatggtaaatattgcggcgttaggctttttatctgaagaaaattcagaattcacttaaaaagtacaaaaaaacttctcaaaaaaatttgagaagttttttgtaggtttaaagtatcttgcattcaggctggcctagatgcaatgtctaaggtgaaaatcgtgccagttgggtagttatctttaacacttagctcaccgccgagaagttctgttaattgtgcagcgattgccaatccaagaccagtccccgaaacggaaccgcgaacatccgcaccccgatagaaacgttcaaagatgtgtgctttgtcttcatcactgatgcctcgaccctggtctttaatggcgatttgcgaaccaccgtcattcgtttgaacaagactgacttcaatcgtgctttctttgggtgaatatttcgaagcgttggtcaagatgctgttgagaatttgttcaatcgcattttcgttaccagtgagatgtacatttggtactatctcagttttgaaagtttgtgggaacgtgtcggtcattttctgaacggtatttgccacaaccgcacttaaatcgagtggttgaacttccagcactaatcgatcagctcgcgataaggccagtaattcttcaatcagctgctgcatttggcgggattcttcggtaatatagcggactgatttttcgatgatctcggggtgctccttgccatgacgttcaatcaattgcgcatggctgcgaatggtcgcaatcggtgttcgtaattcatgggcagcattcataacgaagagtttctgctgttcttgtcgtttgtctagtttacccaataattcattaaagttggtagccagttcgctaacttccattggccgattagggacgggcaatttcatggagcctggttccttggcggcggcgatcactttggtcgttctagaaagactcgacacgggatcagtcagccgtttggtcagtcgacgaatataaagtggtgccacaagcacggtcaaaatgagtaaaaatgctgttacttcaatgacccggaagagtacagccaactgggagtacatattttgccaaagggtgtaagtgataccacgggcgtggactagccggtggtatagaaaaccaaagccgggacgatagtaaacgtgtggtactaaaggtacttttaccggtttaacttttaaaagatcacgcgcattaggtgaaaagtaatattcagttttagcgtctgcacggcgattatgaacgtaaacataacttgcactggtatctagcgtgctgtttttacgccagcttttccagtcatcatcgccatcaatattgactttgatgaggctgttagtaatgttgatggtattcgagccgacttctcttaacaactgatggcctaccgctagaatagtcattaatcctaaagcaagggtgagaacgaccaccatggtcatcaggcttcggagcatgatagctgcgcttgattgattacgctgctttccttttttcatgttgctcacctttcttggacgttttcagacagcatatagccgacgcctcgaacggtgtggattaacttttgctggttgtgaactgaatcgatcttagtacgtaagtttttgatgtagacatccaaaatatttggctggccgtcaaaatctacgccccagacgctatccaagagtgattcacgtgagcagggttcattttcatgagtaattaacacgaccagaagctcgtattctcgttgagttagcggaataatcttgccgttgtgcgaaacccgcttattttcagtatcgacagttaaatctgagacggtataaacttttgcggtttcttgagctggcacactgtgacgtaatgccacctcgacacgggcaatcagttcttccatctcgaatggcttagtgacatagtcatcagccccgccagttagtcccgcaactttatcaccgatgtaatcccgagcagtcagcataataatcgggacttgactggtttttctaattcgtcgtagcacactgaagccatcaaggtgcggtagcatccaatccagcacaattaagccaaggtttgcctgattatcccgaaacttatctagtgcttccagaccatctttagcccaaatcacttctacattatcaagttccagttcaaattcggttgttaaggagtcagctagagccgcttcgtcttctactaataaaattttcgttttcaagggatatcctccaaggttagatatgtatcaaatttgcggtggttgcagatgtgaaacaatgaatgattttgtagttatactataccatcatccactaataggaacctagattagaatgaaactaagtttttttgtaacttttttaatttaaatttaccaaaatgatgacctcatattttgtcctttaccacttattttggccaaatgtttcagttgatttggtatgataaacataagattggacgcacggaaaaagggggcagctagtatgctaaaaatcgaacacttgtctaagcggtttggcgatttacaggccttaaatgacgtcacctataacgtagaaaaaggcgaaattctaggcttaattggtcaaaacggcgctggtaaatcaactacgtttcatagcattttaagtttcattcattacgacggccagattacttggaatggtcagccaatcaacgagcaggttttcaatcaaattggttatttacccgaagaacgcagtctaatgcctaagatgacggttgaacagcagattctgtacttagcgcgtttaaagggtaagtctgccaagcagattaaaccggctattgatcagtggatgcaacggtttgaagtgaaagggaaaaagaccgataagatcaagtccttatccaaaggcaatcagcagaaagttcagctgatttgtacactaattcatcgaccatcgctgattattctagatgaaccttttagtggcctggatcccgtaaacgttgatattttggagcaggcaattttaaacgctaagaaagacggtgcagcgatcatcttttccagtcatgatatggtcaacgtggaagcactttgcgacgagttagtcatgatgcgtaagggtgagatggtactgcacggcgaaattcgttccattcgtgaacagtttggtaaaaatgaaatttttgtcactacggattggtcaaccgcgcaattatcacagttacctcacgtggtagaagtgacggcactttcacatcagcgttatcgcttaagagtggatgatccggcagctggcagggagatctttcagcgactgtcaaacggtgaatatatggaagaattcagtcaacaaccgccaaccctagacgagatcttccgattgaaagcgggtgaccccagatgaaaaagatgtggatcgtgacactgaccacttatttacgtcaggtgaaatcgtggagttttgtcatcttagtgctgtcaccatttattatgctgctagtgtcgtttggtgtgggctttatctctgctaactcagcgactgatggtaacgatatcgcggtggtagctgatcagccagcactgcggcaagcctatatcaaagtcgctggtaaggataaagtggatactaaattaaccactgaagcagcggctaagcatgcacttaaagcaaatgatatcagtggctacgtgactttaagccaaggtattcagtatcgtgcggtttaccatggtaaagaggcgatgtcagcttccgacaagacacaactgacgggtttcttgagtaagctgcagacacaaaataacgtggctcaagctaagctgactcaccggcaactccagcagctatctcttcagccaacttttaagcaggttattcagaaacgtgatggcctagtcaaaactgctcgcaccgtttcgttctggatcctagtcttcatggtctacatgattttgacgacctactcgtcaattactgcgcaggaaattgcttccgagaaggggactaaagtgatggaaatggtcttttccagcaccacagcggctaagtatttctgcggtaagatcctcggtgtgctaatggtgattgggactcaattattggtatacctgattggtggctggatcagtttgatagctgctaaacaaatgaatatggccaaaccattctttgatcagtatggttcattggttgatcaggtggttcataatctcgtcaatgttaatttgctgttcttattcttgggtgtgattatctacacgatattagcggcctttagcggtgcgttagtttctaaggctgaagatgcttcaaaggcagcgtatccggctgtttatctcagtatgattgcgttctttgcaacctttccatttcagaacaatgcggatgctttggttgtcaaaatcatgtcctatgtgccatttttctcgtcgtacttcatgccgttacggattattaatcagtcagtgagcccgatggagattggcatctcgctaggaattttgattctgacaatcatcggtttgacctggtacatcagcagtatctataaggggctgattttacaggcggatgaaagccatttttggcagagactgcgtaagggagtggcttataaataaaaaaatagagccaaccgttattttttgatttgaaataacggttggctctatttgaatggttgttgttcaaactgccgaaaaggctctggcacactggccgttagcataatatggttaaatgaaaaaggtagtggtaggcgtaactgccaactgtgcaacagtaatcgttgctgtcgtgggtcattagcatatagtggatcgccaacgattggatggccgaggccggcaaagtggactcgaatctggtgggtgcgaccggtttgcagttgaacggcaactaaagtggcatctgacttacgactgatgactttgtaacgagtaatggccatttgcggatggtcaccatttagctgccgttttcgcttatcagctaaattgcggccaatcggcattgcaatgaggccctgtgaactattgaggcggccgtgaacccacgttaaatatgtacggcgaactaatttttccttaactaagcgaactaaaacgggcacgattgctggatttttggcgatgagtaatgcgccactggtttcttgatccagtcggttgataacgtatggttgctgattttttggcgctaaataagcagcaacgtgattcaaggttgtgccgacttcgccaggctggttgggatgagttttgctgccctgagttttgttgaccaccagtaagttggtgtcctcatacagcactttaacggtggcagcactatcgggtataacgtttgagtacggatgctcaaaatcagttgctagaaatgtcaggttgatacggtcgcccggatgtacgtcaaaattgactgggagatattggttgtttaccaatactcgtttaccgcgttttagactaaataccaagtgctttggcagataccagtctgtcataagtagctggcgcaacgtcttggtctgaaagtcgcgtggaagtcgtgctgtgaactgccattgtgtgggttgagccatgaaagtacctccaaaaaagcacccttacccgagaatgggcaaaggtgcttggtgtctaacgaattatttcttatttaacttcgccaattcagctggtttaacgattaagacatcgcaaacagcagaacgactgacatagttggtaaccgagccaatcatcaaacgttcaacggcagttaaaccagttgaaccaatgacgatgagttgagtatcatgatcagctggaaattcacgggcgataacgggtttaggattaccaaaccgaacgtgaatatcaactgacctaacccctgcgtccaaggctttttgttttaactcgtttaaacgtgcttgcacgtcttctgaaagtttgtagatcacgtcgccactaacggcaccaccgtaagtgtcactaaactggttaacttccaagacgtttaagatatccaaatgagtatcgtttaacttagcgacttcgattgctttgtctaacaccggatcagtggctttcgatccatcaaccggtgcaagaatgttattgtattgctggtccatatacgccactccctcacaaataataaatccatcataaaaccttttcgtaagcacgccatggttttgcccaacaaaacgaaccactagtacttcaccctttattttaccataatttagccattagtattaggaaaatgaaaacttgttattgctggatcggcataatagtcaattgactagtggataaagaagaaaagctaagtcatttcaaagctttcatattttgcactgtatttgtaagtcttttcgtgggctaaatcgttgttattttaggtgtgaggttacataataatagtatagaactgattggcgactacggccgtcattaagggaccgctgtaattagtataaagctaattacagcggtttcattttgcctataatgcggtaaactaagagtaaaaccatttgaaggagcagctgctgtatgtactattacaatatggaaacagaagatatcggttataatctagcgactgaacaatatctgatgaataataaagactttgatgaacctattttactgttttactaccaaaagccctgcattatcgttggccgtaatcagaataccttagaggaaatcaatcaagattacgtggcaaaacataatattcaagtgacacgacggctttccggcggtggtgctgtgtatgacgatctcggaaacgtatcgtttagcttcgtggtggatcgcgatgacgaacggtttggtgattttaaagcctttactaagcccattgttgatgcgctaaaagagatgggtgctacatcaatcgaagtatcaggccgtaacgatattttagtgaacggcaagaagttttccggtaacgcgatgtatgtgaagaatgacaaaatgttttctcacgggactttgatgtatgacgtcgatcaaagtgttatcgctcatgccttaaacgtgcccaaggataagattgcgtctaaaggaatcaaatcagtgcgttcccgggtgactaatctgaaaccgtatttaaaaccagaataccaaaacttaacgattgccgagttccgtgacacgattttacgaaaagtctatggcgtagacgatctcgctaaagttgctgacaaagcttatcatctaacggatgaagataaaaagcagattcaaaagctttacgatgactactacaacaactgggactgggtttacggtacgtcaccagaattcacagtgaagagacggcaacattttgatgcagggacgattgacgcacgagtattagtggaaaagggtcgcattaagcaggtgaccttcttcggtgatttctttggtgagaagtacgcggttgatttggcaaaaatgctcaaggatgttcgttatgaccaaccgtcactgcgaaaagcattagcccatgtcaatgtgggtgattattttgctggtatcacgctggacgagtttgtgcaatttctaggttaaaagcgagggcaatggttttttcgtgcacaatttaagtgcccaaactgtaaccccttacatgattatggtaaaatgaaagtcggttacaaaagttacaagattggttattaatatttggaagggaagtttggacatgcggtatgtttctatgacagcccacgatattgggcgtaacttagctactgaacaatatttaatgaacaataaggatttcggtgaacctttagtgcttttctactatgaaaagccatgtatcattgttggccgtaaccaaaatactttggaagaaattaaccaaaaatacgttgaggagcataacattacggttactcgtcggctttcaggcggtggtgcggtttatcaagatcttggtaacctgtgcttcagtttcgtgctggatagtaactctgaacagttcggggacttcaagtctttcgttcagccaatcgttgatgccttacatgacatgggggctacttcagtagaagtttctggccgtaacgatattttagtcgacggtaagaagttctctggcaacgcaatgtataccaagaatggtaagaccttctcacatggtacattgatgctggatgttgatcaaaacgtgattgcggatgccttaaacgtgccagaagataagattgcttcaaagggaatcaaatcagtgcgttctcgtgtaactaacttgaagccatacttggcacctgaatatcaaaacattacggtaccagaattccgtgacaagctgttgaaggaattgttccacgtagacagtttagatgaaatcaaggataaggaatacgttgttacccctgaagaacaaaaagaaatcgataagatctatgaacagtactacaacaactgggactgggtctacggcacttcaccagaatttacggtaaagaagcgtcaacactttgattcaggtaccattgatgcccgaattttagtagaacaaggtaagatttccaaaatcaagtttttcggtgatttcttcggaccaaaggatgctaatgaattagctgaacagttaaagggaatccggtatgaccgtgaaaacttggaaaaggcgtttgctgatgtagatattagtcagtacttcatgggtattaagaaggatgagttggtggatttgttggcttaggtgcggaactaggcgtttagagagcggagtgtaagttgactctggtaaaaatcccggttttggatttatatcggcattggcttaggtgcaagtctctgcctgttgtagcccgattcggctatataaaagtcgagcagttttctaccaaccacaacccaataaacacaaacatcaaaacaaatacaggtttgccccagcacacattgctcggagcaaacctgtatttttaatgcggaactatgctacaatttgagctattaataacgattaaggagaaccacatgttaaagcaaaaattaatcacacttggcatcgtttcgtgggtgcttttttccgcgatgaacctcgtgatgtcatctaagttagtcgcgttagggcatccctttcagctgaaagccattatcagttcccttattatttcattggtgctttacgcgttacccatgatttggggcgccttaggtcataattctggctattacgtcttagcgatggtaatcatcatctattcatttggcctgtttaatggtattgtaacggtgatgtttagcagcaaagcaattcttagtatcaaagcggcggttatcctggcagacttcttagtcattctctttaatggctactggatggtattagcattccgatatcgtcactggcttgataataaacgtgataatgataagctggaagaaattaaaaagatgcagcaggaaaaagccaaacaaaataagtaatcgaggtaactatggaaagtttagtaaaggacttcgttgaagaagttgaagctgaaaattatgatacacagaattttggtagcagtttagctgaaatcaaaaaggatggtgcggttaagtcgcttgagccaatggtcaatatgatcgttaaagcaattggcgaaaataaattggcacaggccacgctgaccttaacggatgctgatattcaagtacatctggaaactagcgtggtcaatctgccattacgttatctgaatgccatgaagaagatgctggcggatgatgatactttaccaatcagtgtttatagcattgttgaatcaccagatattaatgcgtcttctttgcgaattgataaggtggcttcggcagatgattttgtcagtcatcaagctgatatggcaactgccatcgcaacgtggttagataagcagttagatcaaatcaaagagaatcaggaaaagaaagacgaagatgaggatacagaaacgaccgacaaatgatgatgttgatttgcttctggtatcaatccgtgctatgatactttacatgcgatgagtcgagaatatcacgtcgctagcaatagcggtttgcgcgagcaactaggtgatttttttgcacagcaggcaatgtaacaccgccggatttgcggctgccttggttcaaaggaaatgtggatttttgagaacccatttagtttcggctaagtggctgtatgggcgtcccagtgatggggcgtctttttttgtggtcaaaaaatgaaaagggacatcaagattggtggcagtcttgatgtcccttttattatgtttaacttataattattcaaatatagtgatctttttaagtttcatttaaggtacacaaattagcaaaacaactgatacaacaaggctcaatctataattataacaaaatgattgcaaatgcatttcatgtcactaattgttaatttttatgcaagattgatgtaacgctcccgttatattaccagcgtaacgtggatggtgaaatcaagtgagggagtgttttaaatgagtcgaaaatatcatcttcggattggactaatcgtggcattgagctttgtgtgttgcctatttcttggtgttcaaacgcaagccagtgcggcagatgccacgttagttagtcaaagtaatatgacacccaagacttacgtcagaaaatcaacaaagggtggcacttacaacttaagtttgaatggcagtgccatcacgttcagcaagaagacccattcgttgtcgaattatcccaataccacttgggaagccactaaaaaaatgtatatgaagaaatcaaacggtgttacatatctttattactacatcaccaataagggcaaaagcgtttctggctggatctggcacggttatttaaaaactggtgtcacctcaacaaccgtactaggttatgccaaacaacagttaggcaaaccctatagctatggcggtaacggtcccagtgcgtttgactgttctgggttaacaaagtatgtctaccagaaagcagcagataagacgttgccacgcacggcgcaattgcagtacaacacatatgcccacgtcagcaaagctaatataaaaacgggtgacttagccttctttggtggcagtaccagcagtatttcccacgtcggtatcgttgcaggcaacggtaaaatgatcgacgctcaaaactacggggtcattactgaagcaatttccgcaccgtggtggcacgtggtcggttatgcgcgcccaatgacgttgtcgtagatttgaggtgaatagatgatgaacttaaaacagttaaaaacaacgtgtctcaaatgggtcgtatgtagcctagcgctatttagcggtgccatggcagttcaaacaacagcgcatgcagcggtggggacttctattccagatttatcggaatggcaaggtgcgctcacggctaccgaagtgcagaatttaaagaaaaccgttccgttcgtaattttacgtgttcagtatggtagtgactataaagacaaagattttgcgaataatgctgctctatgcgaaaagtacgggttgaagtacggtgtctattcgtttagccagtatagcagtacgtcagacgctaaaactgaagcgtcagatctgtattcccgtgcaccttcagcggctttttacgtcaacgattatgaagatcagaccgttacaagtggcacgacgaacagtgcgactgcggcttggtatagtgagttaaggtctaaggcgccacataagcgaatcttattttattcctaccaaagcttcgccaacgagtacgctgccacgtccatgaagaactatgatggctactggttagcagcctatcagtcaacggaaccaagtatgagtcatgtgttgtggcagtacacggatgcttggcattcttctgcgctgaatcaaaatgtggatgccagcaagaagcacgttaagaatactagttggttcttatcatcgcgggctatcggctacaacaaggtagtgaccgtttccaaggctaattacaccatttggggtaatctagttttctcaagtaaaaaaggaacgactaaagtggggaccgactacacggccaagtactactataatcattacaatggttcgacctactattcgctttacgataagcacggcaaatgggtcggctatgtcaataagaacgctatgacggtcatgaaaccaactgcctataatcagacagtgacgttgaagaagaatggctatagtctgtggaatagtctcttgtttgcgactgctaaatacaacagcactaacttgaaggggcgttcatacacggctaaatatacttatactgccggtaacgggaaagtttactactcactgtatgatggcaacacctggatgggttacgtaaacgccaatgcgacgaagtaggaaggagtgatcgagatgaaaaaacgcgttttaattccagctggcatcttggtaacgggattgttatcagcagttatctttgcggggccgcttgttcatggtaatgaccaaccaacaactgcggatttatcagtgcctaagacggttcagaccagtaatcaaacggctacggtgaaacaagtaaccggaacaacggccaacgcaaaagtgacctatcagcaatcaggacaatcacagccaacggccacttatcagcagactactgaagcgactgcaactaaggctaaagatgtgatttcaaatcaagatcacagtggcgaaactgtgaaattaagcgatggcacaaaggcaacggaacaaggtgttatggggcacatttatgtcagctggagaaagggtaactggtcagtgacaacggtgactgatacaactcaaaccttgcggactgatccggaaaaattagcgactcaggtcaatcagcagctaaagaacagtggcatcacgaatcaggctgtcgacaaaggtgcagtaacggtatattctagcgctcaagatgatactgccaatcagattaagtggcaaaataacaaacaggttgaaaatgtgaagggacaacaagcagccactgtgtatcagattgctaataaggtccttaattaaaatcccaagataatttaaatataggtgtcactacaaatgtgacatcacaaaaagctgtcgagaatttcgacagcttttttagattccataagttgcaacaaatccggaacacgggcagcgtcaaccttactagaattgtcactgtaatcgcgattgcagtatcacaataaaaataaagtgaggtaaaaattatgcctattgatgtttcaaatacacctgatatgtatgaaattgatgctaacggaacatttacttttaacactaaagttggggtacgcaatgatctcagaatttcgatacctaaaattgcgcttctgactgtaaagtttctaaatcctgtaaggctttggtagataacagagctcactcgtgttaaaatgtaggcatatcaaatgtgttcaaagttatcaccagccgttgtggtcgctacccgcaacggtctttttttgcaacaaaaaagtatcaccccgctacaaggtgatacctgtggtgccaattgttagactgatgtcgcaacacactttactttcggtcgtctaaccagtgatctatacaaagtagaatcaccccaactagtaaaggcgcgataatcgcggtatcaaatgtattcaaggtcgtcaccacctctcgacgcggtatcacgtgtgcaaggcgttgcgacaattaatattgtacactattaaaatcaatctacgaagatcaacctttattcgttgtgcgatttctcacgtagacgcttatttggcatttctttggaagaaaaacaggtactcattttcttggcagttggagccttgaaaaagatgacttaattccttaaccaattggaatcaggtcatttttgcgaataatttaaaaattccagtagcgaagttttagctttaaacgcttgtacattgtccccccccaggaaaaagactataattaaagtgctttttaaagggaggatattgaaatgaacttaaagaaacagttaggcttgtcattggttgttggcggtggcttgttgttcggcttatcaacccctcagacaacggctcatgccagcacttatttacggtattacgagaacattccgaacaagacggtctcagtaactaacaagaacgcctacgtttataacaatggtcgcctatcccgtaagatgggaactatgcgttattacggttcaaaggttgaagaatactatgctgctcacgtggtaaagaatggtaaagcttcaatctactacaagttccgtgtaggtcaccgcactggctgggtatggcatggctacttgaagtcaatcgcttcaagcacgggtactacgcctactaccacaccaacgaataccacaactactacaccaactagtggtgcaaccacacctactaatacaacagctggcggtaagtcgattgcccctggcaccacagttgataatatggattggactaagcttgaacagcaacgctatgttgatgtcactcctagttcagcttatctaatgtcattattcccaggcaccatttacaatcaaaaagttcaaaatgctgccaaattatcgtgggcttcagatgatagtgcagggtttgactatggaaatagtgcacaaggctatcaaagattcttaagcgccgaaaatatcaataccaagggctatgttgctatttacttcaacggtattcagccatatgatcacgcttctattgacaaggcactgactaaagttggctatgatgccaatgcccgttctaaatttgctggttggtcaattggtgctgaatataacgaaccaggtagcttaaatgaaggtgtcggagatggtgatgggttaatcttattagtcccaaatccgcaaactaagcaattcatttaatatttaatagattaaagtaagatggcctagtcccttaactattgggatcaggtcatctttatttgtttcaagtaattaaaattaggataattatcctatgaatttagggttataggccttgaccttggttaggaagtttatttaatggatggagatgacttttacaatctttttaaatacctttttaaccccgttttaggtgggatgtactcgtactctcccaagagatgtagaaccttatggggtagtgttttcggtcatttttgttctagttttcatttctaaaatcgaccagtaaaatctaatcactccccttgcgaccaacctttacctctgctacatttaaggcaaagacattatgtatgcgaatgggggaatgtcatatgaaaaagagtgttacggcattagtagttggactcgtgctgggcggtttaggagttgctgccataccaacgactggggaagcagctacgtcctggaaagtcgttaagaccaaggactatagtgatgtgccttattacattaagactaccagtaataagtatatgtgggatttaaagcacactaaaaaaacgcataatctcaagcattatccgcgaacgacttggtacgttgataagcgagttaaactgcaattggggaagaagtccggctactattaccaggtggccaataacaacggtaaaattaagggcttaatttactgctcgtatttaaagaaaggtgataaccctgatgatgcttttgctcatagcgccgtagtgaaatcctatggtggtggtttagccggaatcaaatcggttcgtgaagcggcaaaattacaggcggacattctggcactgtttccggggacgatcctcaataccagttattcaaatgatgcccataatgatttgaacgccggcgtcagcaaaaccgctacttattcgaaacttaacaagaattcggcggccattgggattttcacgccttacaactggaccagcacttcaagcaaaacggattatacgaaactagtcagtgcagctttggatgcacagggctatacggcgtcaaaacgagccaaatataaggggtatcaaatcggtatttacgccacacctcatggttatacgtctgattaccataattggcctagcggttacggttcatttggtatttacctggtacccactggcgattctaaattattttaggggggaatgatatgtcagtcattagtacggtgttagtggtgattgttgcagtagaggcactattgatattatgtttggaaatgtttggctcgcaaactgctgctgcaaaaagggcctttggtttttcgatgcagtatcaacagcagccagaaactaaggccacaatggctaattttggtttgtataacgggtttgtgggcatcggcttactattcatgcgcttcgggatgcctgccaatgcggtaatgccgggttgcttactgttcacggcttttgtatttattgccggcatcttcggtggtttaacggtaaatcgtcagattgcttggactcaagggattcctggtcttttagcactattgagcttgttactatttagataactctcgggctagaaaactgtcttcaaaggtgtcgtcacgctgcagatactgtttgccgaattcatccaactgaccgtgaaaatcctgtgccattttgtaggtgaaattatcgggcagggtgacttgctgtttcaagtgctggtaagtaccagtgcgctgataacctaagtgtttaaagaggcggcgggtgtaggagtcagcaataaaggttggtaaatcaaagatgtataccaggtaaacatccgcagtctcctgaccaacgccaggtagcgccagtagctgtttgcaaagctcggtctgagtggtacttgcagccacggcggcgtagtcccagtttcggtcgtcgaaccactgaaagacattgtggatggccttagctttattacggtaaaaaccgcttgctcgaatcaggtcaattaattcagtttgtgataacgataacaccgcttcggggtccaactcggtgcggtgttttaggttgtttaagcccacatcggcattttgccaagcagtattttgaaccaaaatagcgccgacaataatgtctcgtttatcatctgcgggccaccagccagaaggccccatgtggtcaagcaaggtttggtagagccaattgatatctattgaaatggtgaaggccttctttctgtaagatgctgctagtcttattttacatgatttaaaacgaggagcgcaaaaaagcctctttatccagtattttcaaggataaagagacattcacgggtttatttatcattaccccggatatacaaaattagttctgttcgccatcgatttgtttttgaatcgtgtacagtaattgggttaacttcgtggcttcagcatcagacaaagaatcttctaaaagaatgttcatttgtgaaaaagacttttgaatgtcatcgactagatctgcacctgcttgggttaaagaaagcagcttggttcgttcattttccaccggaatcgtgcggacaatgagattacgacgaactaacccctttaataagttggtgacactggcttcttgccggttaaggtaatgtgcgatatcacgctgcatactattagggtgactggcaatgaaattgattgcccgggcctgatccgaattcaggtctaaggtgcgtagttgctggttcaaatactgggtctcgaaacttgcgatacgatgaattaagctagcagttgttttagtgttcatgatgaccccctcctccaaaatataactcagaaatgtaattcgattgtaggataccagcatatgcttgcaatcacaaccataaagacttgattttgacaaataaatttaaatcagttgggtttacaatggttggaaatgctgatgtaaagctgatattaagtgattattaaaagtaaaattataaacttattattatcggctgaacagttcgttttaactgtcgcttctgcaaaaacaggaaccacaagtccaagggtttggaagagtgattcctgtttttgtaaacagttgtgcctatctcaccggattggcattaacagctgctttcatttgtttggtataatcggtcagttttgctggtgcttggcgaccatattcagccacgatgttgacacaggcactaccaacgatggcaccatcagcgatttgcgccatttcggtggcttgttctggggtgtgaatcccaaaaccaatggcggttgggacatcggtgactttacggatccggttaactaagtcagctaagccatgcgcaaattcacttcgttcaccagtgacaccgagtgatgaaaccacgtaaataaagccggtagcagctgctgcaattttttcgatacgatcagcagaaattggggttactaacggaattagatcaacgttgtgcttttctgcaataggcgctaattcgccacgttcttccaaaggcatatccggaatgactaatccgtaaattcctagttcctcacaccgagcggtaaaggcttcgtatccatattggaagacgatgtttaaataagtcaggaacgctagcggcacatcagtctgcttgcggatttccttaaccatatcgaaaatcgtatccattggtaaatcagggtcggcttttaaggcgcgtagatccgctgcttgaatgacggggccatcagcgattgggtcggagaagggaatgcctagttcgacaatatccgcaccaccctttgctagtgcgaccacgttgttgacagtaccttcaaaatcgggatcgttggctgcaacgaacgggatgaaggctttttggtttttaaaggcatcagttaatttactcatcaatatccactcctctgtatttagcaattgaagcaacatctttgtcgccccgaccggagagggtgcagacaatgatttgatctttacgcatctttggtgcaattttttcaacgtaggcaaccgcgtggcaactttcgatagcagctacgataccttccgttttggcaatgtattcaaaggcctgaacggcttcgtcatcggtaataccgacgtattgggcacggccggttttagcgaggtaagcatgttctggaccgacacctgggtagtcaagaccagctgaaattgagtacactgggttgatttgaccggtcttgttttgcaggaacatggacttcataccatggaaaataccatcagaaccccgttcaactgtggctgcagttaattcagtttcaacgcccttaccagctgcttcagcaccgaccaattgaacacttggatcatcaatatagttggcaaatgaaccaatggcgtttgaaccgccaccgacacaggcaaccaccatatcaggtaatttgccagtcttttccttgagttgcttctttgattcttggctgatcactgattgaaagtcccgaaccattaatgggtaagggtgtggaccagttgctgaacccatgagatagaaggtgtcatccacccgtttagtccagtcttgtagtgccgcgttgatagcgtctttcaagaccattgaaccgctggtaacggggtgcaccttggcacctaacaattccatccggtagacgtttagccgttgacggtcagtatctttcttccccatgaagatttcgcattccatcccaaagtaggcagcgatagtcgcggttgccacaccatgttgaccagcaccagtttcagcaatcaaacgggttttgcccatgtgttttgccagtaaggcttggccaatcacgttgttaattttatgtgcaccagtatggttaaggtcttcacgttttaagtaaatttgagcaccaccaaggtctttagtcatgcgttccgcatagtacagtaatgaaggacggttcgcataatccactaataaatcgtgaagttcggttttgaattctggatcatttttgtaatgttcgtaagctttggtcatgcgatccagttcgttcattaaagtttcggggatatattgaccaccgtattcgccgtagcgtccggaggtattcttgttaagttccaaattaagttcagtcattgataggtttcctttcattaattagcatgagtagttgcaacgattgcgcgaatcttatcgggatctttttggccgttggtttcaacaccgctagagacgtcgatcacgtctgggtgaaccgtgttgatggcggtagtgacattttcgggtgtcagcccaccagcgagaataaacggatggggtgcttttggtactcgcgtccagtctagagcaattcctgaaccattgccactatccaacatgacgtaatcagctgcagtaggtgtgattttcgcatctggtttaaagacttggaagacggttgcgccagcattttttaatgctttcactgtgtcttcggattcatttccgtgaagctggacgatttgaatcgcaccgctgtgataaatttttaacatattttctagtggttcgttaacgaatacgccagccgttggaattgatgggtcaagtagttgccggaattttaaggcagttgccagtgaaatttgacgacgacttttcgcaaatacaaaaccagcgaaatctgggtgcacttcattaaccacctgcgtatcttgttctcgcattaagccacagattttgatttgcgtcatgtcatcacactcctaataattgcgtaattttttcagctttatccggtgcggtcattaaggcttcaccaatcaagataccgttcatgtggttttcttccatcacctttacgtcgtctctagtatggatgccactttcagcaacgaaggcaatattattaggtaccagtttgcgtaacttgatgctgttgttcagtgaaacatcgaaggttcttaaatcgcggttgttgacgccaatcaacttggcacccacgtctacagctcgttttaattcctgttcgtcatgggcttcaactaaggccgctaatcccagttcgtgtgctagtttaaagtagtctttcagctgctgatcactgaggattgctactattaatagcacgatgctggcaccagctgctttagcttggtaaagcatataagaatcaactacgaaatcttttcgcagaaccggaacgctgacgttagcagcaatttcttgtaggtagcgaatgtcacctttgaaataatcgggttcagtcaaaacagaaatggcactgacaccgtgctgatcataatccttagcaatttccaggtaggggaactggtcagcaattaatccctttgaaggtgaggctttttttacttcaccgatcaaatgaatgccaggagcattgaaacggtcgtaaaccgcttgtgaatccttagtcggcgctgcggcggctttagccttcatgtcgtcaactgaaacaacttctttttcgcgttggaggcggcgtttcgtagctgccacaaggtcgtctagaatcatgctacttgtgctcctttcgttaagtcgatgaattcgtcaagtttcttttgagctgcaccgctatcaatcacttcggcggctttcttaacggcgccttccatggttaattctggatgtgcggtgtaaagggctaaaccagcgttcaaaagaacgatgtcacgttgtggccccttcttgccagctaaaatattacgggtgatttgggcgttatcagcaggtgtaccgccaacaatgtcttcctttttagcacgtttcagaccaaattgttctggtgtaatagtgtaagacttgaagttatcaccacgaacctcaaccacgtgggttggggcggaaatggaagcttcatccaaaccatctgtcccataaatgactaaggcattttcaacacctaattcgtgaagcacgtgggccattggttctaccagtgaatcatcgtaaacgccgaagagctgcataccggcgtgagctgggtttgccagcggtccaaggacgttgaacaaggtccggatacccagtgtcttacgaacgggagcaacaaaacgcattgctttgtgatattcctgagcgaacaagaagcagatgccgatttgatttaaaatatcttcgctagcttctggtgtgacgttgatgttaacgcctaaggcttcaaggacatcagcagcgccgctcttagaggtagcggcccggttaccatgcttagcaactggtgtaccagcggctgcggcaactagtgacgaagtggttgaaatgttgaatgagttggcgtggtcaccaccagtaccgacgatttcaaggaccggttcgccggctttgaaggttaaggcgtggtctctcattgagttagcggccccggcgatttcttgtactgtctcgtgtttgactgtcaaagcggtaagtaaacttgaaatttgaatgtcgtttgctttgccatccatgatttcgttcatcacgtcgttcatttcgtcaaaggttaaatcgttacggccagctactttagtaattgcgttttcaatagtcattgtcatggtaaattcctccagtttattgtcagttcgtgttcatcaattgagttgattcatctgagaggttttgccatcgtttttcgttatttgggtttgtcatgattaagatctcctttggaatacaaaaactccgcccataacattcacgctattaaaagcgctttgttaaggacggagttaaattccgcggtgccaccttaatttgatgcagggactgctccctcgcatcacccttagcgaaatgcgtaatcacatttccgacaactgacgtatgtctgtacgtttcctcgtactcaagtaatctttcagaggaaccctctgtggtccatttaactatctgcgttcggtcgcactctcagctacggcggctctctttacgtgcacgataatcttgatctccacatcattggtttgtatgagcgaatttgtttgattgacattagattaaaactttatgaaaatattgtcaacacttttttctaaatttaattttataaagtgtcgtcagttgagaaaactcggtattttaatgccgagatgaatcaacgacttggacggccaccattgtattggtctaactgtgaatcaatatattgactcacaactattaccaagcgtattcataaagaaacttagagaccagagatgatcctgccaaagtaatggtttagtttcggaaaattgaatgaaccactgtttagctgaaccacttttgaaggctttccaattgaagaaggcacaaatttgggcggaaagctaatcactatgtgaacatgatttggcatcacttccatattagctatttcaaccgactgacgttctgcaatttctgtcaggatgggatttatagtagtgatctgtttttcagttgtaaaaataaataggcttacaatatttagtcccccaaaactaaattaaaatcagacacatttgggtgtgcgtgttaaatcatacgattgcctcctaatgcttctattccgggattctggccattcatactagaacctatgataaaatattaggcgtaaggaggtgcatctaaatgacttaccaggggattaaattacgactgtatccaaatcaggatcagcagtcgaaaatcaaacttaattttggctgtaatcgatttgtttggaatcaaatgctcaacatgctgatcacgcgttaccagaacaattctgaagccaagtttttaaaggctttcgacttgaataacttgctgccggcgctaaagacggaatatccctggttgaaggacgctgaaagcactagcttacaagtcactaatcatgatttaactgaagcttttaagcagtttttcaaaaagcggcatggttttcctagatttaagtcgcgtaagtatcccaaacagagctatcagtgcaaagtagtcaatcacaatattaaagtcgttgaccgtcaccacattcaattaccaaagttagggaatgtatcttttagagcaggtcgattaccagtcggaaaaatcaaggctgtgacaatccgactttcagccacgggcaagttctacgccaacgtgcaggtggataccgacatcgaagaattacccaaaacttcccaagttgttggtattgatatgggagtggctgacttaatgatcacttccgatggcgttaaataccccacgattcggtttgataaacggctcagcaaaaagaagcattactgggagaggcgtctggctcgtcggagacgtcaagcagaaagggagattgcctgggatgagcataataaggtactagaaccccgaggactaaacgactttaaaaactatctgaaagccaagcgcattgtagctaaatacagtaaaaagattgccaatcaacgggataactatctgcacaacattactaaagaactggttgaaaaatatgatgtgattaagattgaagatttgaaaatcaaaaatctgatgaaaaatcaccaacttgcacgagcaatcgccaaccaatcttggcgaaagcttcgtataatgctggaatataagtgtacctggtatggtaaacagttggtcactgttaatccgcgcaaaacttcccagatctgttcagtttgtgactatgatgatggtaagcacaccttagatgttcggcagtggacctgtcctaattgtggtattaatcatgatcgagatatcaatgccgccaccaatattctaaaagcgacagggtagctaaaagaccaactgggctggaacatcccttagtcaatagccgtaacctctgtgcagcattcattgaatgctgtgtaagtcagcggtgttcctagaagctcgttactttatttagtgacgagtagttcacgcaagcttgccaagcgccattgcaatgcgaatctgagccaaataattttttataatctgtttgccaacttcagcgtcggtcataatggattcaggatggaactgaacaccgtaaacctggttagcttcgtcagccacggcttgaatcgtaccatcatcagcggttgccgtgacggttaagtcacctggcatggttgagggttcgataactagtgagtggtatcgagcagcttcaaattgaaggggacaatttttaaacatgtccgaatttccttgctgagtcatcattgaaggcttgccgtgcatcagtttcggtgcgtgaactacttgggcgccgtaagcttcaccgattgcctgatggccaagacaaaccccgagaatcggtactctgccaataaagacgcgaagaatctgtatcatattaccggcgtcttctgggcgaccaggacctggagagaggatgatcccagtggggtgtttggccaataattcatcagccgtgagttcatcgtttttgactacggtgataggttcttcactcagtgtgccgatgagttgatacaagttataggtgaaactatcgtaattatcaattagataaagcatgagcgacgcctccttgatctgctgtgttaattgcgttaaccactgcacgggctttgttgttaaattcctgatactcgtatttggcgatgctgtcagccacgatgccggctccggaatgaaccacgatttgatcacctttacggtaggtcagccgaatcccgatgcaaaggtccaagtcaccgctgaaatccagataaccgagacagccaccgtaaacgccacgtttgcgattttcgagtttagcgataatctgcatggcggagatttttggtgcgcctgatagcgttccagcgggcagaactgcgttgacgatatccatggcggatgctttcgggtcagcagtactttcaaccgttgaacccagatgcatcacgttagcgaacttcagtaggttacgggtcttagtgaccttgacggaaccaaactgactgacaacgcctaaatcatttcgacctaagtcaatcagcatgttatgctccgatttttccttttctgaagtctgcaattcatgagcaaatttatcgtcttcttctttagttgccccacggcgtctggtacccgctaatgggtaggtgaacaaggtgttgccgcgtttagtgatcagggtttccggtgacgcacctagggtttcaaagtcgcggtggtggaagtagaactgataggggcttgggctatctctgaacagggttggcgcaacgcccagtaacgaaccgctcatagcagcttgttgcggatttgagaaaatcagttggaaaatatcaccgtccacgatgtgtttttgggcaactgcgactcgttctgaaaattctgaaaggctgaattggaaatgaaagggctgagtcaaagcaaagcgtggtagtggctttggctgagcattcagaatcagctgttgaagctgttttaaatcagccatcacatcatcgtagcgttctttcagttcatctgttggaatgatttgactgatggtgactttttgctggcggtggttgtaagcaatgacgcggtcaaccaacagcagatctgcgtcatccagattcattgggtcagctaccttttgtttgagtgccgttgtggcatacttggcataatcatagctaaagtagccgattaacccgccagtaaatggtggtagtccagagataagaggtgtttggtgcttttttaagatgttttccaaaatcggtttgagtgccgtttctttggtggtggtttcgccaccttcaaccgtggttgtcagtaccccatcacggtaggtgaaggtttgctttggggcgagaccaataaaggtatagccatcttcggtcttcttaggtttcccagttaagagaaagccgggttcttgagcttctttcaaagcgttgaatagcgttacagcgtcaaagtcgggcagctgaaattctaaggtaacgggtgctgctggataacctttggcagcggtgagcagttcgtttagtgtcatggtaaattcctccaatttagtgtttgttagggtttaggatattaggatttggagtttgccatcgtttttggttgttgggatttgtcatacataggtgctcctttacggttagagtgctgaaacgcgttcgagaaaactgagacctgcatgtaaggaacttggaacataaatccaagaccgggattttcgttccaagtcccttacactccggtctcaaagcgttttctctcacgctctgcaacaaaaaaaccgcccataacaagaacgctacaaatagcgtttgagttaaggacggatattatttccgcggtgccaccttaatttgatgcagggactgctccctcgcatcacccttagcgaaatgcgtcatcacatttccgacaactgacgtatgtctgtacgtgctcccgtacttgcaagataggcatcatagcctaaacgtgttacggttggcagagacctatgtacaagccaactaaaacataaatccaaaaccgggatttttgctttagttagcttatacgctggtctctaaacgccaacctccgcactctcatctttcagggcgcccctctatggtccatttaactacctgcgttcggtcgcactctcagctccggcggctctctttacgtgcacggtaatcttgatctccacatcattggtttgtatgagcggtgtttaattggcacttacattacgcaataatttaaaatttgtcaagttgaaagaataatttacttattcaattctaatagtcattaatgaaagatagtcggctttaataaacgagagtaattttgtctgatgtaagaacctctgtcatttagtaatcaacttaatagttcacacggataatgattgttttaatagccttagtattttttaaagtgcaataaagcttatatttcgggacatttggtcgctaaatgatactttgaaaatatttgctaaaaatatttaaaaataatgatgcagccataaaagccgttaatatgcactttttaaagagtgtttgaaaattaaagaagattaaaattaggttagtacttgacagaattattctaatagtttattgtcttatacaacaaatcaaaacagcaaagggagttccaattatgattctgaaaacgaaagcattaaaccgacaattaaatcgatttagttactattggtcaatgtagtgtctacaccggacaggttgcagacacgcatcactgcaatctgtgcggccaatagtttttcagcatcattgccggtcacacagaaagtttacaaaacactgtgtgacacggaaaattccgttgttataaaattcgacgtcaaaacgtctcgcagtgttttgtgaaaacaaaactttgcgagacgtttttattttgaataagaaatttaaggaggtgacaaattggttgatgcacacacaagtttatatggctttattgctaaaccagcgcggcacagtttgtcaccgctgattcacaacacaagttttcaggcgttaggcatcaacagcgtttatctcgcatttgacgttgagcaagcacagttcgaaagtgccgttcaatccatgcgagcgctgccgatacaaggtattaacgtttcgatgccatataaacaacagattattgaatatcttgatgagctaactccggtggctaaacaactggaggcggtcaacacggttattaaccaagatggccgcttgatcggtgacagtacagatggtgaagggttcattcatgcattacaggatgaacgagtgactgtgaaaggtaagcgagtagcaatattaggcgctggcggtgctggaagagcgattattttagcaacggccaacgaaggcgcggaagtcaccgtctttaaacggcaaaacagcacgtttaacgctttgcaggaacggcttaccagttggtcagaacggatccgagtttttccttatgaagatcaggttcaaatggcaaaggtgcttcagcaagcggatgttatcgtcaacaccactaatcttggcatggcacatgacgcacgcagccccgtttcaccaccggtcatgcaagtgcttcacgcgggtcagatggttgccgatgcaatctatgcaccgcttgaaacaccgttcctagttcaggctaaacagcagggttgcaacacgatgaatgggcttggcatgttggtccaacaagcggccgggtcatttaaccgctggacgggtcagcaaatgccagttgataacgttaaagaagcaattaaacaacaattagaacacaccaaaaagtgaggatgataaatatgattattgtattaaagaatgacgaccaaaacacgattgcagaactccaacagcacttcggtaatacccacgaaatttttgtccataataatcgagtagccgtgcaaggcattacggatgcagatttatctgatagtgaacgtgcagctgctgaagaactgattgataccgtacccaaggctgtccaaggtagccgtgaattccatccagaagatacggtgatccgaacaaagcacagcattatcggtggagacaacttcactatgatggctggtccatgttccgttgaatcagaggaacacgtaatgaagatggcagccgttgccaaagctaacggggcaacaattctccgtgggggcgcctacaagccacggacctcaccatactcattccaaggcttaggcgaagatgggttgaagttcttacgccgagcagctgatcagtacaacatggatgtgttgactgaagtcatggatgacgagcacgtgaagttggttgctaaatacacggacattttccaaattggtgcccgtaatatgcaaaacttctcattgttgaaagcagttggtaaaacgaatatcccagtcatgttgaagcgcggcatgtcagctacggttgacgacatcttaaacgcctcagaatacattgctgccggtggtaaccacaacattatgattgctgaacgtgggattcggacattcgacaacaaatacactcggaacacgttagacgttggcgttgtaccagttcttcagaagttaactcattacccagttatcatcgacccaagccacgcttcaggccataccgaatttgttacgccattagccttagccggtgttgctgctggtgcttcaggtttggtcgttgaaattcatgatgatccagcacatgcattgtcagatgggccacaagctttgaagccaaatgaattcaaagaattagccgacaaggcatttgctattcgtgaattattaacggatatgccggtagaacaagcggaagcggggcgctagaatgacaactgtttctgtgaagttaccagagacaaaatatgatgttttaattgaacgcggcttgttaaagcaggttggtgaattagtttcaaaacagtggtcagcacgtaaaattgcgctggtcagcgatgacaatgtagcaccgctatatcaggagcaagtttctgactcattgacggctgcaggcttcgatgttcaccgttacgtttttccagcgggtgaggcttccaagtcactgaccacgctggctgatctagcacggcaaatggcgaacgatgcttttaaccgtgatgatagcgtaatcgcattaggcggtggtgttacaggcgatttggcaggcttactcgccgcatcatacatgcggggactttcgttcatccagatgccaacgtcattgctggcacaagttgatagctcagtgggcggtaaaaccgctgtggatcttgataacattaaaaatattattggcgctttttacgagcctgatttagtgattgttgatcctgataccttagccaccatgaaacagcgtgacttggttgaaggttacggtgaaatagtgaaaactgctgcactggaaggtggtgacttttggcaactcatcgagaccatcaatagcccagccgacttaatcacccattcacccgaattgagcgcacgttcgattcattacaaggctacggtggttatggctgacgaaacggaaagcggtacacgtcagttattaaacttcggtcacacgattgggcacgctgttgaagcgttagcggatggcggtctgcgtcacggagaagctgtcagtattgggacggtcgcaattatgcgggtattcgaaaacgctggtttagcggaagagggtattacggcaaaattacgtgatcgctttgcggctgttggcttgccagtgacggatgagttattaacctcaccgcttgtgctggacaaagtcaaaaacgataaaaagaaccggcatggtcacttgaatttagtctatctgacggccatcggaaaacctaaaatcaagtcgattccaagtagtgacattgcttcatttttacatctatctgtagctgattagttattgatagcacgtcataacagtgtttgggaaggcgttgttacgacgttaaggacattatttgaaaatttgaaatagtttaaaaaaattctgaggataatctcctcagaattttttgagtttcaagataaaaatcacaaacttattcataacaaccgtgaagtcgatacgttacactggttttctgatacaatagagaaaagtgaaaggaaggatcgccatggtcacaatccgagacattgctaaacgtgctggagtgtctgtctcgacagcatctcgtgcgttaaataaccatcccaaaatcagccagaagaccaaggataagattaaggcattggctgacgaaatggggtatcggccaaactacaatgccaagaatttgactaacggtgtatctaacgcaatcggcgtggtatttccacctggggaaatgagtctggcaactaatccgttttatgtggatatcctgatgggcattaatcgcgagttacggccgagaaatggcgttttgtcagtcgccattgctaacactgtggcagaattgacggccaacgtttcagcactgatcacgcaaggccttattcggtattttgtgttgctgtactccaagaaaaacgaccctatcgttaaactactgcgggaacaaaaagtcgactacgttgtcatcggtgatcctaacagcgaagatgaaaacttcgttaacaacaataatcggttagccggtcaaaaagctggcgaatacatgctacataagtttaatgctaagcggacgttatttgttgaatctgatcctgaacagggatacgaacggcaacggcgattaggctttcaagaggctatggccacggccaaggtgcccactgaggtgctcaaagtaactgatcaaggacaacttcagttggatgatgctgttgcccagtttttgatgacgcgtcaaacaatagagggaatcgtgaccactgatgatacgcttggggtcatgatttatcagctgctttggcggcagcttgatcgcgacattccgttgatcagttttaaccgtaatcggccgaatgatttgttgatgggaagttcagtccgttttgttgaactctatccacaaagtatgggtgccgcggcagttagagtcttgcttgatccgaagaaacggtcggaaatcattccgtttactatagagaggtaagtctactgaaacaactaacactgtagggtttagacgccgttgattataaaaatttttaaaattattttgagtggggctgaagcctatcataatggggaagagcggaattttatgtttcgctttttttaaaaaaagttagtgcaaccggttgcattattatggaaccggttgcataatgttttttgtagaaagcgtttgcaatcatttttaattcttttgaggagggattcatatggcacaatcagcaactgaggttactgatgggacagcaaaagctgctgagcccaaaaaagatttactgccatcattgccaactagcacaattttcctgatcaacttcgggttcctaggtgtccaaatggcgtttcaacttcaaagcacgaacatggggcggattttccaaaccattggtgcgaatccaaataatttaggtttcttcttcattttgccaccactggccggaatggtcgttcaaccgttagtcggttatttctcagaccggacctggatgccgaagttaggccgtcggattccgtatttgttaatcggtgctgtggttgccatgatcgtgatgttcttgctgcctaacgctggtagtcttgggtttggttatggttcaatggctgccctttggtttggtgccatcacgttattgttcatggatttgtcatctaacgttgcgatgcaaccgttcaagatgatgattggtgacatggtcaacgaaaagcaaaaaggttttggttactcgattcaaagttttgcttcaaacgctggtgctttgctggcaagtatcttcccatacgcattgactgccttgggtattgctaacgtggctaagaaggggactgttcctaactcagttgtctggtcattctacgccggtgccattattttgttactttgctgcttactgactgtcttccgtgttaaggaatacgatccagtgacttacgctaagtatcatgggatttctgataacagcaagaaaaagggtatttttgaagctttaaagactgcaccaaagattttctggaccgtttccattgttcaattcttctgctggatgggcttccaatacctttggacttactcaactggtgctattgctgataacgtatggcacactgctaacgttgcttcagcagggtatcaagctgctggtaactggtatggtgtgatgtcagccgttcaagcgattgctgccgttatctgggcactggttctttcacgggttggcaacaaccatcacaaattgttctactcaattagcttagtaatgggtggtctcggtttcggttcaatcttctttattcatgataagtacacgttgttcttctcatttattctgattggttgcgcatgggctgctatgaacgctttcccattcacgttcttgaccaacgctatcgaagattcagaaaacatggggacttacttaggtttgttcaacagcagtatttgctttccacaaatctttgcttcagttgcaagtttcgccttattcccactgttaggttcacacatgccaaccatgcttctcttgtcaggcatcttcctgattttaggtgctttgagcgttggtgttgttaaagaagtttgggctcgtaagtctgatgctgaagaagaaccagcagacgccgaagattaatttacaaaatgttcattaaaactcagtgcataagttaacaaggaggactatcccaatatgaaacgaacttttgaagtcaccccctggaatattgttactcataaactagatcctgaggacaagcgccttcaagaatcaatgaccagtttaggtaacgaatacatggggatgcgcggattttttgaagaaaactactcaggcgacaccttaaagggaatttaccttggcggtgtttggttccctgataagactcgggttggctggtggaagaatggctatcctaagtactttggtaaggttatcaacgcaatcaactttattaaattgaacgttttgatcgatggcgaacccattgatctggctaaagataaggtttcggattttgaattgaatctggacatgaaacagtccaagttgacccgttccttcacggtcaccaaaaacggtcatgccatcgctatgaacttcgaacggttcatcagtgttgctaataaggaacttgtcggtattcgcgttacagccactaacaaaagcagtgatgcggtgaaggtgacgtttaaatcagccttggatgctgacgttcaaaacgaagacgccaactatgacgaacgtttctgggatgttcttaaaacccaacagaattcaactgatggttcgattgttgcgattaccaaagaaaatccgtttggcacaccacggtttactgttggcatcaagatgactaacgaagctgatttagatgctgaaaaagttgaccagccaaatgataaagaagtcgttaaccaatttagcggtgaattagcccctaaccagaatacggttatcactaaacggatcaccgttgtcacttcccgtgattatgatactcaagataagctggaagctgctatgaatgaacttagtagcaaggtagctgcgatttcatatgatgatttatttgccactcatgctaagatctgggctgatcgttgggaaaagtccgatgttgaaatcgatggcgacactgaatcacaacagggtattcgctttaacctcttccagcttttctccacttattatggtgaagatagccgcttaaacattgggccaaaagggttcactggtgaaaagtacggcggtgcaacttactgggataccgaagcctttgccgttcccgtctatctgggaattacggatcctaaggtaactcgtaacctgttaatgtatcgttaccaacagttagatggtgcttatgtcaatgccaaggaacaaggcctgaaaggtgctttattcccaatggtgaccttcaacgggatcgaatgccacaacgagtgggagatcacctttgaagaaattcaccgaaatggcgatattgcttttgctatctataattacacgcgttacaccggcgataagagctatgtattgaacgaaggcagcaaagtattgaccgaaatttctcggttctgggctgaccgggttcactttagcgaacgtaaccagaagtacatgattcacggtgttactggacctgacgaatacgaaaacaacgttgataataactggtacaccaactatctggctaagtggacgttgcagtacactttagagattttagaccaagtttctccagaagtagccaagaagttgggcgtttctgaagacgaaaagaagcactggcaagatatcattgatcggttctacttaccagaggacaagaaacttggaatcttcgtgcaacatgatggtttcttggataaggatcttaagccagtttcgtccattcctgctgatcaattaccaatcaatcagcactggtcatgggacaagatcttgcgttcgccttacatcaagcaaggtgacgtgctgcagggtgtttgggactttattgatgactttacaccagcacaaaagaaggcgaactttgacttctatgaaccattgaccgtgcacgaatctagtttgtctgcagctatccattctattttggcggctgatctgcactacgaagataaggctgttaagatgtacgaacggactgctcgtttggatcttgataactacaacaacgatacggtagacggtctgcacatcacttcaatgactggtggctggttagctatcgttcaaggattcgctggcatgcgggttcgcaatgaccaattacacttcgcacccttcctccctaagaagtggaacagttataaattccggattcaattccggggacgttcaattcaagtccgagttgatcaaaatgggactaacctcacgcttttgtcaggggacccattgactgttgatttagcgggcaagcaagttgaacttaaggattagtagataaaaataaaagaagctgagaagattgaaaatctcggcttcttttttattttactaaataaacttgatcatgaatcaaatcaaactgattaaaatgcttgttcagtgcttttactgctggggtatctaacagctgcgcattctgccagaagactttcgaatcggttgcaccatctttctcaccaatcacgataaagtcgtaatccttatcagctgcacggatttgctgcaacagctgccagtcgatttccaaaccatctggggaccacaccatgataatgacatcgacttggtcctgatatttagtgaaggcatcactagccgtaagctgttcaatgtcagttacggggtgtttgcctgtttcattttccttggtccagtccttcgagtcagtggtaatgacggtttgaccgttttgacgcaatcctttcgaaacgtagccgttaccggccatgacttctagtgttggtcggccgttaacgaagtcggctaaatctttagccactggtgctgagatataggcccacatcccgtaagtttcttcgagataatcgcggaaactgcgtagttttttgtccaaatcaggcagggcattcgataattgatcccaacgtttatcaccagcaggatcgccagctgggaatgtttcgttgagttgtttgaaaatgacatcctgagtattatcaggcagtaatagttttggcagggtttgtggtaaaagaccctgtttgagcaagcggtcagcttggagaacattgttgatcagaattttgatcgttgggaaatcagcaaacagactgttgtatcgttccatggttgcaatgtaatctgatggtttagcagtatgctgactgcgcgcgcgcttcagtagttttttcttttgtttgggattcaaaaaggagacctccagacataaacaagctgtgacaaaacgcggtggattccagaatttaacgtgaataatgcctattccacgattttgcggagtaggcattattcacgttaaattctggaatctgagttttatcgcgtaattaggctatagtgacgtatagagctaaagtacagtgttaactatttacagctcaaaattgattgaaatacttgccaatatagactgatagcacagcctcgttttattttagttttgtttatcgctatcaagcccaagttccagtgattcttgatgggtaatgggtgtgttctcatcgttagtatccaggcgacgggaacggccgtgaatgtagccgttcatcagttgatagatggcgtaacgatcatcggatgataaggctttttcgccaaatttcagttccttaccggacaaaaataaccggtccaagtcgtattcatcacgttcggatttaccggctaggtagtccatggtaacatcaaaaaattcggctaatttgcggacttccatgtaagaaggaacccggatgccacgctcccaattaccaatttgagctgcggtatttcgatgttccttatctggtttaaataattgatttaaggcggttgctaactggcccagcgttaaatcttgaccacggcgcaacgcccggagtcgttcggaaaacatgcacatcacctcttatctaccattgtaaccctaacggagcgttttgtgggtgttggtttagattttgcatagtggcttgttcaatttaagtcccacatgcgatatggtatgataaacctcgtatacttttgaagaatgaggtgcagaaaagtgaataagcgtttaaaacactggctgatcggtattttgatcgtggtcggtgttatctgtattggaattggttcagcaggttattacttctataatatggcggttgcccgcggtaagaaaacattcattaataatagtactgcaattaagaaaagtgacccgttataccacgaaaaaagttggtatcgcggcactaagaaactggtttggcacgaaacttcggctactaaacattttaaattagtggctaattacgtacccgcaagtaagcaaaccaataaaactatcgtgattgcccatggttttggtggcagcagtgacaagatgggggaatacgcagggttgtttcacgaactcggatacaacgtactgttaccagatgatcgtggtgctggtaagagccaaggtaattacattggctacggctggccggatcgactggactatctgaaatggattaaacaggttatccgtaaaaacggaccacagtcacaaatcgtggtgtttgggactagcatgggcggtgcgactaccatgatgatcagtggtgaaaagacgcctcaacaggtaaatgcctacattgaagactgcggttatactagtatttatgatgaaattaaatatcaggccaaatcaatgtacaatattccagaatatccgttagtccccgtagtcagcgggattaattaccttaaaaacgggtatacttttaaacaggctagtgcgctgaaacaagttgctaagaaccataaaccaatgttatttattcatggcacaagtgacaccttcgtgccaacacggatggtttatccgctgtacaaagcggataagggaccaaaacgattgctgctggtgaatggcgctaaacatgcgaaatcatatgagcacgctcctgcactatatcggagtacggttaaagcctttttagaccggtactttaattagtaaatgctataatttagccagatatctttttagggggatgttgctaatggctacaaatcgagcttcatttagctggctgacctttctagcgaccttttcaatgggagccgttgatgcctatacgtatattgcgcataacgaaacctttgccagtgcacagactggtaacctggttgttttcgcggtgaagtttgctcgtggcggcattggtcaagcgtgggtctgcttgcctatctgggtaggttttgcgctgggctgctttgtggcacaggccgcgttaagctggctgaataataaacgggatttaagacagcgttacttgtggttaatgagtattgtagtagtcacactgctgattgctgcactgggtcagaagtggttcagcgagctggtactgatttttattttaggctggttatcaggatacgaactgacaagctttcgtgaagtcaaggacacaacagtcaataatgggattatgactggaaacacgaagaacatgatggtggcgctatatcattggctgattgagcatgatcgtgttgcccgctctaagtgcttatggttagtggcgacactcctaacgtttgtggtgggagctagtatctcagctatggcttgtttaagaatgagtgcggatctggtgatgtgggcggttctgttattaaatacagccggtctgctagcgatttacttgaccagtcgctttagaaatgacgcgtaatagcgtataataacaaacgtatatcgaaactatagattgaggaagtgccgacatgattgatacgatcatcgtggttgccaccctcgtgattggtctgttggctggctttattttacgccgtcagaagcaccagcacgaagttgatgaagcagctcgacaagcagcggcacttcgggagtccgcgcgtaaagacgcggaacagcaagcaacaaaatatctcactgaagcgaaagcgaagattcaagaagatcggcaagcaactgaagccgagttagcagatcagcagaccgagactgaaaatcgtttgaaacgaactgaacagcgtcaggtgacactgaaacagatggaggaacggttaaaccagcggcaagctgcaatcgaagagacgcagactgcactgaatgacgatcaaacccatctgacagaaacgaaaagtcaggcgcgccagttatttgttgaccgtcaaaacgaagtggctacacgcgctgagttaacgattaacgaagcaaaggatcacattcgacaggaaacggctcgtaaccttgagcaagaagaagatgtgacggttcgtgagctgacggataacgctgaagcgtccgcggacaagtctgctcgtaatctgattattgaatcgattcaacgcggaccagtagactggccccgtgaacacgcagaacactctgttttggtacctactaatgaaacgaagagtaagctgattggtcgtgatggtcagcatattcgtttactagaatcgttgactggtaccgatttggtttttgatcctgagcagccgaacttgttgctgatcagtacccatgatccaattcggcgtgagacgacgcgtatcgcaattgagagcttgttggcttcccgtaaaattacggccgctgcaattgaaaaacaggtgcaaactgcccaaaacgacgtactgaaggatcttcgccagactggtgaacgaaccgtcagcatgttaaagattggctttatgcacccagactttatgaaaattattggccgtttgaagtttagaacgtcatacggtcaaaacgttttgaatcactccattgaagttgcccagatgacaggggtcatggctgccgaattaggtgaggacgttcgtttagctaaacgagctggcctcctacatgatatcgggaaagctattgatcacgaaatcgaagggactcatgtggaaattggggtagctttagccaaagcttatggtgaagatccaattgtaatcaatgcgattgctgctcaccatggtgacgttgaagcaacttcaccaatttcaatattggttgccatagcggatgctgtgtcaggttcccgtcctggtgccagaagtgagtcagttgaagagtatatcaatcgcttgcacagtttggaaaagattgctaacgatcaaaaaggtgttcaagaaagttatgctattcaagctggtcgagagattcgaatcgtggttaagccaaaggtgctggatgatgaagccagtgctgaattgacggaaaacgtgaagaatcagattgaagacgagttgacttatccaggcaaaatcaaggttacaacgattcgtgaactgcgagccgttgagtacgttggtgataagccgggtaaaaagaagaaaaaaagggcgtagatgaaatagagtgtgaaaacaagcgtttagagagtggagaataaggcacaggcaacggaaatcccggttctggatttctgttgcctgtgccttatttgcaactctctgcttgtttgaacacgttttctaccaaaagacaactcttttgacgatgttttctaggaaattagggtacacttaaatagacctactgattttagtgttttttcatgataaaatactattgaatcagttgatttttatggaaaacttatatgatatgattcaccatatttacacttccatatatcgttctcagtaggcgatgtatgcaagcatgcagtcttcttgggtgaagaagactgcttttttgtttggtaataatagtagtcagcaatatggcattttttatgggtcagagtacaagtttgaactatttgaaagacacactgatacaaagcttgcgagcaatcttgttgccccttttactgatagtatctgaaccagtaataggcccgataaagtgcctaaatcatgccgataagcattgatctggttagtgttatcaaatcggctaaatcgcctatttcagcgattatcctgatagctgaagtttcagcaattcctggtattgagcgagatatttgaaaccgggaatgtactaccgattcaatcatatttttgatgagctgtgctttagtatccattacagttaaaatttgatggccaagctgaatcagatattttgaattaggcgcatcacttataacgctgggaacggcttttacggcgtaagaatggagtagcttggcatacttaccccagttggttctaggatgttgtttagaaagatgaactttcagtttttcagttactttgtaagactgaacgtaagacccagtctgcgtgcgggaaaataataaacagctcataaaacaatgactggtccagataccgggaagcctttgacgggaacgtctgttgttgaatcttatcaaaacgattttaaagatgacaatattgcgattctcattttcataccatcgatctaattgatagagcttttcataggcttcatcacgtacataggatggctggaagctatcactgatagcgatgcgagccatttgattcatcgacacgatcggtcttattttgtcgcaaacccgtacttaactgcctggcaccagtggattgatgcattcgaagctaaaatgtagttcatttagaaaacgaaccaattattcgagtagataccggttgcctcaaaacaatctgaacggcgttcaattgtttacttaagatacgaaaaagctttttaaagccttcggcattactttccacttgatcagtactcaataactctgcatcagtgtttaaaattgcgatgtcgagttttaagcactgacatcgatgcctacacacacaacaactttattagtctaaacacctcatatattattagatcacaatctgattgtttaattttctaaactcgacttttattagccaatatacttagaacaaactttcagatctcatttttatggacggagacctgttcactaagacagtatttgcctaacgtgctcgcgaccttttgtcccatccttaatgtatcaaaaaaggagccaaaataccgtcgtattttgactctcttatcttagtatatttcagcaaagtgaaaggaaagaccatgggtttgggatttgtgctgggggtcctttacatacagctgtctgcttgtttgagcacgttttggaaaatagagtgtgaaggggagcgtttagagactggagtctaaggcgcttctggcggaaggcacggcgaactttgacgtgggttctgccagaagtgacttagatgcaagtctctgctctcctgaacacgtttatctagttagtttaaagtattgaataaaggccaattttcagatgtttttcagttaagaagccaaatgaagtaatttaccgacaaagatatatgcatgctcgtatttagacagagtctctcgttagtatctcgtaaggtaccgtcacatctttagcaagatcatgcgccataattttttgcacggccagtcgtcccatttctgaaaagggctgtttaacggtggttagagctggtgtcacgatttgagcaacgtgagaattatcaaaaccaagtacggctaatttcccaggaaccttgatgtgatgggtataagcgtaagacagcacgcccgctgcagcatcgtcactggcagcaaaaattgcatctggccaatcattgccgcttaataagtgttgagcagctttaacgccagcttcaaaggagaagtcgcctttaacaatcaagtcaggatcaagcgaaatatgagcttctgccagcgcttttttatagccggtgattcgcttgataccggtctgtgggtcactatgatcaacggccactaaagcaattttgcgataatgacggttaatgagaaacgtggtggcatcgtgagcggcttgaaagtcatcaatctcaatcgaaggatgatgtgggacagtcacgtttagcgagatcaatgggatattaatggattctaggtagtttagattatcatcatcaaactgtacagctacggaaataataccgctgactttctgaccagccatgagatcaaggcaaaagcgtaggcgcttggggtcgtttaaaccgcagtgtgccagcaagatgcggatatcgtgcgcgtacgcagtatcttccacactatcgatgatgggagaagcaaaactggatttagagtcagtaatgatgaccccaatcaagtttgaagttttagcgactaggtttgatgcggcttcgtttttttgatagtggagcgaggctgcgatttgttcgattttagttttggttttatcgttatagccaccggcgtggttgagtacccgggataccgttgaaggggtcacaccggcgagctttgcgatgtctttgatagtggccatcagttatctcacctcaagtttctagtacaaattataccagtcggtcattgacattgaaactagagtccctataattaaggatgtaagcgattacttagagaattgctttttattttagaaattaactcaaacgtttgagtaaacctaaattagggagaatattatgacacaaacaaaaaagtattggtggcaaaacgccgtcgtctaccaagtctatccacgcagttttcaggatagtaataatgatggtatcggtgatattcaagggattatttctcgattggattacattaagaagcttggtgtagacatcatttggttaaatccaatgtacaaatcacccaatgttgataatggttatgatatcagcgattatcgtgcgattcatccagacttcggtaatttggatgatttcaaagagttattaagtcaggctcacaaattaggtctgaaaattatgatggatttagtagtcaaccactcctcagatgaaaataagtggtttgaagaaagtcgtaaaggtaaggaaaatccgtaccgtgactactacatttggcgtgatccagtagatggtcatgaacccactaactggggttcatacttttctggatcaacatggcagtttgatgaagcttcaggtcagtattacttgcacctttttgcaacgaaacaacctgatttgaactgggagaatcccaagctacgtcattcagtttatgacatcatgaactggtgggcagacatgggtgtagacggttttagaatggacgtgattaatcttatttctaagccagccaagtacgaagatggcaagttagctgatggtgagcggtatgctaacgttgaacccatcgttgccaatggccaccgagtccatgaatttttgcaggaaatgcaccaaaacgtgatggacaagcatgatttagtaacggttggtgaagcaccgggttcgacggttgatgatgccaaaaagtacgccaatttggatgaaactgagttaaacatggtctttcagttcgaacatgtttctctagacggcaataagaaggctgcgttcggtaagtgggacgatcgccacgttacgttgagtgaggttcgtaacagtttgggcaagtggcagactgaactcggtggcaaagcatggaattcactgtattggaacaaccatgatcagccccgggcagtttcacggtttggtaatgacaatccgaagtaccgggtcaagtcagccaagatgttagccaccttgttgcacttcctgcaggggacaccgtacatctacgaaggtgaagaaatcggaatgaccaacgcgcactttaagcagttgtctgattatcaggatttggaaacgcacaatatttacaagcagttagttaccgatgagaagttgattgactcagacaccatgatgaagtacatcgaatttcactctcgggataacgccagaacaccaatgcagtgggacgatagtgaaaatgctgggttcagtaagcatcagccatggttgaaagtcaaccaaaattaccagcagatcaacgtcaagcaggcgcttgctgatccagattcagtcttttactactatcaaagactcatcaagctacgtcatgaattaccagtgatcaccgatggcaaatacgagttgttgccaggtaatgagcaggatcaagacgtttatgcttataccagaaaagatgccgacacaacgttgtttgtggtcgtgaacttctcggctaagacattgacgcggcaatacgagttgcctgaaaacaaacaacttttgatttcgaattatgatgacgatttaaaggatcaattaagaccatatgaggctaaggtttatcaattttaggatatcaagaatacagcgatctgtgcttccataaccggaagttcagaccgctttttgtggtagattacagcttctataaaaggtgttacaatctttagaaaataagttgtaacgaaaggaggggcgcgaaatgtcaaacgtcaccttaaaacagcaaatcatcgctgccagtcaacaagtgggcatcgataaaattggcttcacaactgcagccgattttgagcatttgcgagcgggcttggtgaagcaaaaagccgacgggcacactactggctttgaacaccaaaacctcgatgagcgactgaatcctaatctaatttttgatgacccgaaaacgttgatctcgattgcgttagcgtatcctgccaaattaaaaggtcgggcaccacgaacgggtttaaaacgcggtcaattcgcacgggcatcgtggggtgaggattaccatttcatcttggatgaccacttagcggcattgattaatgcaatcaaaaacttgttaccagaagataatgacattcggtttaaacccatggtagataccggcgagttgatcgacgtagcggtcgcacaacgggcaggtgttggcttcatcggtaaaaacgggctattgattacgccggagtttgggtcctacgtttatttaggtgaaattgtgacgaatttagaggtggcgccagatgaaccgatggcaagtcagtgcggtgattgcacccgctgcatcgatgcctgtccgccccgcgcgctgatgggtaacggccagttaaacgggcaacgttgcttgtcttatcagacgcaaactaagggacagatgccagatgagtttcggccattgattcgtaacgtaatctacggctgtgatatttgtcaggtggtgtgtccgtttaatcggggcgtggataatcatttacatgaacggatggagccagacgttgaacgggtacggccagaattaacacccatgctgacgatgacgaaccgggaattcaaagcaagttttggttcaatgtccgggtcgtggcggggaaaaaagccgttgcagcgaaacgccatcatcgcgttggccaacctcaatgacactagcgcagtacctaaacttttagaagttatcgaaaaagatccgcgaccattaattcgtgccactgcagcctatgcagttggctggttgagtcaacctggcaacactgccatcgttgattttttgcgggcggcttatgaaacggagcgggatagtggaacggatgcccagttgttgcaggaatatgtacgggcaattgatcgaatttcctagtttataaagcttaagttagacattaaaaagcagcgccatttaatccagattgataaccaatttgaattgaatggtgatgcttttaatatcaagaataaagaattgctatttcgtatcaggttcattgacaacttcaaaattatcgtcaacagttgctttcaccactgagtgtgctctgagataatcagcaatcagctggctcatcggggttttattttccgcaataatcttatcagcacggaacatgtcgtagtgaccgccgccacctgcacgatagcgatttaagacgagtctgaaaatttgatcgtcggtgacgggttggcctttgaaaagtaatttgtcgatacggtgaccaactggtttggcaacgttgatccggtagttgataccttcatacatatcataattataatggcgtaatttcggggaatagaaggcggggttaacaataatttgattgttaagattgagtgtgaaataagtcgcagctttttcaagtgctgccttcagatctttgccggtgaccagttccaacgccagcccgtctggatagacgtagttagtcataatgttacgcatagtaatgggattttcaaatccgtgaccctcattgttaaataatgaggtcgcagagatgtcggcgttcatggttgtcatctgaacgcgttgaataaattcagtgtaagctgtttctttcattctggctttctgagcgcttttgaaggtcaggtcaccatctattcgtgccaagggttcagccagccagtgatccacctttttatcgagctgatggctatagatggcaatgtttctatcaaattcagcatttttggtttcaattaagtgagcgcttttatcagtgacaacatacccacccgcttttgagggctctaagtggagcacgattttcccaacagcttcaccgcgatagccgggctgagtcactggtacatcgaagaccgtcgtcgctattttacggtgctgatgaccagtgatcagcgcatcaatgccctttacttcggaaagtagctgataggcctcattttcaccattactcagcgattcgatcagtttgcctgtttttaagttacgttcgaaaccgccatgataggaaacaatcacaacgtcaacgatttttttcagtcgtggtactaactctttggcgattgaaacagcggtgtggaaatgcacatccgcgctgacattatcatggtttttccactgtaacacggctcgggttgttaacccaatgatggcaatcttaataccatgacgttctataatgcgatactgctgaccaaatagtggccggccagcatcatcaagtatatttgcatttacaactggacggtcactggcatttagcgcccgctctaaataatcagtgccatagtcgaattcgtggttccctaaaacttcggcatcatagtgaatttgattatagattctgaccagcggctgcggatctgagtgtggctgtacctgggcgacatagtaggctagaggcgaaccagccaaaaaatcaccatcatcaatggtgactactggtcccggtgctgactgctgttccgcagcaagtaccgttgcagctcgaatgagtccaaagggcatgtgcgctctgggcttaacgtaattagttgggaaaataaagccgtgcgtatcgctagttgaaagaatcgtaagtgtgaccatatcgtttcccccaatgcggtttgtaatattatagaaaattataagttttttctggcgggatagcaaccgggggaagggatgttatgtaggtgtgaagaattggtaactttacttagtcgggctacagctgacagaacgtagctggctgggtatggttacattgcttagttgggctacacgaagcagagactggcatctagcggtagatgactataaatccaagtctctgttacatagccaagttgggctacagcagacagagacttgcacctagtaagaaaaagccataaatccagacccgggatttttgactttttcttactaggctccagtctctaaccgtctgctttcgcaccctacaaaaaaagatccacccgggggagggtagatccaacataggagtaggcattttcgtgatggggttcacgaaaatattattttactttggaggagtaaaatgaaaaagcttacttaatattagttaaatattaagacacgattaatatatagccaaaatgtgaagaaagtgtgaagataacataacagttccgttaccaaacaagcttttttaaattgttaagccccttacctaatcgctattttgcatataaaccatctgatccatagaaattttcttatggagttcatcaatcagttcgcttgatagttgatcttgctggctgacattttgaacgtagctgtactcaaattgaaaggccattaaaaacagttcattttccgcctcgcttgattcctcgctcttagttgttcttgaccgacgtactgcgtagtaatgacgcaccacgtcaacttcttgacggttatcgtcagtttcaatggaatcgaggtagccaatagctctgtcatagcagacctggcttagctgactaaaagcttcccgtgcttctgggctgaaatcggcccgacgtttgcgaccacgctgtttatgagctggttgctggttgacagtcttctcctgtgactgtggagagtcttgctgctgagagattgctggcagtagcggcgttgtggcaggcaaggctagctggttttgctttttttgctttattgatttttgtctgttagctgtgggacgatgatcgtctttgtgctcaaggtaaaattgttggtaggtattgaactgttcagtttgaccacgttctttaagcgacttcattttagcttcacgagtttgtttgaatgatctgttaaattgtttacgggcagtttttggaaaaaagcggaactcccacattttgagccacattttcagtcgagcccacggacttaggaaggcgaattgtgcttgaaacatgatggcacggttgtattgccagccagtctgaggggtaatttttccattgtcaatcatttcagtcaccgtagcgtgttcaacatcttcagtctgttccagcagttggtgaacgagtttattatccgcgcttttgcgatactgacttttttgactgtttaaaacttcaataacagcgggtaaactttccgatttatcgttgacattgcgtaattgatcgattgcaaaattcaccattttaacgatttgttcgctaaattcctcttcagaatagggtgcccgtttattcggcagaaggattggcaaaaccaaacttggtatgaccatactgagtaaaataataatgccagcaatcaaaataatggcgctacgaaacgggaaggtgtgtcccattacgaccagaggtaacgagaaggccattgagagcgtaatcgtaccgtggacaccgctaagtgccattaacaggctgtctttaattcgggtgtcctcagaaggcaaagaaatcaggttaaacatgcaccacaaaaagcgcatcagccccataagtaggtacagtcctactgcagttaaaatcaataggggtaaatgatggacttcactcgttgaaaggtcgttccacacacttggaatggatgcacccagcaatacgaaaacaaagccgttgagcaggttcgtcagggcttcccacgtcgtcttgttcaccagttgtgtttgagtagaagtcaatcgcaggcgctgaccttggataccgtgaacgataccagcagcgaccactgctaaaataccggaaaaaccaaagtgttcagcggtcagataaacgatgaacggtgtcagtaagctgaatggcaaaatgacagcgatcgtatccaacgttttacgctggaaaagaacgcggattaaaacaatgatcatgcccatgataatcccaacggcaataccaccaaagaagacgattaagaaccgtttgaatccctgaaccggcgagaattcaccagtagtaaaggcggttaacgccaaatccattgccacgataccggaagcatcgttgaaaagtgattcgttttccaacgcacccatgacgtgttcaggcatttcgatacctgacgtaatcgacgaaacggcaacggtatcggtgggtgtcacaattgcggcgagtgcaaaacaaagtgctagtggcaacgtcccccataaaacgtgtgtcagcgcgccgccaactataatcgtgaccaatgccaagacaacagctagagaaagagttgaactcatgttttttcgtaaacgatgcatgtccgtgttttgaccatcattgaacattaagggcgcaataatcattagcataaagatttctggttccaaatgaaaatggttaaaaagcggtactaacgacagcaggactcccgcaccgatttcgtaaaaagctagcggaattttgggataaatagcatatatgatgttagccgcaatggcagcaacgactaatagtagaactgtaaagaacgaagtcaaaaaaaccactccccccaaattaattaaccaaattgtaactcatgttctgattgattactataatccgaatacttaaactgcaataacaattttaccagtgaataaaactaaatatggggtatcaaatttcactttcaaagagtaagtaaacccagataaatcaagtgtttaggaacgttacaacagattcatagtttgataaatcaattttataaatgcacacaaatctatattgttataacacgcgtggttgtaacattttcgccaaatatttagcgcagaaataattatcttttcacaagctaaaaaatataaaagtagtattgaatttttctgagattgatggtattataaaactgttcatgatgaagtgttggggacttagtaatgaatgaattaagacgcacctttgcttttgttttagttttttgtttgttactaggagaaagcgaaataaaggaagtgcttatctatgattaatttatatgttgcaccaagcagcgcatcgagtcgtaaagcgcgcgcatggttagaagatcatcatattccgtttaaggaacgtaacattaaatccaatccacttaatgcggatgagattaaacagatcttacgcttgaccgaaaacggtagtgaagatattatttcaacccgttcaaacgtctttaaaaaattacacatcgatttggatgatttggcagttagccaattagtcgatctcgttgttaagtatcctgacttgatcaaacggcctatcatctttgatgacaagcgtttggaagttggatacaacgaagaggagattcgccggttcttgccacgtgaagttcgggtggctgaattacgcgatttagaatcacagctcagttcataatttaaactaaacttgcgacagcattccattctggggtgctgctttttagtctgtaaacaaaaaatcagcctgattaccagagatgaatcttctgacaatcaggctgaaccgtttttaacgtgtaatattaaagattaaaaaatgacaactgtttaaactgatcctgtttagtagcagacggacgatattcatcatagcgctttgcaagttcagggtggttaagcaagtttaaagtggagatgatcagctggcgaatcgtagctgtatcaatttgagaatagccggcaatttgagcaagcacaagagcgttaatacgacggatgagacggtcatcatgtgtcaagtggtttaagctacgtagaattttacgcgcatcaaacagcgcttttttcccgttttgcttttccacaaagcgaaccgtaatctgaatatgcgactgttgcggtttttgtttgttcacggctaagtctcctttttctcgatatgttaatcgtagaacatccgtttgaaaaaagcaacaatatatggcgtaacttccttatttttctaccagatgtggtagaactagtatttcactatctaacggagtgttgtgtggcctttttctaagaatcggtgaccgtctaatcgcttatattaatgacacggaaagaagccgtgatgtaagtctatattgataaaaatttcatccggtttcttgactgaaggacgacttaaaatttacttttattcaatactctaagctagtctaaacggctccataactcagatttcagccattttgtgttaaattctggaagctaccgcgttttgtcacacactcgatacgaaaaagacctgatcatcatcacgacaatcaggtctttggggatattgcatatgattaatttaagttagttactcgagcagtaccaacatggtgccaccaaggtgctttaacggattcgacgatcacgccacggttttgagaatcgatcatcttaccgccgccgatgtacaggccaacgtgactgatactgtgcttactaccaccgaagaagaccaggtcacccttcttagcatgggcgtatgagaccttcttgtacttgttgtattgcgcttgggcagtacgtggaattgcttttgaagcaccttttttgtatacgtatgaggttaaacctgagcagtcaaaccgagaaggaccagttgagccccagccataaggtttaccaagttgttgtttagcgaccttgtaaatctttgagtaagaaggtgttgtagcggcgtttgctgttgtactgtgagtcatgttagcagcaaccgtaaaaccaagaactgcaattgctgtaagtgcgagtttaacgaaccatttcttcataatttctaaatatccccttttgcttgtatgtagtctttttttaaaattcatatttgtcttaatcaattcaacgagactaagtgtaacaatcctaagttacagtagtgtttcagtgaattatctattagattaatgaaatcgacagaaacgtaatctttcagtgaaacggcgctaatttaagtccgttgaatgccgttataacgggcgtcgtttctttattgcaggattgtaacaaaagctggtaaattaggggatttttcaaaaaataagtcaaaaaaactgcgattttggcttaaaatcgcagtttttttgacttgtttagcaagattaaagggtgatttctgattttgatgtgtcatcagttggtaattgtaaataacgcagatgagacatatcaattatactaatgtagtgggtaaaattatggttagttggctgtttgccggcttgtcttgggatgatcacctgctgaagaattgattctgcacgcgcaatcgcatcatgagccgttgccggttggggttgtccccagagattgatcgtggttctgataaaccgattagtggggattggcccttctggtagcggcttattttcagttaaccattgactggctgagtcttgtaaatgagcagcgtcagtatccagaaagttgttaacacgctcaatgtggttggccaattcaggtgtgttagtgaggacgtttaaggggtcactgattaaggtcaacgagtgggtagtgggttctaacacagccgtagctccagttttatcggctagtagccagtggaaagggtagactttgttttctgcataccagactttgccaatgagggcaacgttttccagatcagcagcaacttccgcaattgtactatgttggctaagcacccacaagatgaagtcttgaggcgtgaggttcgtcataccagcttgcggttcatcgtagtagtgaacgcggtttggaaaataaagttcggcgcaactgagtccctgactatttaggccatcaccaaaaagatagtggccgttcaggtgacgtgctgagccgacaattcggtacttactagtgtgcggttcgcctagaatcggccgccattcagtactggtttcaaggatggtcggtttccaaggatcaacgttgggaaaatccatcgttcttgccagtagatgggtgccatccgccgctgttaatgtaagactggtacacatttcaaaagccccctacttatgttgtataatgctattataggtcagggaaacatttctacctaaggacttgtttttgaaccccaatttcgataatctagaaagaagttaagcgcttctccgggtggggcaaagtgacaaaagcgttaaatcatggataagaatgggagaatttagcatgaaatcagcatggaatttagtcggtatggggctgtggcttctactattaatctacttaatttggatggtgcacgatatgcgtgtgcgccggctgaagcttttggttacggagaaacgttcttggtcgtggcaaaatattaccaaatcgagtattgaattagtcattttcctgcttggcttgtgggggatgggttacgcgacgctgttccaagacgtcagtcagcttaatcctaatcgggtcaccgttgcttatcaatataagccactagtcctagataccagtgctgtggataagtcagattacgtcatcgtcaaaacgggtaatggccgtaaaccagcgcagtattataccttttatactcagggtgaaaaggacatcgttcccggtgacagtgccaccgtttcagcggggtcgcatccaatcaacttggtggcatcttcgtataagtgggataccaagaaagttaatcagatggaaaagcagcatcaaaaggcgtgggttggtgttgtagaaaccacttataaaaaggattttctaaacggtattggtctccatgcggggcggttagctaaccgcttcacactgattcgggtgccagaccactcgtttgttaaacaggtaacggatgataatgaacagtagagtgtgtgacaaaacgcggtagattccagagtttaacgtgaataagacctatttcggtgggaactttgccggaataggtcttatttgcgttaaatggccggaatctgagttttgaagcatgattagactaagttaatgacaaaatattacttcaggtattttgcccagacgctacttggggcatagaggttacgcagcgtgttggcatctgccgtggttgtgcccattgcaaccggatatggtggattgaaatctggaattctatcaggatctgtacttggctgagtcagcataatcgttgctggttttagagccattccaccattaacgttctctgcccagtcctcgtctaataaaaccgagaaattctgtgtccatttgccattacgataaacatcatcattaaatgccggtgaggtaaagtttggatcaatctgacggtaatgggtcgccttactatggttgatattaactgcagtacgggttggatcagctagaccataggcaataccattgcgataaacaatttgattagggaacttcaaaatgttggctgttttgacatattcaagttgagtgccgttttgaacaactgacagactgcccttggctagggtgtagattttatcagcttgagtgtagaaataggggtcttctacagcataactaggtaaagcgtaactgatgggtgtgaatatgaccgtaccagtatctgacggctgtttgtttgagtcataactcttgacgctggtagcagaagcagcatcgtaaaaggctttgaaggttcctgctgttgcccattcgctacctgagtaagaattaccggtaccttcatcgataacgttgttggtcatatattcgacatagggcaccatggtcttagattttgatgaactaatagggcgcataacgatgcggaagttttgccagccattgtaggttggatcaccgtcatggtcgggtgctaatgagccagtgcctgtgataccggcagcgttgttcgaagctttaatgaaggcaaccactttgttaatttgcgaagtggttggttttttagcgtatgctgagtacgaagaaagcccagttagttgcggtttcttcagtgtataatcagtttctgaccccacttgactccagtcacgcttgggaatgctgctgtacacaacttccttatcactgttggtcctgtatgaaacatcagggttctgcccagccttgaagtaaccgtgccagacataaccgttgtaacggccattggtaacttgatagtagattgaccgctttttacctgattgtaaggtaaccgttgaagttcgagaccaggttgtgtgaggataattttttaaattatggctttttttcgtgtgggataaattccacatgtatgcgttactatgcttatttttgaggtaaaacgtcgagaatggtgcattgtcttcagttcgttttacgactcggtaagatgctgacgcatttggtgtttgcagaccgctatacgcgatgcccaatccggcaatcaacgcagcggtgctaattaatagtttacgattcaaaacatagccttctcccttaatattcgtccaaatctactttagcattgagcctagtagatgtaaatttaataggaaactaaaagcaccgtccttcacataaagggcggtgttttttgagttaactcagttccaatccttacagattgggggtaatcaccatagtcaagcctggtcgtatttctgcggagccacgtacttgagctgatcgtttggaggtggtaatcaccatagaatagtatagtcagttttagtgtgaatgtttaatagttggctcaggtttttacgcgtgcgcaaagtcgtttggatttgcatctaatggtccataatcatccatattcgtatcgcgataatcccaccattcattttcgtaaccaacaaaaccagcgtcggtcatagctttaactaaagtctgaaagttcttttcttgagtgggtgttcgagggtaatcccgaaccgcttttcccgtgaaatcgtcgaagccggattgcatttcgatttctttaccatctaagtcagtgagggtgagatcaaaagtaacgcctttttgatgggagtaatttggatcaggttcagcaacccaagttgggttagaaacgacttcaaataatttctcctgtgcctcagttggtcggtaggcgtcccaaactttaatgcgatagccttgctcttttagtgctttagcggccttggcgagtttctttgccgtaccgatcctggcaatcgcggttgtaaagtcatagatgactcggccagtgaaattatcggtagtagcgtatttaaggtcaacaataatatctggatctgcatcttgaatgttcatgtatccttcttcagtcattgatatccctcctgtggtgacgatttcaaaatgattatagcatacatgtagtagcgtttgatacttactgacacagataattgcttgagaaatacaaataagtaaagattaatgctcacaattagtataaaattagaaattttcaaacaatggtcataatttggttacttatctccgataaactaaaaagtgttaaagaatagtgataaggagatgaggacgatgcaaacacctaaagtggaaccgaaaaaaagacggtttaaaatgccgtcagcgtatacgattctgttcatgattatttgtttagtggcaattctcacctggattattcctgcaggggcttataacactgataaagctggcaatattattgcgcatacttataaatcagtaacggcgaacccacaaggtatttgggacgtctttatggcaccaatttacgggatgatcggtaacgatcaaaccgagggcgcaatttctatctcgctatttattcttgtaatcggtggcttccttggtgttgttaacaagaccaaggctttggatgacggtattggtgccgttgttcgtaaatataaaggaaaagaaaaacgtttaattccgattttaatgattttgtttgctttaggcggttcaacatatgggatggcagaagaaaccattgcgttttatccactgctgattccagtgatgattggtgtgggctttgattccctaacagccgtggcgattatcttagtcgggtcacagattggttgtttggcttctacggtaaatccatttgcgactggtgtggccagtcaaacattggatatttcaatgggacagggactcttcccaagattactgctgttgattattacactggtgctgagtatctggtatgtttaccgttatgcttcaaaggttgagaaagatccaagtaaatcggctgtgtttgaacagcgtcaagaagatctggatcgtttctcagtagctgatgctgatgaaggtggcaccatgaccggccgtcaaaaaggcgtcctcaccctctttggcttaacattcctgctgatgatcgttggtttgattccttggagcacgatcaatacgaagtggactttctttgaaagtgcaaccaagtggttatctggtattccagtagtaggcaacatcctcggtagcgacatggtgccgatgggtgactggtacttctcagaaatcaccatgctcttcctgctaatgtcagtcgttgtgatgtttgtatataagatgaaggaagctgattttattcacgccttccttggtggaatggctgaattccttagcgtagctatcatcgtggcagttgctcgtgggattcaagtggttatgaatgacggtttaattactgatacagtgcttcattggggtgaaatggggcttaaaggtctctcagaaagtgtcttcattattatcacctacattttctacattccaatgtcgttcctgattccgtcaacgtctggtcttgcatcagcaaccatgggaattatcggaccgatgggtaaatttgctggcgtggatggcagtgtcgtcatcacggcgtaccaggcagcgtcaggctgggtaaacttgattactccaacttcaggtgtcgtgatgggggccttggccattgcgcacatcaacattagcgtgtggtggaagtggattgccaagctgatgatttacctcttcgttgtgacgagtgtgttcttgggggtgttggcaatattgtaaggtgcggatacaggcagttagagactggagcctaagctgatgccggtagaaatcccggtcttagatttatagcggaattggcttaggtgcaattctctgcctgtaggagcctgattaagccaaggtgcggagctagacggttagagaacggagtgtaagacggttctggtaaaaatcccggttttggatttataccagaattgacttacatgcagttctctgtctagtgtagcccgattaagccaaggtgcgaaaacaagcggttagagagcggagtgtaagtcagtatcggcaaaaatcccgaacttggatttatgccgatactgacttacatgcagctctctgcttgttgtagcctgattaggcaatataaaaaacatgcagcacagcccaattaaacaatcaattaaacaatattaaagaaaccatccaaaatcaaaaaggaggccccaaccatgcaaaacgacatcaaagcaacccatcaaaaagaagccgttgaagctcttaaacgagtagttaaacacccgtcaagcaccacagatcctgcaccgggtgcaccatttggtcagcccatcagagacgcgttagatgaaatgatgcaaatttgcgatgaactcggctttaaaacctatacggacccggatggcaattacggttatgcagaagttggtgaaggtgaagaaatctttggtattcttggtcacgtggacgttgttccagctggcgatacagcggactggagccatgacccatttgaactggtggttgaaaacggtgtggcctatggacgtggtgttcaggatgataagggaccatcaatagcagcgttgtatgctgttaaagccttaatggacgctggtgtgaccttcaaagagcggattcggttcatcttcggaacagatgaagaaacgctttggcgcggaatcgccgtttatcagcaaaaagaagatcccattactcatggtatcgcgccagactccgagttcccggttacctatgccgagaaggggcttcagcaatcctacttcgttgggccaggtagcacggaatttagcctgaagatgcaacacgctttcaacgcggttcccgccaaagcacaatataatggccccaaactggcagaagttaaagcagcgctggatgatttcggttttgactacgaaacagacgaaaatgggattaccgttactggtaaatcagtccacgcaatgttagcgcccaatgggactaacgcggtgttacgattggcaatggcactggatcaggttttcccagatggaccactaggcttaatcggtcgttgcttcaaagaagatgccactgggactaacttaatgggtgatgtagcggatgaggcgtctggacatctcaccatcaacatttcaaacattgaagtcagtcctgaagaaacacggatgcaggtagatatgcggataccggtaactgtggaccatgatgagttgattgagaagatgacaaagaaggttgctgaatatggataccgttatgaagatttcgattatttagcaccgttatatgtccctaaagacagtgagctagttgaaaaattgatgtcagtttatcgtgaggttacaggagatgacactgaaccgcaagtttccggaggggcgacttatgcccgaaccatgaaccaatgcgtggcctttggtgcaatgctgccaggagttccagattatatgcatcaggtcgatgaacagtgggaactagaaaaaatgtttacggcgatggacatttatgctgctgctattaaggcaattgtgggcgattaagagagtgtgaaaacaagcgtttagtaatatttaaaattttaatcgacaaataaagacttagagacagtgaatatcaccgtttctaagcctttttagttgctcgaactaaccttcataatggtcgtctaagtacacaccaatatcttcaacgtataactgcccggtatactgcttaccctgattggtaacgaaaccgttcttggcgtaagcaaatgaactggtggcggtggcttttaccgtggccccttgtggttcaccggtatcagcgtttaatcctgaaggtacatctacactgaaaactttagcggatgatgcgttgatggcattgatccaatcagcaaatttaccttcaactggccgatccaagccgataccgaaaatcgcatcaacaattgtggtataccccgttaaatcagtgcttgctggaataacaggaatctgatagtaatgcaaaattttgagctgttgtgcagtttcggtagacgtgtggtcttctgcgcccgtcagcatgacggtgatgtcaacacctcgaacgtgcagcatgcgggcaattgccagaccgtcaccaccgttattgcctgtgccagcaaaaactaaaaccttcgataaatcaaaattaccatttaacaatcgaccagttgcgcccaaggctgcccgttccatcaggactaatgatgggataccgatttcttgaatcgtatgcgaatcgccctgacgtgcctgagcaatgcttaccgttcgtgtcatctcaaccactccttactattttcttcacgtctagcgtagtcgtttaatgactgaaatgccagtgagaagtcaggggatttttggcaaaaaaattccggtaatgggtagtggatcaccattatcggatttcttcttttattaatgagttcaagcgacgcatttagttcttgatttccgtatcaacacgatcattgtttaggtctgtttgatgacgatcagacagtacaacctttgacacatcaaacaaatcacgcccaagattattaatatcgatatcttttaaatcgggtgcgaaggactgccaccactcatcaagctttgataacccataatccagcaactttttaccatccgctgtcagtgtcaattccttaacacgtttatcgttggcggctgcttctttatgaattaagccaagcgcagttaagtgcttgaccatccgtgtcatcagaccttcatcgacagctagtgttgtggatgcgcgtcgttggctgataggctgactttcaagaatcagaaccatcagatacatttcggtaatgttaacgggtagcttatctttaatcaacagctgattcatatcacgttgaagctggcgatggagaatagcattataggttgaaacggctaaataatctttcttaatatctgccacaaactttcacctcggttacttaaatatttgactattaaagtataactgtatttataaaaattgaatagctttacttagtcaattttcaaaatttttgtaattgctgcctgcatttcatcaggttgaaccgtggtgttgtgacgaacttcagcgtggaagagggtttcaatggcttttggcagcgggacgttaatgtgatcttgaagttgtttcacagcgtcaaggccgtcaacttcaacttgatgtccttcaatggcactgagaaccgcattagggaatttatatggactagcagttgaaacaatgaccattggatgattatcattagttgcttggcggtacttatccgcgacggctttcgcaattgcggtgtgaggatcaatcgcaaactcagtgtttttataaactttcgcgatggcttgctgatcatcatcgccactggcaaagtccgctgaaaaagtggcttgcagtttttcaagaacagctggtttgacctgataatgaccgttcttttccagctcatgcatgtaagcagctgtttgagtggcatcttcaccagttgcgtggaagacgagccgttctaaattactggagaccagaatgtccatggacggcgaggtggtcgtgaaaaatgggcggatacggtcatagtaacccgttttgaagaaatcagtcaggacgttattttggttcgaagcacaaatcaatcggttaacgggcagccccaattgtttggcgtaataacccgctaaaatatcaccgaaattaccagttggtacgctgaagttaatggtgtcgccatttttgattgcgccttttttaaccagttgaccataagcgtagaaatagtaggcaacttgtggcactaaccgaccaatattaatggagttggctgacgagaactggaacccgtgagcagcgagttgtgcttcaaaatccttatcgttaaaaatttctttaacgttagtttgtgcttggtcaaagttaccgttgatcgccactacgtaggtgttttcgcccacttgggtgatcatctgctgcttttgaatggcactgacaccttgactcggataaaagacgatgattttagtaccagtaacgtccgcaaaaccagccatggctgctttcccggtatcaccagacgtggcagtcaaaatcacgatttctttcttaaagtgattcttcttggctgccgttgtcatgaggtggggtaaaattgacagcgccaagtctttaaaggcgatagtagcgccatggaagagttctaaataataatcatcaccatggtgagtgactggtgcaatcaatgggtcgtcaaatttatcatcataggctgcgttgacacagtcgcggatttcgtcatctgtaaagtcggtcaagaacgccttgagtactttaaaagcaacttcttgatagggcatgtttggcagtttgtttaaatctaaattgagttggggagcttcagttgggacgtaaagaccaccgtccgggcttaacccttgtaggattgcagcggatgcagttaaggcatcgtctgcagtgccacgggtactgcgatataagagtgtcatagtcattctccttatttacttacaaattgtagtttctttatcactagtttacctgatttaatgagaaattacagaggagtttttaatttgttgctcattttatagcgggataagagccaacgctttccttcattaccaatgattgttaagatggactaatcgatattgtttcttcaggaaaatttaacaggagttttggaatgtaacatgctaaaatgtgttgaagactatgacagaaagaggaatcactcatggaaattgatgtaccagaaaccatggcagaagtcgaaaaagaagttgctcgccgccaagctaacggtgagaccgtgacggaagccgaagttattaaaagaaccgtattagcctcatttcaagcctatctagaatttgctgaagaaggtcactacgattcagccaagtgggcaggagacaatattgaagtcattgatattatgaaacagcccattgaaacgattaaaccgcagacggactcgtttgtgactgattttaaagcaagcaatgatgcctgcttcttatacttacaagaggcagccacaaagattgcaggtatgcgttaagacttgaaatccttgttcaacaccgctatcatagttgtgttgggcgcccttagtgtaatggatagcacatgagatttcggtcctcatgatccgagttcgactctcggggggcgcaattggtgttttttaacttaatatgattagataaaacgttgatatatcagcgttttatttttttgctctgatgtaatttagtgcctttttagctacatatcgtgtgaaaagtgtgtggctttgttcattttaataactattaccagaattcgttgatattccaatgttgtgatttattgtccagatagttgccatttcacagttcaaattaacataagttaatgtgccagtgatcgagcgatgctaaactgacctcaatcaaaaaaataagtgaggcaaattaaaaatgaaaacagtcattatcttcgaccacccatacacgagtaccgctagtgaaaatgtaccacatcaacgttcttttcttgcagcaatctacaagcaggttattatccagttaaaagctgaaaattcagaagtggacctcattgatctccacgcggatcattttgatccagtgatgtccgctgaagacttgtcgaactggcgacgcggagtgccgattaacgctcaagttgaagactatcaaaagcgattattagatgcggatcaaatcatcttgatgtttccaatttggtgggaagtcatgccagcaatgatgaagggctttctcgataaagtttacgcaaagggctgtctgtatcaggccggctcgatgcaaaccaaacttgttcggcaaccaaaaattaaagtgattaccacgatgggtaccccaagttggatttatcgttgggtgataggcgcaccacttttaaaggcgctgttccgaggaacgttccttaagacgaaacttttccattttaagtggtacagcttttcacaagtggaaaagaagtcattggcacaacgtcaacgcctgattcaggggttcaagctgtaatttggttaaatagttgattcaattttagatgattttaaagaaaggtcgaagctcgtgtgacgcgaacttggcctttttcgttgagcatattgattggtcgattgctataccctttaaaaataaaccatctgtgagaagattgttttaaaacataaactaccaccaaagcaaattaatacgtgtaatggagcggcttcgtagtcaatcaaggttacggggatacttgttatcaagattgattcactttatacttatttttatatgatattgggaggatttatgatgaagaaaatcaaagtatttttactttccattttggcagcgtgtgctattctttttgcagtatcgacgacaactgctcatgccgcaacttggcacaagtacacaccatcagcaattcgtggtacttgggttactgagaaaattgactatctcggcactaaagcgcgaattgaagtaaaattatctaagaatcagttttatcttgaaggcaacgacccaactattttaaaaaacatgtattatcaccataacaagggtagtcattattactacatcaagggcactgaatatatgtatactaaggggcatgaagtagattactataaggttcataaatctaaaaactggattcatctttgcgcgtatttaagcgttaacgatgggcatcactataaaagccattactggacaaattattactacaaaaaatagtaaaaatctaccagccaaagtggtgaatttttagtattctcactggtatcattacagaagtttaaaaatgacgatactttaatgccattcaacataggataaataaacccattaaacaaaaaccaatcattttggagtaaactattagatagatatataaatatttgtagaggggaataaataaactatgataataacgactcgaaaaatttctgattttttagctgctaataatgtagatcctagcaaattagaccaatttttggtgcaaaatgactttggcggtggctatgtggtagatgagaaaccagtagaagatttctacgattgcttaaaaatcacgcaacagcaatttgcagaagcggtaaccccagctaaactcatcagcatttacaataattcgaagattgaaattattctgtttagttggcgtaaggaaaaagcaccgaacgctccctattatactaatgaaggagatacgggtatcattataaacggtggtgctgaagtcttcgttgaccttttttctgatagacagttaaataaaaaattagggaaattgatcagcgagtacattactcaataatgcccctgtttgtcacgatactaattgataagaaaacagcatagtcccaacagatgaattactgtcggggctatttttgtggcttattgtagaagtgcaaaagttgttttctaattttagacagtaaaaaagacgtgttgataacaacacgtctttgtttatagccctgataaactttttttctacgtcctatggctctctctcttggaactgctctttgtccccgaaaagaagtataacacttttccaatagaaaattccgttttgcctaaaaataattgacaaatcaacaaaaataataatgaaatgttgatatatagcgctttcaaagactttatacgtgatgaaactacttagtttttattttcaaaaagttcatcgaacagattatttgtgtgttagggcattgatgatcaagcaaatttgggagttgaaatgtggaaatgaccgttaaaaggatagccagtagattaaaagtgaagtaaactttgtagttagttcatgatgttttgaacgctaactattaaatggaggaaattgcgcatgaaaatcagaccaatcgagaaaaaggataacgcacagattaaaaagattattcaagctgctattcgtgagtatggcaatgatttacccgattcaccgtattatgatgaggttctagatcacttagcggagcactacgcacagcaggataaggcgaaatactgggtagcagaagttgatggtgaattagttggcggtgctggacttggcccattttcatatcccaacacagcggaatttcaaaagttatacctaacaccggctgctcgggggcatcatatcggccatcaattagaaactctggcagagaagaccgctaaggaatatggttatgacaaattctacatagaaacgtttttgaactatacatcagcgcgaggattatatacgcacgttggttttacacagcttgataagcctttgggagataagccggctcataaggcatgtactgcttggtatgttaaggacatttaaatagtggtagtaaccagcatgacgaatattcaaacttgtcacgctggtttttgttaggtgtagattgcaatcggcagagcattaatgtaaaatcaagttaacaagtagttgcaaatgcaagtactgaattctaatttaggatgtgtcagtatggctaatttagttgttgatccagctttttgggatctttttccggatgcccaaattaatacgttaaccgttcatgggttaaataacaccgttgatgagtcacaagatccacattttcaggctttattagatgatgcgatggcgaagtctcaccagtatttaacggaagatacctttcgcaataatccagtagtagcgcaatggcgcgatgcttacagtaaattcaagaaaaagaagggcgctcgatcatcgattgaagccttgctgaaacgagtagatcagggcaagacgctttcgccaatcaatccgttagtggacgtgtacaacagcgtttctctggaatttggtgtgccttgcggtggcgaagatttagccgccattgatgggccgatgcacctcggtgtcgctaaaggtggcgaagcctttaagccattaggtgtgaatgaagacgaaccagctttacctggtgaagtgatttactacgataaaattggggcagtctgccgctgttttaactggcgtgatggcgagcgaaccatgttaacagaaaaaaccacggatgctattttagtcatcgaagcgattaacgaggagcaacgtgtgcgtcaggctgaagcagtgaccacaatgaaggaacggcttcaaactgaatttagtgttgacgctgatgttgacacgtttacggtagcttaaatgagcgatgatccgttgagaaccatcggggtcatcgccaaggcactagatggtatcgccaatattgaatttaaacagtatcacctgacacgtggccagtatatgtacctcacgcgaatctgtgaacacccgggattaacgcaaaccgagttggttaatttgattaaggtggatcgggcaacggctactcgagcggtacagcgactggaggaaaatgattttgtgcgccgtgaaacggatgaccatgatcgcaaaatcaaacacatctggcccactgaatatgcgcaagaagtttaccctagaatcaaggcagaaaacgactattcaactcaggttgcgctgagggggttcagtgacgatgaggttcgccaagtcaaatctttactgagtcgcatgagcaaaaacgtcagtgatagttgggattttgttaaacagggtggacatcgtgattattagggaataagttgatgcccgttcacttatagataagtaaagacaggttgccttagtgggtagcctgtcttttgtttattcaaccgttcccagcgcaatcacccgattcttgatcaacatcgccaccccccacgtgatggcaataaggccgattaccaagaaatacagggcttcatgtcccttcgtgtaaaaattgactgcaatagccgataaaccagatccggcagcttgagcgagggtgaagatggtcatcatttgagtaatgaatgctgcgggtgccacttcactagccatggctctaccgatgggagacgtcaatgtttccccagcaataattaatatgtaaaagacgatgatccaaagtggcgatacttttacattggcaggaaagagggtcaatggtagtgtcatgaacacgggacccgcaccccaaagtaataagccgataccgaacttcaagctttgattaggttggcgcttccctaacttacgccaaataccgctcgtaatactgccgaataagacggcaagaatggcaggaacggtttgaaaactagcagcagataggtgaatccccaaaacgtttagatcaacatggtcaagggtgtaaattgataaaattccggtggcttgtccctgaaccagcatggtaatggtagtccccattaaaaacaaactgtacgttttgacgtgctgggcttcctgatgggtaactttgggactacgaatgattttaattaaataagcgacggggaggatgataccaatgagtcccacggtgttactgaaacgatttgcggttaagtatcccagcttaatgagtgacacgagtaagacgacaacgatcatgatagttccaagtgattttttaataagtagggaccgctctgctggttgcagcggatctggcggcaccataccgagatcgccaaagtagcggcgattaaggcagatgtagggcaacgttgtcagaagttgaataataacggcgactaaaaagccgacgttatagccaaaatgcagcgcaacagcgccagtgatcacaggccctgctgcgccaacgttattcataatgtaaatcatcgtgaacgctgtgtttcgcatcgtacccatttgtcggtaaatcaggccaactagcgcgtaaaggctctgaccagtgacaccagaggcaacgatttgcagggctaaactgatgaaaaatagagttaggccaccgtgcggcatgactaacagtgagatggctgcaatgttgagtaaagtaccatacaagtaaggcttacgcaggccaatcaaccggtctgctgcatagctgccagcaattcctgcgaaataacctaatgaggaaaagactgccataatctgggtagctgtgattcggtcaatacccagtccgcctaggtgcagtggctcatagaggtagagaatcatgatggcgctcacggcgtacgttgcaaaaccgttacccagtgcgcctaaagccattaacctaaaggcgggcggctgatttgtattggtgcctatgtgttttgacaattccagtgcctccaaaatataatttaagtgaactaaccataataacataccgggaaaatagggtcgcttttagcaacaaaagccattttgaaagtcagtggattctgcctaaaagaaggatagccatgctataatttgggtatcaaatcatgttatcgaggttaaaaaatgactcaaataacggcgaaagataagagtaaggaaaagttttatcaggcactgctgcaaattaaatcagagggtttagactatcggacgttaactgttcagcagcttgcttcgtatgctggattgtctcgccaaacattttaccggcattatcaagataaagatgaaattatcacatcacggattcatgaatttaaactaaacgcattgcaccactttacccagacttctaacctggatgcgcaatcaatgattagttttctgttgtcgtattgggacaatcaccgggaattttttgcactgattgagtggtcaggactacgtgaggtttttattgataacgtggcgtttatgaatcgtgaaattatgaagatgaataacgttgtgcatttgaatgagacctatatcagcaacacctatgcgggggccatttacatgttcctggtgagctttttaagtgacgagcatcgtcatactaatattgaaacgctgattcagttatttttaacgttaacgaatgggcaggagctgctatttaaatagtgacattttggtggaatttggtacattttagctgttatttccatgatactctagggttgtgaaataagtatcaaactttgatggaggtattatcatggaaattacagctgcagttgcattaaaacaaggcgatcctctcgttgttaaaaacgttaatttaaatgacaaattaaaatctgacgaattattagttaaaaccgttgcaagtgggatttgtggtgcggatattcaagaaatcaatggtggtcccacaggctttgcaccaattcccatgattatgggccacgaaggtgctgggattgttcaagccgttggttcaagtgtgaccgaatttcaaaagggtgatcacgtcaccgtttcgtatgctagttgtggaacctgcaaacagtgtgttgctggccggccgtacgcttgcgaacggatgaacgaacttaactttgagggtaaagatattgatggtggcacacgctacgaacttgatggcgagccactgagttcatttttccagcaaagttcttttggtaactacatgaaagtacaagccagaaacgtggttaaagtgactaaagatgttgatttgaagttacttggccctcttggctgcggcctgcaaacgggtgcaggaaccgttttgaacgacttgaaaccagaaccaggtgatggcattgttatcttcgggactggtactgttggtcttgccgcaatcatggctgccaaagttgctcattgtgacccaatcattgccgtggacgtggttgatagccgacttgatatggcacttgaattaggcgcaaccaacgtcatcaacagtaagaagacgcctgatgtgccagccgaagtgaataagattagtgcgggcggtgttgaatttggtgttgtttcagctggcgttaatggtttagctgaaaatgctgttcgttcaaccggcatctacggtcagattgggattattggcggggcttttgaaggtaatttcaatattgctcaggatattctgattccagcacggacggttcgcggtgttctgcaagggtcgtcactacctaaattattcattccaaaattgatcaaactataccaagatgggcaattcccgtttgataagttggtcaagttctatgatttagccgatgttaatgaagctattgaagattctaaatcaggcaaagtcatcaagccaattttggtaatgccagaaaataactaatatgtagacagctgttagaatgttgatcattctgatagctgtttttgatttaaaggggaatcgcacaaagcacatcaaatcttaatcttttcttaattattaggttgtcccggtattcgggggagagtatacttaatttgttcgaggagaatcgctttcatactttgttatagggggaatcatcatgaatttttgtcctaaatgtggtgctaagattgaatctaaagagatgcgcttttgtccgaattgcggacataaattagtggcaaacacgggcgttagtgctgaaaaggtaagttctgtagggggaactaccgcagctaagcgaccaaccgcccacgttaatgtggaaacacctaaggctaaagttaaaccggagcctgaagttgaacagccgcaggaacctgaacccgaagagacgacatacgcgaagtcaagaagcaatacgtggatcaaaaaggagttctcagctagtgccctgctattttgggtcaagggccaaatttcggtggattatcggtttgtcagaattaatgaaaagaatacggttttaggtgtttttccagcgggctcacatactcaaaacgtaccgttgaaaaacatctctaacgtttcattgaatacagcgtataaaatgagtcgtttcatttggggaattatattgtttttctttggtttcgctacaatggatgcatcggtactattagggctgattttgatggttctgggtgtagggatgttcttaaatgggattatgacccagttggaaattgaaaaaagcggtaacggctacacgattgcggtaccgttcttcaataagacggatatgcaagaagttcagcaggtgattgaagatgccttaagcacggacgttgataagacggatcagagcttgtatcagcaccggttgaacccgaatgatatggataatgttgaataattgaatgggaatagcaaaagagcaattcacaaattgcgcgttaatctgtgaattgctcttttgtggtgtttgaaagatttagttacccaagaaattaataccaaacttttaattttttctcgccaatggttaaataatgatcatcaatgtggtattgaaaacgcttgttgtctcctagaaaatcatcttcgaaaacataggcttcagtcattacatccagagaaaggagtgtaaatagtgcttgagccattttgcctggtgacacatcaattttattaataatgactaggttagctatatctgaaatggactccaaaaaatgacgaattttatccttagattggcagatcgctttgtctcggatcttcaaactgaccgtttcactcatcatactagcatccggaataaattcaggatcctcagagttatcagggtcatcaggatcccatagttcgtcaaggggagcacgaccacatccctgattcgtaacgatgtaatgcaactccttcttggaattaaggaaagtggttgcaaatgagtaaagtggcacctctgtcagcgataaagctgtcaaaattagctttgctgcgccgtctgtgtaagtaatttggttaaataaaaattgaaagggttcttctactggttgtaggaatttcttgaaatcaccaaatgttatcaaatcagacgcatcatcaatggcgacgttaaaaaccacatagtttaagtcaacatagtcgcgaaattcataatcttccatcgttaaacacctcgtttgagtgggtaaaatggtcggaaaaatcgacagagtggctattcaaaacttatttgtgccatacctgaatcatttcagggacgtgagttaacgtcatcgttagctcctgagtatcatcagcataggtaacgactgccgaaatggtttgattgggaatgtgataggctcggtagcggtggcctgctggaattgttaagccatcaactgtttgatcataagcacagcgcagtgtggatattggaacataaaaagggtagaaatcggcatcaaaatcaaattcgtcatctggttcttcgtcgtgttcatattgtatttcattcagatcaaatgttagcgtttgaggaatttcatcagaatggcgagattgcagagagttaaaaataaaggtttgaaactgagaaaagtcgcagtagaaccaacttagaaatttttccaaatcattactttcataatctaaatcggctagctgatgctttgtagccatacggattaagtctaaacatttttcctggttaaggtcatcaatccaaaaaggaattgacgcattactatcatctgcagagtcagctcgaggatcacccagattcaattcattaggatcagtgggtgtttgacgaatataaggcattaagtcgttgtagacatccactaaatcgaatgggagatcggtttcagccggatataatttatcggggatgaatcgttctagtggcgtgaagtcattttcgaaagtatgacaagtttcgttgatttgagcagcaatagtcgaattaaatgcaggaatttcatggacaatttctggagtttgatgagggtagcctagcttgaaagcttgaagtggtgctgagatggtatcctcgtcacgccaaaaaacggtgaaagagggataggtcattgttctgtcatcgccgtcacctaaaataaattcgggttgaaacagaacagctaagtggttagagattgttttcaaccgctgatttaattcaattgcaccgcttaatgtaacagctttcgtgtattggttttctgcaggtatagacatagaaaagcacactccattcttggttagaatatgagactctcacttgatgttttaagtataacggacgtgagtgacacgtaatgtcgtttttaaaatcttttaacttgaaaaaatttaaatcggacattatgctccgttctaaaagcgacgtgatatgacgtgctaatttgctacattttgattgtgagttgttaaagtatcagaatttatgactacaaaaacaattgattcagaccgtaactaatggtaattttagttaaaaataataatcctcatactgcttattttaatggacaaccttgaagggaagttacgcaagtggataaaagagacgatagtattcaaaatggtaatagccaaaatcagttgtcgtctaaagacgaaaacgtagattggcagtctaaggttaaagagagaattgcaggggaaatgctgtggttatttcagaaaaattattttactttaaacgacatcgttgattactttcacgagaatcaaggatcagttcaaagaacagttcaacgagatttgagggctataaggaagtcgatgaagtatatgcctgatgcgggtgattatactgtgaaatacgacaaagacattccaggttatcacttgttttatgaagcagatgacccttattatcaaaaaaatcaggaaattgacagcctccatggtgatgaagctttggcaatcatgaagattctgattggaacccgtgcgcttgaaaaaggtagtgtaaataagattcagaagcatttgaagtataatctaacccaaaagcaacgagatcttctaacacgagaaaccactgagacactcagtaagtactattcagttaaaaccgtcccagatttgattgagcgggtaaaaatcttcacagactggattaagaaaaaagcaacgattaaattcacttatcaaagcagtgttcccaattctagtgcaactaaaaaacggcgtggtgtaccgttaagtttgtatttttcagagtattatttttacgttctgttatatgatgatgaacataaaaagagccggatttatcggctagatcgtttcatcaccttccgcaaaacgaatagcggtaaggtgacagttccccggatcaaaaaattggatgttggtgagttacggaaaaagacgtaccttctatctggcggcggcgataccacgttggaattttggtaccgtggtttcccgcaaacagccttagatcggtttcccgaaagcagtgttaaaaaagcccgtactttagacgacggttcccaagaagtaatgattaaatgcccaaacgtggctaagcagggcgctaaactttggctgatgagtcaaggatccttggtatcgggcgtgaaacctgaatacttgagaggtgaagtacgtgaggagattcagaaaatgatggcgaattatgaatgacgacatgactttttaattcagcctacttagagtcaccaattgaaataaatgaatcaacaaaaaagtctaagattaattctgctgtggatgggttactccatcgatgtcagaattgatctcagactttttgaatttcagttaatgaaagttagtcaggaaaagtggcttgtttttcgtcgttaagactaggccacagttcctgttcggttttatccatgagacgttttacgcttcgaaaagctgaataatgatcaaaagttgttaaattatcaattaactggataacatactttagaatttgtggatcagtatttaattcgttttggtgtgtttcaatatcactcttcatggattgtagaatttcgcttgtttttccaccaaatacaatcagttgttttggctgaatcattgtacactccgcaataaataagttcaaacttagcagataagtttgcttatttttaattcctaatgtatttgtctcggtaaccgcagccgcatcagttctgtttttaaaatctggcaggttttctagatagtatttgccgagactttcagggtcagaaaattggagtaatgacttcgacttgcccaagttaaattgatttacaactttggttgaatcactttcaacggtgttttttaatgcatccgtgatgtagcagtttttgaagcggtcttgatttatctctaagtataatttatacgtatttgcaattcgtttagtatcgtgaaacatttgccaatcgtgttcctgtggttcattatcttcgctgtttctttctgcacaattaagggctacgaacataaattcattattgactggcttctcagaatcaaaaaagttagggtagttttcggtcacttgactgtgctttgaattcgggtgcttaaaaggaaaaggaaaagcgacatcagtatttgcgtaatgtgttttttcatttggctcgaatgctttagaagatttaatgtctccattaggccccaaagttagtggtgttacatctgacaaatctggaaagtcacgcttaatctgttcattactgggtaagtcatgcacacaggtcgtgaacgagcttatttgcgacatatccacatcatattgactacttaattcatcgagttcctgttttacttgttttctagttttcatatgagtcactccttaaattagtaaccttccaagaaagcttcatcttaacttccacgtttagagttacaaagcagaatcagaacgtaaggcttgcagagttgttcttttagagcttttagcttgggtggatggtctgattaatatattgaacaaacatagtatacggtgtcccgacgacatggtatgtcgttaaactgacagaaaataaaataattagcgacattcagtcgatagaaagcggttactataatgtgtttattatatcgcaaagtaaaactaatttacatataaggaaaaagaatgaaaattaactaatttagcgacgggtggtgacgtttgccaatgttaagttatgtccacgatgacatgaaacatcaaagcagtatcgttgattctactcacaattaatggagggattctgatgaaaaaaggacttatgttaaccgggttaataagcgttatatttttaaccggctgcggtaatagcagtaccaatactagcggtcacaaggaaaaggatgcggtgattccggttaaacagttaaccaccaaaactaatcaaggatatccggtaatatctggagtcaagaattcagtgcggctaaagcctggcaaaattgatagccaagctaaaattgataagtacctgaaaaatcgcttgtttctggaaatggatggttctaagtcagcaatcaaagaggcaatggctgatgatgtttacgattctttagtcactcagggaattctattcgattccaaaaataaagaacacacttttgttgatatagctgatgaattggaagatggggataagacactcacttacaattactatcccaattcaattagtccaagtcgtgttgagttgaagtggaatcagcaaactaaaactattatgaaaattgaacacggtgatgatactgatgatagtgttgccacctcgtataagggaagaattttaccagatggcaccattaatatgtatttagtcggcacatataacggctataaaggtaacaatccgctgagtgtttccatcttaaaattggacaatgactatcggtatgtggcattaaatagccaaaagtatcactataaatttttgaatgaataaggtagctatattttctagactggacacatgatttagatacaaaataattttgaaataaatttgaagttaaatttaaaacgacacctggtgacattggccgatgataaagtaggtctgcattacgaaattatttctttattgggaggaatttgaatgttaaaaaaggtcggtaaatcagcaattatggttatggtaggaacatcgctattgggaggtatatttgttgaagcacctaatgcactgagtactacacaggctcaagcggcagctaagatccccaattcagcctatgtacgtgatctaagtggcattaaagcggctttaggaaaggctagttctgacgtccaagcaggggttgcaagctcactgccaagtgcgaaggaataccggtatgcctatacatcttggaattggccaagctttcatgattatttagacaatcttgcaagttcgattgaaggccataccaatacaaaagcaactgctcgtgccaactatgactgcatggttgcaacctataacatctttaaaaaccggttatcatcgggcgctcaaagccaattggaagcattggcgaataacctgaatcaagaaattaacgccacaaacggttcttcggacttctatgatattgctgatcaagaagaagggtacgtgcacgctttggaagccgctgtacttgattatggcggtaactatgatggtgtcgcaggacccaaatcttccgctaaacacagttatatttctaaattatccgtgaagaaaaccggttcaaaaaaatacgtgaaagtgactggtacggcaaaattgtataaatctgctaactatgctcacatccacacctataaaggatatcgttatgtgaagttgagtagtaagcacactttcagcaaaacaatctatgcaccaaaagctaaaacgattaccgtcaatgccggttattattcacacggacattataaggcggttacttctaccaaaactgctcacgttaagtagaccaatctgtttaattattgggattatttgtagcggaacaaaaagtgactgccaaagccaaatcttaactaatgcaaacgctaagggatgaacttaagtaacttgttttaggaaaaacgagttgacagttcgatttcaaaagcgttattatcaatggcaatcacatgagaatataaaaagttgatcaagatgagtagaatgttgcgccttaaaagagagctggcggttggtgaaagctggtaaggtaacacgtttgaagatggtcttgaatttaaactagcagtgaggcttagctaagctgtctacgggtttgcgtgcgttattcatgcaaggttacagcaattttgctctaacttattgagccactttttgtgaaaaaagtggaaattaaggtggtaacgcggcaggcgtccttaggttctaagtttagaatctaaggacttttttatttggaagaggagtggtttgatgtcagagaaaaatattgaaacctatcggcaaaaattagcgcagtatattaagttaagttcagtgtctgctaaatatcagaatattcctgaaacggctgatttcttgaagcaaacctttgaagaacttggtggcaaagttcaagtgtttacggatgaaaaatttccattagtattcgccgattttccggttcctgatgaaaagccaggtgcgccaaccatcttattttacaatcactatgatgttcagccagctgaaccatatgatttatggcatactgatccctggacgctgactgaaaaagacggtaagttatttggccgcggtgtagctgattgtaagggtgatttgtttgcacgattaacagccttaaaagactacctggatgaaaatggtcaaccgcctgtacacatcaagtttttggttgaaggtgctgaggaaattgccagtcaaggaattcatagttattttgaaaagtatgctgatttgtttaaaaccgatttgattatttgggaatccggcaaaaagaacgagattggccagctggtaatcaccggtggcaacaaaggaattagctgttttgaactatcaacccattctgcaagcattgatctgcattcttccaacgctgcggtagttgatggtgctctctggcatttaattgccggcattgctagtttgcataaagatggtaaaatcgccgttgaaggcttctatgacggagttgaggagcctacaaaacgtgctaagcaattagcgcataaaatgtattattcacccgcaaaaatcaaagaagaagatcaccttgagtaccccttcattcaaggtgacgatgaaaatgccattaaagaagcactgttatttgcccctagcttaaatattgagggtgtcagtggcggttatgaaggcgaaagcgttaaaacagtgttaccaaaacagggtgttgctaagtttgatgcccggctggttccgggtcaagatccagttgatatcgctaacaaaattcaaaaacagcttgagaaaaacggttttggtgatgttcacgtgaaatttaccatgggtgttacaccctaccggtccgatatggatgcaccactgatcaaggagttgattacgaccgctgaatcagtttatggtggtgaagataaagttgaagtgttgccaacttcagcaggaacaggaccatcatataattttaatcattttttggacgcgccaatcgcagcttttggggttggaaatgcacagtctggaccgcatgcaccaaatgaaaatattgtgattaaagactacgagacgggaatcaaattgctggaacaattctttaataacctgcatgtgaaatagttatggcagcttgacaaacaaattatacatgattagaatgttctcataaggtaaccggataaattaaaacataattagtaaaaaatagatgtttactaatttaatgttgttatccacctaagtaaatagaataatcgataagaagaagagtaacctaaaaaaacatgcacagaaaactcggttgatgaaaaagagtcttgtttatgtggtgaagatgagcttctgaaggatagtgaagagtgcaagctcttcattcggtaggacccgttaacgttccaagcattattgtgctgttgaggtaaatcatgtgagtgatttataaacatgggtggtaacacgaagttttcgtccctaggtcatataagtatggcttagggacgaaaactttttttattttctgtagaaaaacggttatatcaattaaacggatatgtgagtaaaaaactgaaacgagggttatcaatggcaaagcaattaatcaacttagagaatatcaacgtttcgtttgatcaagcaggtaacacggttcaagctgtgaaggacgcttctttacaggttgaacagggtgagatctacggcgttgttggctactctggtgctggtaaatcaacattagtgcgagtcatcaacttacttcagttaccaactagtggcaaagtcgaaattaatggcgaagttctttttgaaaagaaggatggcgttactaagcagattggaaccaaagagttacgggaaaagcgtcggaatattgggatgatttttcagcattttaatttactggaagaaaaaacggtgattagaaacgttgagttcgctctgaaacatagcaagaaaaaagagaaggaagttacggcacaagcgcttaagttgttaaaactagtcggtttagaggaccgcaaagacttttatccggctcagttatctggtggtcagcaacaacgggttgccattgcgcgggcactagctaatgatcctgatattctaatttcagatgaagcaacttcagcgttggatcccaagagtacaacgcagatcctggatttattgaaacggctgaacaaagaattgggcctgacaattgttttaattacccaccagatggaagctgtgaaacaagttgctgataaaattgcggtgatgagttccggtgagattattgaacgcggtgaattagttgatgtcttcactcatccccaaaaagaattaaccaaagaattgattggtactcagggtgaacttaaaaaggccatccatcttctggataaagatgccatccaacgtttgaatcacgaagaatgggagttagctcatttaacttacactggtaccaatgtggttgaccccattgccgcaaagctctacaaagactttgatgtagaagtcagcatcatctttggtaacgttgatgaacttcgagggactcccgttggtacgttattcgttactttgaaaggtgccaaggataaccgtgaaaaggcgattgcctatctaaagaaggcaggggtcgatgttgaagaatacagttctagggaggtgattgcataatgtcagaattcgcacacttaatgcctaacgttgttcatctaggctggcttggacaaaacggctggttgacttcgatcggacaaacgttatatatgactttctgggcagccttgtttggcggtgttattggtttgattttcggtgttggactagtgatttttgataagggcgggattgctgaaaaccgcgtgttattcaatatctttgataagatcgtgtcgattgttcgtgccattccattcattattttacttgcattcattgcacccgttacccaagcaattgttggcacacagattggtccgactgccgcgttagttcccctgtcattgtgcgtaatcccattttatgcacgtcaggttcaagcagctatttccagtgttgataaggggaaaattgaagcggctcagtccttaggggcaaccgttccggatttaatctttgacgtttatttaagggaagcaagttctgaattgattcgagtcacgacagttacactcattagtttgattggtatgactgctatggccggtgccattggagctggtggacttgggaatactgccattgcttatggatataaccaattttcaaacgacattacgttggttgctacactgctagttctaatactagtggtatttgtccaactcactggtgatgttttagctaaagctacgagtcacagtcatagataattaatagaagagggtaataggttgagtacagaagaagataacgaacgaattaagctattacaggatttcatcaagattcaaacgccgaatggcaatgaagtagaagttgctaagtacattggcaagttatttgatgaaaatggcatttcatataagattgatgaatttggtgataaaagagctaatctagttgctgaaatcggggagaaaaaggtcgacgatgtcttagtcttaactgggcatcaagataccgttacagttcccaatgcagatgcttggcatcatgatccgtttggtgccgaaatcgttggcgataagctatatggacgtggtgctgctgatatgaagagtggtttggcagcccaagtacggacgttcattgaattagttaaagaaggctacaaagttccggggacactccggttcattgctaccgcaggtgaagagtttgggacacctggtgctaaccgtttgaatgatcaggggatttcaaaggatgttaatgccatggttgttggtgaagctagcgatggtaacgtggtttatgcacactgtggtagttttaactacgaaatccagagtaaggggaaatccactcatagctcaactccagaactgggtatcaacgctctagatggactgaatgagtatagcaaccgcgaaaagcatatctttgacgatgcaccggttgatgaatatttgggtaagttagttcacagcattacgctgattaaaggcggtgatcaggtcaatattattcctgaatacggagaattatttggtaatatccggccgacattagcttttgacaatcagcacgttattgatgccatccaaaagacggtggacgatatcaacgcgacaacggattacgaactaacctttaaggtcatccatagttggcacccagttgaaacgtcacctgaaaagcacctagttcaagttgctaagcaggcagctgaaaagaactatcaagatagagacattcagctgattacttacaaaggtgctacggatgccagcgtgttcaccaaaggtaatcccgatattgacgttatcgttttaggaccagataacgctagtgtggttcatcaaactgatgaatttacaactgttagcagctatctagataccatcaagacttataaagatgtggttaaaggctattttgaaaaataataaaatttgttactcagaggagagaatattatgaagaaatctactaaatggatcgttggtattattgtcgttgtggtcattgtgattgccggcttctttagttttggtggcagcttaagcggtaagcaaaaagcgcaaaccgttacagttggtcgagttgcaccatctaagggtgatgaagccgtttggagtaccgttgctaagcaggcaaaggataagtacaacattacgattaagtacaaggactttactgattatgtgcaaccaaacaaggctgttcaaaacggtgaaattgaccttaactccttccaaactgaacaatatttggatgtttggaacgctgcccacaaggatagtaccttaacttcaatcggttactcaattactgcaccactgcgtttgtactcacgcaaagtaaacaatgttaaggatctaaagaagggtgctacgattgttatcgataacgatgccgctaaccagggtcgttcactgaaattattgcaaagtgccggtttgattaaattgaacaacgttaagacaccaacaccaagtgatattaaatctaaccctaagaacttcaagattacaccaatcgatgccaaccaaactgctcgtcaactcgatgatgtcgatgcagcgatcgtcaatggcggtttcgctatggccgatcacgttaacattaaagattcaatctacaaggaacctttgaacaagacaaataagcagtacttcaacgtgattgttgctaccaagaagaacaagaacaagcaagcttataaagatgttattaaagcatatcaaactaaggctgttaagaaccaaatcaagaagagttatggtgaacttgaacaaccagcttgggacatcaaattctaattagacgcggagattttgacattcaaccgtaaatgagatgtcaaaataacaacttaagcagtccgattaccagtcaatattcgactgataattagactgcttttagtttattaatgatataggaggatatgcagatgaagacgaaatttgcagcagttggcgatgccattattcagcgtcatatgcctagtggtggttacccaggttttgaagcggttcattcgattattcaaggtgcggatgccagtatttttaatctggaaacgacggttcataagtatgaatcatatggttcgcagtatagtggtggcgggtatttttgctcagatccgtcgattttgaaagacctgaaagaatttggctttagtgccaccacttttgctaataaccatacgatggactattcgtatggcgggttaactaaaacattagactacgtgaatgcagccgggattcctttagctggtgctggcaggaacatgcaggaagctgctcagccggcttattatgattcaccaaatggtcggatcggcgtgattggggtcaccagttcgtttaatcctgcagccattgctggtgacgcctccgcctatttacctggcagaccgggattaaatccgttacgttatcatgccacttattttgttacacccgatcaaggcaatgcgctagccaagattattgacgcgacgcatgcagatgataataatcggttattgcgcaaagcggggtttcagccaaaagtgccggataacacgattgcgttgggagactatcgctttaaaattgctgctcagccaggccacgtgactgaagtagacgaaaaggacatggctaggattcaacgatcgattgaagaggctaaggatcaggctgactttgcggtggtttcgattcactgtcacgaaatgaaagttgaggatcgtgaatcaattccagattttctggaacagtttgcccgagcctgtattgattgcggtgcagatgccgttgtggggcatggaccgcacacgattcgagcggttgaaatataccgggatcgccccattttctattctttaggcgattttattcttaatatccaaagtatgaataaagcacctgctgattattttgagatgtacgatttaccaaccgactcaacgattaaagaactctttaacgctcagtgggcgggctacactcgtgggatgcaagttgaccccaagctttatcaggcatttatcccagattggacgattgagaacggtaagctgacaagtgttgaaatacggccggttgaattaggctatgactactcactttctgatggtcgaaagggatggcctacgatttcgaataaaggggatattttacagcgcttagcaaaactgtccgaaccatatgggacacattttcaaataaatggggataaagcttcaattgaattataggaactaaattgtgcgactagtctggcagaggaccaagattagtcgcacaattttgactttaacagcccaactcgatatagttagtgtactaactatatttaaaaggaagaaacactatgaataatttcggttatcttatcatggatgtagccaaagaacttcgctatcagctcaacgttgccttagaaaaagagggtatcaccagtgcgcagtgggctgtgattgctcaactggagctgccaaaggatccgttaacttcagctcaagttgcggggattgtcggaatggatcgagcgaccgcttcgggaatcgtcaaacgtttggcggccaaagagctggttgctgtccaagcttccagtcaagatcgacgggcacgtgttctcacgttaacggctaaaggcgaagaaacctttaaacgctgtgagcaaattgctaacgcacaaatgtcagagtttgccattcccctggagcagcaggaacaagcaaccttagtgagtttgctgattaaattggaagaaggtcatcatgttggataagatactcgttttgggcagtactgggaatattggctggccggtggttgaacaactggcagcaatcgatgatgtgaaggtcgttgctggtatttatcatgctgaatcggtgcaaatgaaacaattgggtgtggaaacccggcactttgattttttggaagctgacacctttgacccagcactcaagggaatcaataaagttttctttgttcgcccaccggaactggcgaaacctgaacaagatatgaagccttttttaactgcggtgcaacgccacggaattgaccaagtggtgtttgtttcattgattggtgtggagaagaatcccatggtaccgcaccgtaagattgaacggatgattactgagatggggttaccccatacttttattcgaccaagttttttcatgcaaaatcttactagcactcatctgcaagatattcagcaaaatcacgatttatttgtgccagcggggcattctaaaaccagttttattgacaccagagacatcgctgctgttgcagtagcggttctacgcgatcctaaatatcttggtgaagcattggcaataacgggacccgcagcaatcacttataaacaggcagctgccattatgaccactgaattaggggtgccaatcacttacagtaaacctagcctgctaaaatttcgtcgcaccatgattcagcgggggattaaaaaagaattcgtcaacgtgatggtgatgctctacatcatcacccaacttggcaatgccaaaacggttaatcatacgattgagacagttttgcaccggccagccactacgtttgcggaatttgtgcgagataataaacgattatttctaaatcaagagtaaattaatagaaccgtgattatctacctgttatggttaaataatcacggttctatttggttgtttacctagtaaatctaacggaagaaagaattttttgatcgaaattaacaatgtcaccattgtggcctttaccatcaaaaataatggccataattaattgaccagcttcattaacggtcttcatgaagggaccttcacggtgattattgatgtcggtggtgacaccgcctgggaaaataccatagatttcaacggagtcttgattcttgtagaaatcaatggctagtgactgaatcaaggcgttaagtgcgaccttcgaaacgcggtaggcagctggattgtaaaaggctgttgcgaaggagggacctgagatgttgacgatttgactctgatgactttttaaaactggtgctaattgttgaatgacttgtaaagtacccagtacgttaacgttccaagttgcttggtattcagctgcggtggttgctaaagcaggcttttccatgtcaccggcaatgcccgcgttgttaaccagtaggtctaaatcaggatgtttttctgcgatgtagctagctgactttttgatggtgtccgtgtcatttaaatcaagtaagacgtaatcaatttgattttcgtcaacaccattttccactaaaatttgtttagtttcagcagcgtgtgcttcacttctcacgccaaggatcacaaagagtcctttttgggctaaacgtttcgtaatttccaggccgataccacgattggcgccagtaatgagtgcttttttcattgtctaattctccttagaaggttagtaataggtaagttttaagtcattatacagccggtatgacgaaaaacaatcctatttaagtgacatacggattaggttgtctcatagtctgaaaacattgatataatagcgctttcattcgaacgattctttaagtttgctttgtttgaacatcagttggtgctaatatattaaagggtaaatgatgcttttagaaacctgctcatttcagttgagttcagttttcaagcggatattgacagtattcaatttcgggcgtagtgttccggtgctaaccggcattgcgcccgatttaaatacgttgataattttataatgttggagaggcaatgatttaatgaaacgaaaagttaaagcgtcacctgcgttacttcgttcgatgacggcgggacaaatggaaatgatctccctgggtggcgccattggtgtgggtctgttcatgggttctacttccaccattaagtggaccggaccctcagttttattggcgtatatgtttgttggtttgattttgtacattgtcatgcgggcactgggtgaaatgatttacatcaatccgggaaccggctcctttgcggattacgctacggaatacgttcatcctttagccggatatttggcaaaatgggccaacgtgtttgaatatattgtggtaggaatgtccgaagtggtggctgcaacccagtatttgcagtactggtggccgcacattaatacctttaccgttggggtggtcatcattggtttcttagtcatcgctaatcttgctagcgctaaagcttatggttcgctggaattctggtttgccatgatcaaggtgattacgattatcctgatgatcattcttggctttttggtgattttctttggttgtggtaatggtggacatccggttggttttagtaatctctggtctcatggcgggttcttcactggtggtgttaagggattcttcttctccatgtcaatcatcgtgggatcatacgaaggtatcgaattattgggaatcacggctggtgaagttgctgatccgcagaaggcaatcgttaaatcagtgaagtcggtgctattgcggattttgattttttacgtgggcgcgatttttgtgatcgttactatttatccttggaaccgtctgagtgcaatcgggtcaccgtttgtctcgacttttgctaaggttgggattactgctgcggcttccgtgatcaactttgtggtgctgacagctgctttatctagcgccaactcgggaatctattcttctagccggatgttgtttaagctggcacacgaaaatgatgcaccgaaaatctttggtcatttatcaaaacgagtcgttcccagtgcttcgattttaggcatttcaggtgggattctattaggttttattcttgatattgtcttttccgcctataataaatcgacttcgaacctgttcgtggtggtcttcagttcatcagtcttaccaggtatgattccgtggttcgttatcttgttagctgaactgcgtttccggaaaaataatgccatagcgatgaaggatcatccgttcaagttacccctatatccattttcagattactttgccatcgtgatgctgttaatcatcgttgggtttatgttcgttaacccagataccagaatctccgtaattgttggtgcggcggttttggttgttgcaacgttgttctacttagtacggcatcgcaaagggcgtttagattagtttcaagagagtgatgcattcaaatgtgcatcgctttttttatttgaggggcaaattctataattaatccgaacagaaattaaaaagcccaaagcaatcacttacaatggtagtagctaattccaaccaatatagggagtgattactttgggtacatctactttatcacgttttcaaagggcgcactagcacaactggtcaatgaggggaataaatcttaccaagtatggctgcgccttaggcgtcgccaaagctacgattagctagagttggaggttaaaccttatgtccgaattagctcagcaagatgcagatcgcaaaaggcggaattgcggtcgtgtcgtgctgacggagcatagcgactttaattaccaatcactacgattaacctggtcaccagaaaccattgcggccgctaactgagcactgcgtcaatttttaattggcttatcgtggctggctccccttcaaattgactgatctacccaatcggaatgtccgccagcacgcagtgagcgaaagtgggaaatttacaagtggacttccatcgaacaacggccaacaacgttaatcaacggtagtttggtcattgggaagtagatacggtgctttctagtcgaagtgagtcacgatcatgtctggttacattcgtagaacgtaagacccgacttctatgggccatcaagccctaatgaacggctaagctcaaacaccgctttggcaagtatgggggccttcggtccccaagtaaaaatcatatgttgatcatggtaaagagtttgccaattatcaggccttagaacggattatcagatcaaagtttatttttgccatccatatcacccatgggagcgaggttccaatgaatattttaatagacggttacgctgggttcccgaaaagaccaattttagccaagtaacgacctgatgaacgactgatgagatcctagcagcacttgaactaattaatcaacgaccattaaaaatacatcatcaacagactgccattgaaagattccgggcttgttcggattaaacttgtaatttgccgaggaaaatcaaaaaatagtggtattattattaatttcctaatcataatctaattttatgtgctataatactaactaaatcgctgtatgtgcagggattaacataatgtattttagtaaacttacatatagaggagtgttttatatggactacaaattttcgagtcgcgtacctaagactgataatgatcccgttggtgaaattttaaaggcagctgcaaaccccgcagtaacgtcatttgctggtggcttacctgcaccggaattattcccagttaaggaagttaaagctgctgctgataaagtcttagacgaaaagggtccagctgcattacaatatggctccgcacaaggtgtacctgaattacgcaatgttattttaaagcggttggaagttgaaggtattcataccactgcggaccacgttatgatcgccactggttcacaacaatcgattgatttaactggtaagatgttcctcgatgaaggcagtaccgttatcgttgaagacccaacttatttaactgccgttgacgttttccgttcatacggtgctaactttgttggcgttgatatggatgaagacggcatgaagatggattctttggaagaagctttgaagaacaatccagatgctcgtttgatctacaccgtacctactttccaaaacccaactggccgaacgatgaccttggaacgccgaaagaagttagttgaattagctgataaatatgacgttatggttcttgaagataacccatacggtgctattcgctgggaaggtgaaaacttaccttcattgaagtcactcgataagactggtcatgtgatttacatgggcaccatgtcgaagattttctcacctggtctgcggattggctgggtagtggcagaaccaaagctgcttaaaaagtacaccatgatgaagcagtctgctgatttgcatactgacagtttctcacaatatgtatgtgcacagtactttactgacaatgatatcaacgatcacatcaaagctatcagtgcactctatcataagcgtgaacaaatcatggttgacgcgattgataagtacttccctaagggtgtttcacacagtaatcctgaaggcggtatgttcttatgggttacagtaccaggcgttaagagttcacaaaagttatttgatgtcgcactgaaacgtaacgttgccgtggttcctggtgatccattctttggtaacgaaccagttcccggaacatttagaatgaactactccaacacacctgaagacggtatcgtggatggtgttaagaagttagctgaagcacttgacgaagtgatgtctgctgaaccagctactaagtaattaaaaatcgtttaaatgaattttgaatcccgttatgatttcaacaccttacagtgctgttaaatcataacgggattttgcgatataatgggattaaaacgaaactggggagatttaaatgaatttagacgaaaaatttgcttatatggcaactggtcaaccgtacgatgatctagatccgaaattaatgaaggtacgagaaacggcaacggcagttactcagaaattgaacgggacagtcgacccagataagcgaaatgaactattcacgcaattagttggacacgtgggcgaaacaccatttgtggaacctaatttcagatgtgaatttggccgtaacattagtgttggcaatcatttttacgccaactatgattgcgtgatgttggatggcgcgcccattaccattggctcacacgttctttttgggcctaaagtggggctttataccagtaatcatctgtttgatccggttgaacggcgaacgggtggctgtattgctaaatcaattaccattggcaatgatgtttggctagcagctaacgtcacggttttaccgggagttaccattggcagtaacgttattatcggtgccggcagcgttgtgactaaggatattcctgataacgtgattgcagtggggaatccttgtcgggtattacgacaaattactgaggcggatcgcaccggatttaatgggcaagacttttcagcgggtaaataactgactgataagtgttcttgattgccttagacctactataaggtcatataatatatttgataactggatagggaggaattcgaatgactacaattacagatacgtttgaattaaacaatggtttaaaaatgccaaaggttggtttcggtacttggcaaactaagccgggtaaggaaacttttgatgccgttagcaatgcactgaaagctggttaccggtttattgatactgccaaggcttaccaaaacgaaaagagtgttggtgaagctattgcggctagcgatgtagcgcgggaggacctgtttgttcagactaagttgcctggagaatcgaagtcttatgatcaggctatggctgactttgatagcagtttaaaggcgctggaccttgattacgttgactcttacatcattcacgcaccatggccatgggcacagatgggtaccaaccatgatgccgaaaatcgcgatgtttggcgtgcaatgcaggatatttacaacagcggtcgggcaaaatcggtgggtgtctcaaactttaatacccatgatttggaaaacctgttaaactgggacggcttgacggctacccctgcggtagatcagattcagtactacgttgggtacactcaagattctattgtaaagacagctaaggataacgggattgtcattcaggcttactcaccattagcaaccggtgatctggtaaatgatcctgatttaaagcggattgctgaatcctatcaggtctcggtaccacagttagctttgcgttttgtgattcaaaatgacattgcaccgctaccaaaagcacggtcaatggcacacgtgaaggccaatgcggagcttgattttaaaatcagtgataaggatatggcgttcttgaatcaggtcgccgcagtggatcatattcatccggtgggggattagaaatagagtgtgaacgcaagcgattagatagcggagtgtaaggggcccccagcataaatccatgggtttgggatttgtgctgggggccccttacatgcagctgtctgcttgcgtgaacacgttttggatatttaatttttgagctcaatcatggtaatcaaacaacgagcccataattacttaaaaaaaatcaaggattttgacgaaaaatgtcttaattaaatttaattttaagagtaaacgtggtagaatatgggtatccaaaacattagtgtgatgggtattcggtctcttgatgatattgagagtaccgagttatcgttatggtggcagggccttcctgtaggcgttaacggcttcatagtagcgtcgtaatcgtctgcaatgcctggtctttaaccatctgatgatagaaaaccactgtaattgagaaaacggatcgttaaaaatcctgcgggataaaataaacttctccctgtaaattttaataaactaagtgttatttcccccataatagataaccaattagttcccgtgtaaggatgatcggtgagtattaattacagcgttaaagagcttcgaacctccccagttcggagctttttgtatgcctcaacactcagatttctgcatttaacgcaaaatatgcctattccgacaaagtccgccggaataggcatattttaattctggaatctaccgagttttgatgcacactattttagtctaaaatttccgtcttaatgcgattttgaggaatatcgcgatccccatatgcatcttcagttgggccaacgaccaaacctgcaaccggtgtgaagcctttgtcgatcttcagggcttccttcacttcatcgttatctgcgaatgcaacaagtgcaccccaaatatggcaagcgcctaagtcgagctcaactgctgcaaggttcaggttttcaatgacagtagcagcgttggaatacgctgcgttatcactagcgtcaccctttagctgaactgaagcaatgatcagcattggcgcaccgtacagcattttttcacggccaaaacgtttggcagccgtatcgtcaattagtgataacagcttagggttctgaactaccgttaatactaggctatcatactgacccattgatactggtgaggcgtatgctgccttcaataattgctcctgctgcttctcagtaactggttcaccggtgtagcttcgtacagacttacgttccaataatgctttcatcgtatccaaatctgtcactccttttgcgttcagtttatcactaacaatgaaacgtttacaattttaacgtttcattgttttaacagttgtgtatcggagattaatcgttttctttcagccagttatccagcacttgaatgaattcatcatgttgatctagcagcgccaagtgacgactgttagcaaacaagtgccattttgcaccaggaatatgatcatagacggacttagcaatcagcggggtgcagagatcatccgttccgttggtcactagcacgggaacgtgaattttgtgcaggtcgtcggtaacgtcatagtcgctgatagtaccgttttcggtaaattcgttgggaccttctgcgattaaactagcacgtttgccgttagtttcgcgacgcaggggttctggtgaattttcgtctgggtcatcccagcagtagcgctccatgtaacggtcattggctgctagatacttaggaccagtgaagttacctgtacgttcagcttcagcgatggcttgacggtcttcgtagctaaggtatgaaattaaccggtgctgttcttgggtccagagtttgattgaagcaggggagccgtcgatcatgacactcttgacaccagtttggtcatattgagtgaggtaaagcatttccagcataccgccccaagactggcccagcatgtggatttgatccagatgcagatatttccgtagcgcaatcagttcttcagcccaagtttctttgacgtagacgctctcgtcttcaggcagagaagacttaccgcagccaacctgatcatacataattaattggcggccagtttcagcgtagtcgtccatgagttcaaaatagttgtgtgatgaaccaggaccaccatgaattaacagtagtggtgctagtccaggtgttccttcacccacgatacgatagtaagttttgtagcctcgaaatggcatgtagccttcttgaattttcattaatgatcaatccctttcagaatagacttcatagatgattgtactactgattggaagtggagattggctagttttttagattgtggggttgtttttagatagcttaaacgtgttcaaacaggcatacccctgccacgtaagccaaaaagaaaggcgaccagacaaagaacgtctgataacccttcttttcatcttacgctctggggcataagcacctattttcacactctattactttaataattcttccccattcttactaaaaatccgttgtttcatagcatctgacaatagacctgtcgtttccaactgatcggctaatgtcagtaccgctggagttggggtatacggtgtatctgaagcatacagcaactttgttgggtcaattaattccagtagggctggtaactgttgtggtaataccataccggctacatcaaagtactggttactcattacgcccatgatattaacttgatcgtcagttaagtcaggattcaaagatttagttaaatactgaacccggctggcaaccagtggtaatacggcacccgcatgaggaatgatgaagcggatgtttgggaaacgggtgaagatgccgttttgcagcatgtttaaaacggcccgagtggtatcgaagaaaaattccacgataggtgcaggaatctggttggtaactgttgggtcactgacacctggtgcgtttggatgcagggcaactaatgcatgattatcgtccaaagtctgcatgatgggatctaaccgtttgtcaccgagataaataccgcgcgagttcgttggtaaggtgaagccggtggcgtcatcggccaaggccgccttgattgctttttggctggcatctacgtaaggcaatggtaatgaagcgaaaaagccgattttatcctgatagttctggtgttgtttggcggcgtattcgttaacttcctgtgctaattcaatggtgcttgattcttcacctgtgttgatgtgaggtgaagaaattgaaatcacggagtaatcaatattgacctgattcatgattgaaagcgtggtgtcgattgagtattctggcgttttaacaccatcacccatatcgttgaactgatccttgagatactttttatagccgggtgataggtaatgagcgtgaaaatcaattttgtggtaagtcatttgtaagcctcctatagtaaaactgcttctagtgtcgttgcgaaaccctctggcttttgcgcatagcccaagtggccaccgggaatatcgtaaatgggtaggtgccagtagttagatagaaaagcgttgacgtcttgtggataagaaccaactgaatccgtaccattgagtaagtgaatacgatcactgtattgagcgagttgatcaatatccattttgcggctggtgtattgacggatctcatattggaaccagtacttcatcccagcaacagcgggatcgttattatcctttaatgaaacggctggtttagtcatcatcttagcatctaattcaccgattcgcatggctttgccaaatttcttcatggctgcgcccatatcttggtcaaaagccgttttgacgatttcgtcattgtcagcctgatcctgcttagcggttggtaaaaagctgttgattggtggttcatggaatgctgcacccttgatgatatcggggtaatcctgcaacgtttccatggcgacgattgaaccggaactagtgcccatgatataaatgggatcgttgggactgagctgtttagctaatgcagccacatcactggcatccgtttttaaccggtatgtgctatgaatatcagccgcctcttctggtagtggttcggttaacttgctgttgccatagccgcgacgatcataagtcactacggtaaacttgtgctgtaaaaatgcgactgcgccttggaagatattaccggttccgttagcgccgggaatcaagatgagaacggggccgttgcccttaacgttatagtctagagttgcacctgtttgatttaatattgtcattataaagacccctttgagtttgaaatcacttgctgaatcactcaatttaagttaaactcatgctatgagttttaaactgtatttgtattatagactcataccatgagttttgcaactgaggagtgaaaaaatgaaacgtggacaattatctcgagaaattatattggaaaagggcttaaaaattgccagtgaatctgggctaaacgggattacctataatggattagctcgtgagatcggtatccgacctcaatctatgtaccgttatttaagcgatattgctgccgtaaaaagcggtatcgtggcgttatacgtacagcagttagtagattatcttcagcaacagttaactgggttggcgggtaaacctgcactgcggcagttggccttatcctttattgattttacgcataccgggatgccttttacggatatggtatggggaatctctcactacagcgatgaacagccagttgcggatgtcatggcacagttacggcaactgactcagcgggcggttatggccgtaagtagtgatgagactaaaatcaatgaaaatactgcgttgttgttggaatttgttgttggtcatttagcattgataaccgctcggaaggatttggagcgcaataaagccattttccagcaaaacgttaaccgaatcatcgaccaattttaaggaggtaacggcttgaaaatggcaagttgcctatcgtaaaatagacctaattattttgtccaaaatataggtgaaggtatggtgaggttaatcatggcagactcaattgttcagttaacggtagctgatgcgggggagttgcaggcaatcagtcaggaaacgttcttggatacgtttggcgcgtataatactgatgacgatatggactggtacctcaacaacgaactaagtcttaaacggctgcagcaacaattgcaaaatgaaaattccttcttttattttttgaagtaggatgagcaagttgtgggttatttaaagttgaatataaacgatgcgcaatccgaggatcagggcggagacgcgttggaagttgaaagaatttacgtacgaccagactataaaagacaggggtatggccgtcagctaatggattacgccattaagcgggcgtaccaactggataagaaatttatttggctaggtgtgtgggaatataatcacgcggctcaaaaattctatgagaccatgggctttaagcaatttgccgaccatctatttatgctgggcggtgcgcggcagagggatgtgttgatgaaaagagaaagagtgtgaaggtaggcgcttagagactggagcgcaagctaagaaacacggtgatcaggtggtttgggcctggtcaccgtgtttcttggcttacgtgcaagtctctgcctatctgaacacgtttagactatgtaacaggaaccacgtgcaattcatccccaaatttttatcattttctcctcaaaactctccccatcaacagtaaaataaagaaagaatgttacatatataggagaaagaaaatgtctacacaaaagttaagcacccgcaacctgctttttatcgggatgatgttattcggtttatttttcggtgccggtaatctaatttttcccgttttcgttggccaacaagcggggacacactactggccagctttgattggttttttaatctctggtgttggcttgccattgttaggggtagcggcaattggaatcacaaaatcggatggcgtttttcaactatcgcagaaggtcaaccggttttatgcctatgcctttacagtgttgctgtatctctgtattgggccattatttgctttgccacgattggcatccatttcgtttgaagtggggctcagtccgtttgttgctcatgggcatcaaagtagcggcttgctgatatattcagtgttattcttcttggccgcctggtggtttgcacgcaaacctagcaaaatcatggtttacgttggtaaatttttaacgccagcctttttgattttactggcagctatattaattatggtggtcattaagcccatgggtagcggtcaaatgccagttggcgactatgtaaaagtaccgctggcagctggttttaccgcggggtattccaccatggacgccctggccgcgttagcttttggcattattgtagttaacgcgatttgtgacctaggtattactgagccaacgcagattgctggggataccattcgtgctggaagcatcgccgtggtgctgatggcggtaatctacggtttattaggattattgggtaggaatgctttaggtcatttcagtcgtgcagctaacggtggacctgttttggccaacgttgcccattattatttcggtgagtttgggaatgtattgttagcgctgttggtcatcttggcttgtctcaaaacggcaattggattgatcactgcgtttggcgatacttttagagaactctttcctcgaataccatacgcagtactgattattttcgctagtgcaacaccgctaatttttgccaatattggtctgaatcaattactgctgttttctacgccattactttatttcatctatccgttagccattacactgatattaatgagtctactgacaccaattttcggtgaatcacgctggctatttggtacggtaacggtttttaccctgattccagcgttgcttgacggtctaaatgcactgcctgctaacttacatcacgggtggatcgccaatctcttgtcggtggggcacctgctgccaggctttagtatgggccttggctggacgattccagcgcttgttgggctagtggttggctggtgtttgtcggtgacggctggtaaaagaagttaataatagacaaaaaagtcgtgccataattctatattgataaaagtttcatctgttttcttaactgaaaggcgacttaaagtttacttttgttcaatactctaatctagtctaaacgtgttcaaacaatcagagagttgcaaataaggcaccgccaacagaaatccaagttcgggatttccattggcggtgccttatttgcaactctctaaacgcttgttttcacactctgtttatagagaaaatctattttataaagcccaggcacccatgccttgtgctttgtaaagtgaaactgcagcattcacttgggcgttaacatcgccaccgttgatgtgcatgttttggaacagaccgtaagcaccacttgaactgttacggataccagcgttccagcctgattcacgagtgatgatggtgttccaagttgaagcagaaacgccagtccgtgaagccatttggttcaagacgtaactcttcatgttgctaccagtgtaacttgatgaactagcagtgttgttagtttgggtagcagctgtgttagctgaaccagtgtagttgctagtttggttctggctttgacgttggttgttagtgttgtaagttggtgttgcttggctagtagctgctggttgagcagcagttgtttgactagtcgttgagccatccggaatcgtcaacttttcaccggcaatgatcaagtggttgttgatgtggtttgcttgttcgattgagttaatcgtcgtatggaaggtttgtgagatgccccatactgagtcacctgacttaaccgtgtaagttgtcgatgcgctggcactagctgcacctgcgaagaacaatgcgacggctgctgcggaagttgctaagattgaagtaacaaattttttcaagtatatacactcctataatttaaacctgtgaggtccatcaatgtgtcgattcatatcaatcaacacgactgagtttacatggtgggtattaccttgacgtatcactgattttaagaaaacaagtcactgtgcaacaataaattgagcttttgtaatatttgaaataataaagaaatctttaagcagcgggtataaagacggtgaggtcatgtataggtgacgctttcaaaatcaaatattatgctgatggatgttaaatatattactgaaaaatgaattttagacatgtaaaaaggccaaaaagtgttccgatacatttctagaatactttaatgttaattactatatattgtggttatattttaaaattctttctaattgcacacaatatatggttgcagtcccttaagtaaccctatatcatgtatttatgacagaaaattggaacaagatattgaggtgattgggatgcaagaaccaaaagaattaaccatagaaacgttaacggttctcaaacgtgatggccgggccgttaagttcgatacgaagaagatcgaacgtgcaatcaagcgtgccgctatttcggttgaatcagagttaacagatgaagaccagcacgccattgatgacgtggtagaggctgttttgactgaaatcagcagtcgattcaaggaaaacgttaagatttacgaaattcaaagcattgttgaacatgaattaatggaacggcatcagcttgactgggcacaagcctacattaattaccgtgcccaaaaagatctgaagcgaaaccaagctactgacattaactttacgattcaaaaattgttacataaagatgaaacagtagttaatgaaaatgccaataaagatagtaatgtttttaacacgcagcgtgatttaactgctggtacagttgcgagaacgatgggattaaaaatgctgccaccgaaagttgctaatgcccatttaaagggtgacattcactggcatgatctggattaccagccatacagtccaatgaccaactgctgtttgattgatttcaaagaaatgttgaatcatggctttaagattggaaatgctgaagttgaaccgcctcactccattcagacggctactgcccagatgtcacagatcattgccaacgttgcttctagtcagtatgggggctgttcagccgaccgggttgacgaactgctggcaccatttgcactgaagaactatgacaaacacatggtagacgcaaagcagtggatcgaaggcgaagaccggcaacaagcctttgctaaacaaaaaaccattaaagatattgacgacgcaatgcaggcgctggaatacgagatcaatacactttattcttctcagggacagacaccctttaccacgcttggttttggcctaggaaccagctgggttgaacgggaaattcaaaaggctatcttgaatgttcgaattgccggtttaggtaaggaaaaacggactgccatcttccctaagctggtctttaccatcaagcgcggactgaatttaaagcccgaagatcctaactatgatgtcaaagaacttgctgtggaatgtgccactaagcggatgtatcccgacgttttaatgtacgataaaatcgttgaacttactggttcatttaaagcaccgatgggttgccgtagcttcttgcaaggttggaaagacgaaaacggcaaggaagtcaatgctgggcggatgaacttaggggttgttaccttgaatttgccccgaattgcgcttgaatcaaagggcgataaggacaaattctggtcaatcctaaaagaacgacttgatatttgtaaagatgcgctagtgtttaaagttaaccgtgctaagcaggccacaccgcaaaatgcaccgatcctttatgaatatggcgctttcggtaagcgacttaagccagaggattctgtagatgaattattcaagaaccgtcgtgctacggtttcactaggttacattggcctttacgaagttggcacggtattctatggtccaacttgggagcataatcctgaagctaagcagtttacagtcgatgtggttaagaaactttataatagctgcaaagattgggaagatcagtatggctatcactttagtgtttacgcaacacccgctgaaagtctgactaataccttctgccaagccgacattaaaaagtttggccgggttaaggatgttacggataaggaatactatacgaatagtttccactatgatgttcgtaaagcgccaaccccatttgagaagattgattttgaaaaggactacccgccatacagtgctggtggtttcatccactattgcgagtatccaaatttgaagcaaaatccaaaagctttggaagccgtttgggattacgcttacgatcgtatcggttacttagggactaacacaccgattgatcaatgcttcaagtgtgggttcaaaggtgaatttaaaccaaccgcccggggatttgaatgcccagagtgtggtaacactgatcctgctacttgtgacgtggttaagcggacttgcggctacttgggtaaccctaaccagcggcccatggttcatggccggcacgttgaaattgctagccgggtcaagcacatgactttgggtaacgatcaaaacgatattgcaagacagtagggtgattgaatggaaacgaatagagtgagattgccgaagaatccacagccgaaagaatggttggctgatgatttaagtgagcagcgcatcgctagctacaagccattcaactttgtggatggtgaaggtgtgcgctgtagtctgtatgtgagtggctgtaagtttagctgcccaggttgctataataaagttgctcagaactttcattttgggacaccttatacccaagaattggaagatcaaatcattgaagatttaggtcagtcgtatgttcagggcttgacgttattgggcggtgaaccatttttaaatacccaggtctgcaaccggctttgtcaccgggttcgcaaagaattcgggcatgataaggatatttggagttggactgggtacaaatgggacgaactcatgaaggagtctgatgataaaaaagaactgctgagtctgatcgatattctaatagatggtagatttttgcaggctaaaatggatttgacgctgcagtttcgtggcagtagcaaccaacggatcattaatgtgccagaatcgctgaagagtgggcaggttgtggtgtggagagcgtaaaacaactcgggttgattccagagtgtaacacaaaaaggcggggttccccgaacttgggaacttcgcctttttgtgttacacggccggaatcagagttgttgaacgcgttttctaccaaaagacaactcttttgacgatgttttctaggaaattagggtacacttaaatagacctactgattttagtgttttttcatgataaaatactattgaatcagggaacttatatgatatatcacccaattacacattccatatatcgtgttctcattaggcgatttaatgcaagcatatgggcccaaaaacagtttttggttttttcccagcccttctgggtgaagaagactgcttttttgtttggtataatagtagtcacaatatggcattttttatgggtcagagacaagtttgaactatttgaaagacacactgatacaaagcttgcgagcaatctttgttgccccgtttactgatgtatctgaaccagtaaataggcccgattcaaagtgcctaagatcaatgccgaaaaggcattgatctggttagtgttatcaaatcggctaatatcgcctatttcaagcgattatcctgatagctgaatttttcagcaattcctggtattgagcaggatatttgaaagccggaaatgtactattgactaccgatttcaatcatatttttgatgagctgtgctttatatccattacagttaaatttgtggccaactgaatcagatattttgaattaggccatcacttataacgtgggaacggcttttacggcgtaagaattgagtattcttggcatacttaccccgttttggttctaggattgttgtgtagaagatggaacttttcatttttcattactgttttagaactggaacgtaagaacccttctgcgtgcgggaaaataataaacagctcaaaaacaatgactggtccttagataccgggaagcctttgacggaaacgtctgtttttgaatcttatcaaaacgatttttaagatgacaatttgcgattctcattttcataccatcgatctaattgatagagctttctcataggcttcatccgtacataggatggctggaagctatcactgatagcgatgcagccatttgattgcatcggacacgatcggtcttattttgtcgcaaacccgttacttaactgcggcaccagtggattgatgcattcgaagctaaatgtattcatttagaaaacgaaccaatttattcgagtagataccggttgcctcgaaaaaatctgaaacgggcttcaattgtttacttaagatacgaaaacagctttttaaagccttgctgcattacttccacttgatcagtactcataactctgcatccgtgttaaaattgcgatgtcgagtttataagcactgacactcgatgcctaccaccaacactttattagtcataaaaacctccatataattatagatacacatctgattgtttaattttctaaactcgacttttttagccaatatacttagaaaaaaactttcagatctcatttttagggactgggacggcccttttcagctaagacagtatttgcctaacgtgctcgcgaccttttgtcccatccttaatgtatcaaaaaaggagccaaaataccgtcgtattttgactctcttatcttagtatatttcggctatgtagcaggagggcaagctgccccgaacttgggaacgtgccttattcttgttatacggccggggtcagtgttgtagagcgcgtttcggctatgtagcaggggcgacaggtttcccgaacttgactacccagacgttccactaaccactcaaatgatattattttcgcgaaaaaactttatgttgtcctcaaaagtgtagtattctaaaacaggattaaactcgggaggaattaaatttgagtaaatatcggttacaagcaattgtgtttgtgctagtggcttttatgcttggctgtaatgaattcatggttgtggggattttgtcagacattgccagtcatctacacgtttcgattgcatcagtcggatatctcgttaccgtttttgccacggtttatgcgattagtacgccatttattactattttaacgagtaaatacagtcggtataagacgctattggttttaatggggatctttttgattgggaatacgctgagtggctttgctacgaactactggtccatgttggtatcgcgggtcatcgcggcttctgttgcgggctcaattatttcattgatcatgacgttcaccaccactgttgcgccacaagaaaaacgggcaaacctggtttcctgggtgttcgctggtttcagcattgcgtcagtcattggggtgccaatcgggacaacaatcagtacgaactacagttggcggtacgctttttttgcggtctcggttgttaccgtgattacgttcttcttattagtatggctactacccaaacacgttaaacaagttcaaggatcagtcatggatcaattaagtttattaaaggatccacgcatttacaccggcatcttactggttttgttcactgctgcaacgatgtatggttactacacttatatccgaccgttactcaccactgcgttagggttcagtaatgctagcttaaatattttgctgtttattcttggtatcatgagtattgtaagtaatcgatggtcaggtcgaatcgctgaaaagagcggtttaagtgggatgcctaaatactacgttgctgatattatttttctggtgctgctacctttagcgctggtaactaagatttctggattcgcagtgttgctcattttgacgttgattgtgacactgatcaattcgcccattcaagttcattttctaaacacagctgaacgggaatacccgcaatcactggtattagcgtcttcgctcaattcaattttctttaattttggcatttcactaggatcagccacttcgtcggttttagttggtgcgattggactgaagaatattagcttagcctctgcagcatacgccgttatttcattggtactaattattgtactgaatcggacaattaaagctaacaagcaggctggacaagttcgtcagccagaataggcattttctgtgttagattctggaatctatcgagttacatcatattttccaaaacgtgcttaaacaagcagagagttgcaaataaggcacaggcaacagaaatccaaaaccaggatttccgttgcctgtgccttatttgcaactctctaaacgcttgttcgcacactcttaattttatgagattccatcaagattactaggttcttctaggtaaggaacatagaatgcttgcgaagatttcttattagtagcggtaattgtataggttaatttaggtttatactgctttaacgataatttgaaaactgcttgtgtgccgctacctgtattttgactctgaagctgcttcttaccgctgaagagtcgcacggtacgatgagggcctaacgtatgaatggttacggtggcatccgacttagttcgaacttctccgaaattgacaatatcggttgtggcatacgcagaactggatagtttcttgatctgagtgacacgctgatgcttactggtagtgccatatagttcgaaggttttgtaaccagagaatctgtagtttaagttgtaagtgcttttctttaatttgtaataactcgagtgatgatcgtatttaaccgccagcaacttggctgactttggtgctttgactttaacgttcaacttagaagacgagtacgtgactttctgagtacttaggctaggcaaggactttgcagaagccgatgtcgttgtggcaaaggcccctccaagcagggtcagaaacaggccggaaacaaataaaaattttcgcatgaaatctccttactataacgattaaaatagcagacaatgatgatagtatcataattacgatacatcgtaaaggtgattttatatacttttggcatataataagtagagccattatgacaggttagacttaaaaatgcaaggatttacttcgcaaataattgcttgggaaaatgaccgagattgttgcggtgattaatcagtttaccattgtcattaaaaattctataattgagtaaatgacttgcggaggggggtgcagtaatggggatgatagcagcaacattcctactaagctttttaacgatagggtttattggatccttgcagcagttaatgcatatactagatcatgatatcgaaggtaagaacccttccccgtggcgaactgagctagtttacacgctttattttgcagcggtaacgaccttcgtattcgtgatgtccatgcatgcggcatccacggatcaactcttgtggatcaacggtgcgctggtactgatgatgagctatacggatgccgtcaagacacggttgaatattattttaccgctgatgcttaccgtggggctgtttttcctcattacgcaaaccttcagttattggcttattttgacattaacgattgggatactcttattgttaatagaacgtcagtggtttttcccgtttgataaacatccgctagttatcctcagtgtcaaagccgttgttggggcaatctcatgggcaggactaaaagcagcgctcaatttaaaaacgcagcagtcaatcatgatgtacgttgtttatctgttggtaaccgcactcgtttattggtttatggtcttgcttcggcgtgaacacattactaatattgatacggctcgtagcctgctttatgataatttaacaaacgctcatagctggttgagctttaaacgggatgccgatgattattttgataattatcatgaactcagtatgattgcgatggatattgataactttaaacagattaatgacacttatggtcacttggttggcaatacggtgctggttcagtttactaagcgattaagggaaatcttagcgcaacaaacaagcggcgcaaaactctatcgaaccggtggcgaggagtttaccattctctatccgggtgtgactagagaagctgtcaaacaaaccgctgaaaagctccaaaaggctgttcgtcatttgttgattgagaccgagactggtgagcaaattcgggtgacagtgtcaatgggtgttgattgccgacgtggatctgataagaaagcaatcgaaattttcaatcgtgcggatcgttgtttatacatctccaaacgaaatggtaaaaatcaaatttcgattggtgaagatgggtaagctttggtacaataaaaggcgaagtcaaagttcgtttaacctttttaatccataacgaaggagtaattggtatggctgatttagatccgaaaaaattcaaacacattttagttggtgttgatgactctccagacgcccaattagcctttcggtacgcaatgaaccgtgccaaagaggatgatgctgagatgacgatcacgtcaatcctggaatctgacgatatgaacgtgtatcaggcgttgaataaggattttgtgcatggtaaacgtgatgagttggaacaacacgttttaggttatcgggatctggcaatgcgatttggcattaagaaggtcaacgtcattattggcgaaggcaatcccggtgaaacgattgttaaacaaattattcccgaagttaagcctgatttattgattattggttcattatcaaaaaagggcattcggaaacgtttcgggtctcaagcagcttacatggccaaatacgcaccaatctctgtgttggtgattcgttaatttaaattcgttcaagaatccgtactactgaagttgaagtagtacggattttttgggttaggaaaaaataaattgattttgaggtaggtcgtttgtggaagttactattttaaaaatcttgatagcaaaatcaaacaatcactaaaattaatatcataaattgacaaattttggtcagtaaaagccaattaagatcactgcaaattcatatattcgatttgactaatgaataaatattgcatagtatgaaattgaatagtaaactactatagattacagatggcttatcagaggacggtgtgtttgatgacaaagagattcgtgtcattaccagtagttgaatcgagcatctatatatttggcgggcatcagcgaactgtaccaggtggctggagcttctttgaacagaaacaccaggtttttgagcttatgtgtattgttgaaggacggcaaacaactgagattaagggtgtttctgcttatacgtatggaccaggagatgtcatgatcatttcacctggcacgctgcatactaactggaatactagcaaaactgaagaaatgacctacattacctttcactttaatattgaaagtctggaattgaagtcagaaattattagtaccttagctaataaagtgttgaaagcggatacagaagtagctcagttagccatgaagacagctcagcaaatgattcaagacagtcaaaagtcggatcttagttcagaaaaattaaaaattaaagttcaaattgagctgctgaaatttctatacggtcttatgatgtacaacgaacacgcgaaagggtctaattctaaatactcggaacgcgaagctcaaactgcacgtgagattgcaacgagaatcgaagataaaattgagcaggatgaagtcagccatttttcctttggcgatgtctgtcaagaactggggattagccagggacacggtcatcgagttttcaagaaagtgtatggcgttacgccgttacattttgccgatgaacagaagtaccgaaaagcaaaactactattgggttcaccggaaaactctattgaagaagtcgcatacataatgggtgccagcagtatgtctaacttcagtaaacagttcaagaagtggtctgggattacgccaagtaagtatcaacgacaaatgattggtaaacggtcagttaagaacgttaaagaaggcggctattttgaatagaatatcattattaatgaatattaagtcattattgcattcaatagtctcagccggaaaagatattgatttggcatgtgaatatcataatttaactaaaaataggcataaacgaagatagattgaccagttggaagcgattacaattatctcataacaagctagcttgtcgcttaaaaagttagttgcgttaattaagttaaatgcagccatcgttgtaggttactgagagaacttaacgtttatttggttgttttaattaaccaactaataaagcatgatacttttgattggaggaaacaattatggcatctgtgcctgaacaagacgccgttgaacaaaacgacgaatttgccaagttatcttggcgtgaacgtataagttatggggctggtgacctcgcacaaaacctgatttttgggaccattggttctatgctcttattttatctgactaccgtttatgggatttccgcagctgctggtgcaacgattttcttagttgtccggtggatcaacgttttctgggatccgtgggttggcgcgtacgttgatcgacataaatttaaccctaaagttggtaagtaccgtcctttcttgattaaatacgggattccactgaccattttgtcagcaatgctgtttttgccaattccagctgttcgtggcaacattttgtatgccttcttagcttacatggcaactgcaatggtttattcaatggtcaacatcccttatggtgctttgaacgcatcattaacgcgtgataacgatgaagtttcaacgttgacgactgttcggatgactgaagctaacattggtaacttgttggtttataccttcttaccactctttgttcaattagcttcaccagacaagcaattgaaagacattggtttctttggtatcaagttacatcttggtaactatgcttctccaaaagccggtggcgcctacttccttgtcatggccatttacatggtgattggtttcgcaatgttggtattcacctactctggtgttaaagaaagaattttaccaactaaggaagaatcagcttcagttaaatacagcgatttattcggtgaaattaaacgtaacaaaccactgcaaatcttaggcctcttcttcttgattggtttcacattcatgttctttggtaacactgtatggccattctacatgcaatataatgttggtcacccagaatggatggcttcaatcaacttgattggttcgattccaggtattttcttagtcttcttatggccaatcgttcgtcgtaagattggtaaaaaagggttcttctacttgttccttagcctgttcatcgtaggttcattagtactttgggcatggtcattaccaggctttaaagatcaaacgatgcttggctacattggtcgtttcttgcaacaatggggcttaactgccgctactggttacatgtggtccatggtgccagaagttgtttcatatggtgaatacaagtctaagaagcgtgttgctggtatcattaacgccatcatgggtctcttcttcaagattggcctagcacttggtgggattattccaggttacatcaacgccttcttcaagtttgatggttctgctgcacatcaatcagcctcagcaatgatggggattcagtggtcaatgatctggattccaatcgtcttagcagttgtcgcaatgctgatcatgagccgttacccattgagtgacaagcgaatcgctgaaatcaacgttgagcttgaagctgaacggaaagcaaagcgcgtttaatttagctttgacattaaattttcgacttcaataagcacactattattttgtttgaaaggaagattctcatgaagattcagaacccagttttacatggttttaacgctgacccaagtatggtccgtgttggggatacctactatattgccaactccaccttcgaatggttcccaggcgttcgtctacacgcatccaaggacctagttcactggaacctcttaccatcaccactatcaaccacaacgctgcttgatatgaagggtaacccaagttcaggtgggatctgggcaccagatttgacttatgcggatggaaaattctggttggtctacaccgacgttaagattaccgagggtgcattcaaggatatgactaactacctgacaactgccaccgatattcgcggaccatggtcggatccaatccgtgtcaatggtgtcggctttgatgcctcattgttccacgatgatgatggtcgtaagtacctggttcaacaaacttgggatcaccgtgaataccaccacccatttaacgggattaccttaactgaatttgacactgataccatgaagttgaagccacaaacggctagaacactttatactgggactaaggttaaattagttgaaggtccacatctatacaagatcaacggctactactacctgtttgcagcccaaggtgggacagtttacactcaccaagaagtcgttgctcgttcaaagactttggacgctttgtcattcgagtcagaaccagacggcccattcctgactaactttgatacccctgatttaggcattcaaaaacaagggcatggtgcgcttgttaacacaccaagtggtgacgaatggtactacgcttcactttgcggccgtccatggaaccatgaaaacgaatcagcttatgatcctcgcggctggtgcacattaggtcgtgaaacttccattcaaaaagtggaatgggacgatgaaggctggccacgggttgtcggcggtcacggtggtcaaatggaagttgatgcccctaaggatgccattttaacagaagcacctaaagacggttctcaacacgatgaatttgatacaccaaagctcaacgatgaatggaatacgttacgaacaccattcactgctgaaaagggttcatttggcgatggtcacttgaccttgattggtaaaaactctctggcaagtaccttcgatgtttcaatgattgcgcgtcgttggcaagcctttaactttgatgctgaaaccaaagttaagtttgatccattcacgtatcagcagatggctggtttaaccaacttctataacgaaaagcactggtcatttgtcttcattacttgggacgaaaagaagggccacgtcattgaagtcggtgaaaacaacaacggtgattacacgtcataccttaaagatgatgccattgcgattccagaaggaacggaatacgtttggtttaaggttaaagcacgtaagcagtcttacagttacgaatactcatttgatggtcaaacttggcatgagattccggttactcttgatgccgccatcttatcagatgattacgttctgcagaattacggtggtttcttcactggcgcctttgtaggtttagcagcagttgactatgctggttatgaccaacccgcaacctttgattacttcgactataaagaattagattaatgattagataaactttgattcacaatcaacttcacattgatagcataacaaaatagctgatccatcagtttctgtctgatggaccagctatttttatgggtaactatgattgttgccccttagtcttccaatactttgtaacgtaataattctgccggctcacgtaatcaatgaccatgacatcggccttatcgattaacgttggcgcaccaaaggagacggattcaaagtccacgagctgtaaaccaatctggtgttcactgatcatcgaaactcgtccagcgtagacttcaggaccggtaactaaactgattaagcgctgttccccctggcattcagctaataaacgatcaactgattcccagttatttgggagttgttttgctagatgaaaggggtcgaagatgttggctgcttggttttctttgaccattgattgacaaaagtccaaataagatgaatcagtcacaatcttagaaacgtgcgaacggtcaataatttcaacactatcgacttgaccgttatcatcgatggaaacaatcagcagctgatggggtgtttctgcgatggcggtgccaacgataaacgactcgtcatcgtcctctagataaagttcaaatagattattcatcatcttccatttcgcctcgttccttggcttcttgattgagcttttgggccttgccaaagtcttcggtgacgatatagctacgaattccccaccaataaaagccgagtgatgcaatgataatgataataaagtctaatggatatggaatccagttttgtccgttaaattgatggctgccgatataggacatgatagaaatgaaaatcaggtagccaatcatccaaccactggctttaaaggcctgtcgggttgaaacgaagtggttccgccattcatagtagaagtaaaaggggagacccaataaaatgattaagataacttgaatcgtggtgggccacattgcccagtaggtagctaacgaggccaacacaaaggaaatgggagcaatccatggtagccgttttaggcgaattggacgatagagatccggtcccatttttcgtagtgaaacagcagtgacgggtcccgttaagtaggctatcaaagttgcggttgataacaccgttgctagtaccgcccaagaccgaaagacggtaaccatgaccatacttagaacggtattcaccatcatggcgtaacggggaataccgtactttaagttgattttacccagaaaatggggaacgtggcgattaccttccatggcaaatagtgctcgtgccgtgtttgcaacgaaggagacaccggtaccaaatggtgaaacgaaggcatccatgtacagtaaaacggaaagccagtggatacctaataaaatggccatgtcagcaaatggtgaattaaagacgataccgtgccagccagttgcggcaatcattttcggtggaatcgcggtaataaaggtactttgcagaatgacgtacaagacaccactgatcagtaaagagatggtaatcccacgaccgatatttttcttaggatgttcaatttcgccacccatgttaatgaccgtttgaaaggcatcgaatgagaagataatccccgcggctgaagtggcggtaaagatcggtgcggaaccatagggcataaactcatgtagattactgccgtagttaccggggtggaaaccagacatggttagcatgatgatggttagtagtggaattccaattttaaatactgagatcaaactggtgaagtgggtcaaaatggtaacagaccagaagtttagggccgtaaacacgatgatgaagccgaaaaccacaaatagcccgctgttagtaatgacaccgttgctaagaaagtggtgagtccagcgtgcccacgcccatggccaggtactcatgtattggaccgcggccacagcttcaataggaatcagggtgattagtgagacccagttggcccatgccgcaatgaagcccagcattgaaccatgagagtattgagcgtatttactcataccacctgattctgggaacatggccccaatttcgacatagtcataagcgattgaaccaatgactaagcccccaatgatccacgaaaaaatggcagctggaccggcaattttggtagcttcccacgaaccaaacagccagccggaaccaattaaggagcctaatgccagcatgaccagttggaagaggtttatttttttgaattttggcgcttccatatagagtcaccctcgttttatattttatatgttattagtatgtatgaaagaagggccgaattgaaagactgccaattcgacccttccagctagtgttttgaatcacgcttattcttcttgatcctggttcatctttgtacggaaaggactttcaattttttgtcctggttcgttagctaaattagtgcggacgaccaagacatcacaagttgcattacgagtcacaaagtcggtaacggaaccgttcatgacgcgttccaacgcgcccataccggtggcccccatcatgatcaaatcattttgatgatctttgatgaaatcgaacgcgatgaccgttttaggattaccaaaacggatgtgggtgctgatatcggtcaaatcgtacttttctttaatctgactagttaattcagccaagtattccgttgcgtcttcaacgagtgaattaacaattgcaccattggacagaccgccatagtagttagactggtgggtatcgatgatactcagtaaatcgagatgtgatttatttcgagtcgcaacaccaatagcttttgcgagggctaactcagcaaatttcgaagtatctaatggtacaacgattgaattgtattttaacatgtctcttaactcccctatatcaagcaggttggacttggaattagatgaatcaggtttaattgggtgacctatacccgacctaaaacgacttgagttgcttccgccaatacgtggcccttcattgcgtcatgcaactggttaagccagaagccatccttcaagggcaacttagcgtccaacgcataaaccgtcactgtatagcgatgatctttatctggtggtagcgggccgctataatgctggctggtttgtggattttgattattgaccaagtgtccagcagtggaattattgccaaaagtcataggcacttcaccagattgactggcattttcaggaatcgttgttaagtcacctggcaggttagcggctacccagtgaatccacgtgaatcccccaacgggaatggcatcgtgatcaaccatggtaacggcgtaagttgcagttcctgcaggtgcgtccttaatttcaattggaaatgagcgaacggggccatcatcgatgcgatactccgcgggtgcgtacttaccgtaaatatcgggtaagtaaccgtttgtaactggcactttgatttccataaaatcacgctcctttgtcgaacttgtttctattataacgcaatttaactgcagcgcgacaactactgttcagtgggggttatcaagctggaataatcgtacttagtcagggttgccgttgcattcagtattcgtagcggagtatgctgtctttaaacaacgttaaggtggaggccgaagtggaaaatactgataaaatagcaattttacaaaaactgattcaaattaagtcagtcaacggcaatgaagctgctgtcgcgcaatatattgcgtcgttatttgaatcgtatcagcagtcagccaaagttgaatttgtgacttattcgcctggccgtgacaatttggtggtgacgattggcgctcccgatggcaaacaattgggtttatccggtcacgaagatgtggttgaccctggcgaattgagcgattggcatcatgatccgttcgcgggagaaatcgtggatggtaatttgtatggccgtggcgcttccgatatgaaaagtggcttggcagccgttgtgatcgccatgttagagttattagaggaggacataccgttaaaggggtccattcgactgctggcaacggttggcgaagaaaccggtgaatacggtgcagcacagttgactaaggctggttatgcggataatttagctggtttggtgattgctgaacccacaggattagataggattgcgtatacggcgcgtggtgtgattgattatcacgttgattcaatcggtaaatcggtgcatagtgcgcagtcttctaaggggattaatgccattgataatttaatcgtgttctacaacgaagttaccaaaatcatgcaaacgttggataagatggaccccgttttgggtggtttattgcacaacgttgatttaatttccggtggcgaacagatcaatacgattcctggtaaagcccggctatcagccaacgtccgtaccattcccgcttatcctaatcagatgatatatgatatactggaaaaacttgtgcatcgtctaaacgacaggccaggttttcagttaaagctctcatacagttatccggaagaagccgttccggggcgtccggatacaccactggtaaaattagcacaaaaaattggtcaccgggtaattggcaaccgtgttattccggtgggagctggcggtgctagcgatgcctcagaatttcttcaggctaagagtcggttctcggctatcgtgtacggacctggaacgaatacgtctcatgaagcggatgaatacgttgaggttgaacaatttttacaggcgactgagctgtatcgaaagttggctttggcgtttttggagtgaggtatattgtctaattgggttacagaaagctcgttaaacgctttcctttgcaccttgtttaattgggctacagaaagcagagagctgcatgtaagagacagccagctaaaatccaagttcgggatttttgccgcccgtcccttacactccgctctctaaccgctttcttccacaccttatataaaaggagtctctcatgcaaatttcaaaaggacgcgccaacctgatgctactcatggcagctatgatctggggcgccggttacattttttctaagatggcgactaacgccaacatgcaagctggcttgatcaacgccattcgtggttttatttacgctgggatagcctttctttttttccacaaggcaattctgaaaatgaccaaagttgatctgcgactcggattggttgccggttttatcaactttttgggttatcagtttcaaacatgggggttacggtttaccacaccttcaaataatgcgtttttaacggcggtttacgtggttattgttcccattattatttggttgatgtataagcgtcgccctgaacgtaagagttatcttgccattattattgcgattatcggtatgggttttctaaccaatattttggccaatggattcacgcttcatattggtgatctgctaacccttatttcggcctttttctacgcacttcaaatcgtttactttgggatgcgggcgactaataccagtccttttgtgctgtcatttatgatgggaattacacagggcggtttcggcttgatttggacgctgctgtttgagcatgccagctacggtgccattaattggcaggctggtttgtggccagtaatcgtactgggaattgtctcctcctttggcgctcaaacgcttcaaatcgttggtcagcggtttacggatccgacacctgctggtttgatcttaatgactgaatccatgtttggcagtattttctcggtggttttaggcttcgaaccattcaccgttcacttactgttgggtggcattttaatcatcattgccattttaatcatgcaactggacttttcgcggtttcaatcagttaaatagatggcaatcaaaaacagcgttcgcaagacaccatctggtgttttgtgaacgctgcttttgatcaagttcgactgaataaagcacgactcattacttcacaaagcgaagcacgtagttaccctgtgcatctgaagtaatcgtataggtagaatatccatccttcagccattgcgatttcgtggcttgggcccaactcttcgcgtccgagacggaagagaaggtatgagactgactgaatgtgatggatcctgagttgttactactgttgtcggttttcttggaagatgacccagctgagttagaagtagtattggcggagctagacgattgctgagtactggacttggcctttgtaccgtctagctttctttgttcgctgttcttaattgttgcatctgattcctgattaatcgaactttgcaaagagcttcgttgagatgaagtgatccctttatcatcatacactgaaccgtttgagcggtcatcggtagaattgtttgggtctgaagtagacgcatcattttgtgatgtgtcatcagacccggtattactggaactattatctttaacagattgttcggtgttttgagcaccattttcgactgtagtcgagcggttagcaagccaaacgccaacacctacgatcagcactagtgtgactagaaagctgatgataatttgtcggaaatgcgatggccgtttcggtggcttacgcttattggctgactgattatcggtgttgaaattatagcgttgcatacgcgattgcggttcttgattattcacgtaaaatacctccaatatcaagaacgagcgagcaagccattaaaatactactagtgctagtttaactcatttaggcctaaagtttactattttttactcattttgtaaaatttgacgcgtaaaaagtaggccaatcttggtcacaatcccatcaggttataggttccacttaggttgtgaatttgagaagttttaggttggtaaattaagcaggcagtttatggtaaaataaaagctgatgttgtttagggaaaaggggcgattacatgacggcgaccatcaaggatgtggcggaggaagcaggggtttccaccgcaacggtttcccgggtactggccaacaaagaaggcttttattcggaacgcactgcacaacgggtgcgtaaagttgcaacgtcattaggttatgaaaaaaatatcagtgccgttgaactagtcactcaaaaaagtcaggttattggggtgattatttcttccattaagactaatttttctaataaaattattgagggtattcaggatgaagctcttaaacatggtcttagtgtgatcatgctttatgctggtcaaaacgatcctcagttacaggagcgggcacttaagaccttgattgaacggtccgtgaagggcatcttagtggtggctattcaattaacagatcaaaatttgaccctattgcaaagttcacagattccgtatcggttcctgtcgacttcgtataatagtgatcaattaccgtccattgcttctgatgattatcaaattggttatcaggctacgcaacaccttatccaaaagggtcatcgaaaaattggactagtggctatggatgttagcgagtatattggtcagcagcgagtagctggctataaagatgccatgcgacagtcggcgttgccagttaaagatgaatgggtcaaaactggaatgtacacgtatgatgatggctccaatgctatgaaggcttttggtcagcaaccagaggtgacagcaattatcggcgctagtgatttagcgtcgattggggtcctcaatcaagccgtgcagtttaacattaaagtacccgagcagttggccatcgtgagcattgatgggacttatttagctgagatcgttcgaccgcaattgactacggtgacgcaggctttttatgaaatgggtaccttgggtatgcaaacattgttagatcaaacgcagcctgtaaggtcgcggtttacacccattaagattgagatacgacaaagtacataattttgaaaggtggtttttattgtgcataatgatattcctcagattccgttagcaaacaatcatacgattccgcagttaggcttgggtgttttccaagttgataacgaaagtgatattaaaaattccgtgaagtgggcgttggaagcaggctatcggcacatcgatacggctgcgtattacggtaacgaacagtgggtcggtgaagcgattcgtgaaagtggcgtagaccgtaaagacctctttattacgtcaaaactctggaacaacgtccgcggttatgacgaaactaagcacgcctttcaagaaagtctgactaaattaggcctggattatttggatctttacttgattcactggccagcatctggttacgtcgatagctggaaagccatggaagacctttaccgcgatggtaagatcaagaatattggtgtttctaactttgaacaaaatcagttggaagacttgatgagccagactgaaatcaaaccggtggttgaccagattgaaacccacccatacttccagcaaacagaaatgcatgcttaccttgagtcccaaggtattcagcatgaggcgtggagcccacttggtggcggcaagaataacgcggttaatgacccgttatttgtaaagttggcaaaagctcacaacgttaccccagcccaagtcattctacgttggcacgttcagcgtgaagaaatcgtcattcctaagtcaattcacgaagaccgggtcaaggccaatcgcgatatctttgcctttggtcttgatgaagctgaaatggcagagattgctaagctggatcaggggaagcgagttggtcctgatcctcaaaatactgaatggttaaaaaagtcacaggagtatggtgcgcgaaaataagagtgcataacaaaactcgatggatttcagaatttaacgtgaataaagctcatttcggcgtactttgtcgaaatgagctttatttgcttacccaagctagcttcgttagaatgatggtatggttttgaacgacgaagataactaagcagaggagggattttttgacacatcgagcaaaatggatgacgatttctgttgtgatttacgtgatttttgtcgtctgcgcagtcgcgtttaagttacttgatccggcgaaaattggactgccatggaccgttttttggtatgttgctgccgctgggttgatgtactatttttacttcaaaaatatggcctaccaagaagtcatttattacgctcggcaatttcatttgaaaaaagtggacttagaagctatggtgccagaccgtaagaacacggctgaagtgcctgatccggatcatcccaacatattgatcccacttattcaagtgccgctgagtgtgacgaatcgactgacagatgtgctggaacagcgggcaaaaacagaaaacgtgaagccgtttaaatagtgactgagtgttgcggtaccttaatctgctctataactcagcttccggttatttaaatgcaattttaatacaaataaagtgccccataactgttagacaaatctaacaattatggggcactttatcatttcgctcattatttggagagcttagaatacctaaccaagactaccttgattagcaatgtacagttaatcgttcttccgacgccgagttttgtctaatcctaagaagccaaggaagcttaatccaagcagtgaaagccaacttgcagattgctcatttgtctgcggtaattgcttagctgcttgtgacgaaggcttggacttattgccgttaatttgcgaattcattgcttgagtagcagaagttgcttcaccagagttggctgagaatcgtgttgaggtcggcgcagttgtcggattattaaccgcgtttcgagctcgtatagatgaattctcagttcctgaagcctttggcgtttgtgaataaccagttgaaacaggaacttgggtcttagcagccggtgctggaactaccggcgtattatccgctgtgactggtgtttccggtgtttgtgtatcgttatcagttgtagttggtacgtttggtgtattaggtgtgtcattgcctggtacggtgactggctgataagtgagtggtgtgttactcaatggattcgtcggaactggaggtaagtagcctttggtcacgtcattgggattgattggctttaatggtgtgccatctggtccgtatggttgataacctggttcgtaaggaatcactggtgtcgtcgtttgatttgcatgatgcggatcgtttggatatggaatatcaggaatattggttaggttagtgatgtagctgcctaactgactgtacgttatggtcttgacgatatcagctgttgttggggtcacattaccaatctctggtacttcagcaacgtctgctaaatagccgttaatgactggtgaagatttggcattaaaaccggtcttgtagtctttagcactccagtctgtgtaggtaataccacgggttacaaggtcaacggtgccgtcacgcgtataggttacggcgtccgttacggtaggagccgcggtgctatcatctttagcgtaaacatagttaaccgtttcgtgaaccactttttccaaattatctttggtagcaccatctggccactttggcccatttggattattactaaagatcgggttattcggattatccggatgatttggtgtaaaggttgcagtttggtgtttcaggtgaaccgtgtaactcggtgttgcgccaggctgattaccaaaagtgattacgccatttgctggtaaatcatcactgatcacggtgtagcctttggcggttagaccaccttcaatcgcttctttgacagcagtgtagttattcgcacctgcagtaacaccagtaacggtatcttgatgaatcgttgcaccgttggcatcatcgtctacgtaagtaacggtcgttttctgagaatctggcgtataggtgatggttaattttgagtcaccagttgttggggtaacgtcataagcggctgttgttgctagctttggcgtgtacccagctttaccggctggactcgtaacggctgcgaaacttgccgttggcgtggtgcttacccagccatcatctgcactgagagtgacactagttggttcagcttcgtaagcagccactttatctggtgttaagtaacctagaagtttaccggtgacttgatctactacagcagttcgctggaaatcaacactagcttcataatcaggagcaactttcccaccattactgtatacgtattgaatcgtctgggtaacagttcgattcaggtcgtttttatttataccagcaggccaagttaagttagtatttggcactttattgcccggaacttgtggctgatctggtgtgacaacctttgcctgatgtttcaggtgaacagtgtaattttgtggtgttgtatcatcgtggtcaaacgtgatcatatcgttagctggcagatcagtatcgacgacttgataacctaatgctgtcaagccaccttcaacggcttgctgaactttggtgtaattttgcgagccatcagaaacacctgataaattatcttggtgaatggttgtaccgttatcgtcgtcatcaacgtaggttacggtagcttgctggtcatcgggggtataggtaaccgtcagcttaatgctgccagttgatggtgtaacggtgtaagcctgagttacagcttgatctgcagtataacctgatttaccggctggactcgtaacggctgcgaaacttgctgttggcgtggtgcttgcccagccatcatctgcactgagagtgacgttagttgaatcagcttcgtaagcagtcactttatctggtgttaagtaacccaggagcttacctgtggcctgatccacgacagcagcccgttggaagttgaccgtagatgcatgatcagctgcaacttttccaccattgctgtaaacgtattgaatggtttgcgtcacagttcggttgagatcattgtgattaacaccagtaggccaagttagattagtatttggcactttattgcctggcacttgtggctgatctggtgtaacaacccttgtcaggtgcttcaggtgaacagtgtaattttgtggtgttgtatcatcgtggtcaaatgtgattatatcgttagctggcagatcagtatcgacgacttggtagcctaatgctgttaagccaccttcaacggcttgttgaaccttagtgtagttttgcgagccatcagagacacctgtcaaattatcttggtgaacagttgtgccattattgtcgtcatcaacataggttacagtagcttgctggtcatcgggagtataagtaaccgtcagtttaatgttgccggtcgatggtgtaacggtgtaagcctgagttgcgttcttatcagcagtataacctgttttgccggctggactcgttagagcagtgaaatcaggattacctgattgtaccgtccaggcatctgttggtgacaaggtgacactggttgggtcagcttcgtaggcagctaattgactaactggcaggtaaccaagtaaatcgccagttacagcatctactgcagctgcacgctggaagttaaccgactgtgtccggtcagctgctactttactaccgtcagcataaacgtattgaacagtttcagtaacagtccgattaagttcagcactgtcagctccagccggccagttagcgttggttcctggaattttgtcaccgggaacttgtggctgactaggcgtgacaactttggtctgatgtttcaaatgaacggtgtaattttgtggtgttgtatcatcatggtcaaacggaatcacgtcattagctggcaagtcagaaccgacgacttgataacctaatgacgttaagccaccttcaacagcttgttgaaccttagtgtagttttgcgagccatcagaaacacctgtcaaattatcttggtgaacagttgtgccattatcatcgtcatcaacgtaggttacggtagcttgctgagaatctggcgtataggtaatggttaactttgaattaccggttgttggggtaacgtcataagtggcagttgttgctacttttggtgtgtacccagctttaccagccggactcgtaacggctacaaaaattgccgttggcgtagtgcttgcccagccattatctgcactgagggttgtactggttggatcagctttataagcagccactttatctggtgttaagtaacctaagagcttaccggtgacttgatccattacagcagctcgctggaaagcaacgctggcttgatgatcaggaaccacttttccaccgttgctgtaaacgtattgaatcgtttgcgtcacggtgcggttcaggtcattttcatttacaccaactggccaagtcagattagtatttggcactttattacccggaatttgtggcttatctggtgtgataaccttggtctgatgtttcaagtgaacgatgtaattttgtggtgcctcatcatcgtgatcaaacgtgatcacatcattagcaggtaggtcagtgccgacgacttgatagcctaatgctattaagccaccttgaacggcttgaagaaccttagtgtagttttgcgagccatcggaaacacctgacaacgtatcttggtgaacagttgcgccgttgtcatcgtcatcgacataggttacgatagcagcctgtttgtctggggtataggtaaccgttagtttaatgttgccagtagcaggagtaatagtgtaagcctgagttgtagcttggtctgcagtgtaacctggtttgccaactggactcgtcaaggcagtgaaatcaggattacctgattgtaccgtccagccatccgttggcgacaaggttacactggttggatcggctttgtaagcagttatttgattaactggtagataacccagcagatcaccggtcacatcatctactacggctgctcgctggaagttaacggattgtgtttggttagcagctgctttaccgccaccagcgtaaacgtattggacggtttcagtcactgttcgattaagatcgtcagcgttagttccgataggccagttaacgttggtacctggaattttgtcaccgggtacttgtggttgactaggcgtgactgtcttggtgtcatgctttaaatgaatagtgacgttgtcagcagtgttatttgtcgcactatcgtttaagaaggtaatcgccgttgacgttgcgggagtgaccatgacgtagttggctggcacgattaaattaaaatcagttgttgcaccagcaccgccagtttcatgctgggtggcgtttggaacgatttgttcattgttatcgtcatcgacataaatgatatccgcgtgagcggtatcccgagtgtaagtgacggttacgtccgagctatcagtagcaagcgtgccggaaacggttgtttggttaggctcgcagttagtgattgccggtgaggtctttgagtaagcttcgccaataatgccgctaaccggtacatcaggtgcggcagtaccgctgccatcagcataaacgtagtggatggtaatggtcttgctttgcgcaatgtagtaaagcgtaaccacgttattggtagtgccatccttagtaaaggtgtacgtcgtcgggttaccggcctgagctgtgtagccagggaaggtcttttgatcaatattgacagtttgaccgaattgaccagtctggtgatcagtcgtgaagacagttccctgctggttgacgtaattaatcgttaagggttcgtcatttggcgtgtaaaccacatcaatatctttagtctcaccatcactagtcgttacagtataactggtcggttcactaggggtaacgtgataacctaaaacggttggattggtccaactgtaggtaccgcccacagcttcttgaccggtacttgtagcagcaagtggggttccggtaccgttaacgtagtgaacgttaatagttgttttaggaaccgaaagattaatggtacttttggcctgggtattcatggatttgttggctgtagcttctgtagctgtcgaatccagtgtgacagtgtctggcttgctggattgtccggcggtgtaatcggcaaccttgattggtagatatacagttgtttgttttaaagaagccaatgttggcgactgcactagaacactctggatagttgaccagtcagtgacattatcggcagtaacgaagccatcggcagtggtatcaattgactgactgtccgttaccttattcggtgaatacagtactgttgcacctgcggggattgtcatgctggcgattttactgccatcgacttgaacgctgaagtcgttgccatcagctttggttggtaacgttagcaacgagttaacgtccttcaggtcattgctagtggtgttagctgcgttgacacgtaacgtacccgtttcgttatatttctgcatgaaggtcgttgaatcctgacccatatcctcaggataagtaacgtccttatctgttttagcagggacgtctgctgagaacgcagcggctgaggtgatcatgaaggatgctggctcattttcaacataaacgttactactagtgtcaccaactaaactagcaaaatcttttaaagttgttgtcgaggatgctgaccttacgtagctggccggttgaaaatcaccagccatgataaaacgacctgaacctgcagaatcagtatcgaggttaactgtggttccgagtttagcggtgggtgaaacttgataattaagggcgacacctggtaaagctgtcctttcagggttagtaacactgattttaacaatttcttgaccattcagtgtctgtggtaaaacttctttgatggcagtttgagaaccactagtggtaacggtaatgtcattaagtgactttaagactgcgttagtgggaacgataacataataagttgctgttgccggaccgttaatcgatttaccttgggagattgaaaagttataactattttttatcgtatcacctgagtggtaacggatgccgttatcagatgtactggtactagtccgattgctgtaaccgctatactggactacgccataatttgccactgtaaatttagcggaatcactttgcggagcgtcagcatcatcattagacgcggttaccgtgtaagagttgccaaccgttgcgttggtcagataacccgaaataaagaaccgattgttttttgaagaggtggaggtgatgctcgaataatcgctttgattctgtttgggacctattgggtaggtttgcttatcgatagattttgaagttacggaaacaatcggatcagttactgttccagtgatgacacttccggcaatattattgtactgaacctgtttgccagacttcagtgttacagtgacgtttgcggcataggaaggcgttgtgactttggttgctatcacaccatcagggacgttaaaagtaacttggtcagttgttgccatggcactttgaccgccagttactacggaatacagcccaatgtcattgtacgtatcgttgtcgaatttcggccaggtggtattaccggcgtagctagtaacgtagttttgaggttgagaaatagccgcaatattgacgtaagttaagggtctataactaattgaaactggtaacactgaatgcgttccggtttgaagtgtaccactggtgttagtctttccaaactgttcactgccagtagtttgattagtgacgttgattgagcccataatggatacagtagggtaggttgcattagcgtaggttaaggtgacaggtgttcctgctccccctggttgcgtaatggtaactgagttgttattactagtaccagctacaaatccctttggaacgtcaattgagtatgagccgctggttattttaggtaaaaagttactgttggtattagcgttcacacttaaagtaacatttggaatgacaccgttcacggcattagccaagtttagagtatagttttgaccattataagtattataaatggctacattacttgatatgattggtgaagaagtcacttttagcggatatacagttgccgttccgcttttcgtcaccgtcaagttcatcggtgtagtaccatcagtatccatggaaactgatccatcttgagcgatttttgtgtaaatgtgcagggtgtaggctgtattctgggcaaatgaataagaaacagatgatgctgaatttttagtaccgttaaagtcggtatcatagctttgaactgaatagattggcggtagatcaatttttagtgtatccccagtagtggcattaccagttactaaaatagtgggggcctttgtagcggatccatagtttagtgaaacgtcattttcaccagtcgtggttagcgttgtgtttcccagttgaacggatggcgcaacgttatccaagctggcggtgatttcttgtggtttgccagtcgcttgataagttgcagcagctgttgcttttgctgccgtaatatggtcgtcgtttacttcacctaaattggtgacgtcaggagtatcgtctgctacgttctgagcggctctattagttgtcggtgcaggctcactagcaggtgttttagttggtacatcttcaccggttggtgtttctgttgcttttgttggttcagcagatacttgtgaagtcgctggatgagtattatcagttaatgttgatgaatcagtttgagcttctttggtgactggtgttttagttacattagttgttgaaacatcattagtgatctgtgcttgagacgaaagagccacttggttacccctgttagtggctgctgtcgactttgcagtagcgttatcagcttgttgtgtctgattaacgctatcatcaaccttagcataagcggtgtaatttaatccaccaaaaaagataccggcgcccattgatagtgcagctaatccggtaaaaacccagcgtttaccatccttatagcttttataatggactacggtatttgctttaaaatcacgaatcttattattctttcctaacataaaaacgtccccctttgattaattgctcttaatcaataacattttacggttagacaataaattcaatatgcccacgatcattgaatggcattaactattaatgttttaccccaaatttccaatttaagctttctgaaattagaattcctaccctaagatggataaacattggtttccattctccaactatggaaagtgattatcatctgccaatatcctagcaggtttatacatattttgaaagtaatattcatcacttttcttaattaatttccaatgttcagccgtaatttaatttatataactatccactgatattacaataaacaaaccctttataaatgttgacgttgtagctttaacgaatgatatattatatatgtagcacctctgaacagattacttcgttttataggaaactgttgtaagcagcataaaatcaagcattaattttagagagatacacaatcgagaaattttatttctcttgacgctcaccaataccccatgataggatgaacctacattattgctactcaactcaagtagtgcatagtctgggtgtcaggaagtcggtggttgctgcgaaccgatcagggctgtgtgaccaaatactgaggagcatcgtacggaaagttctagatccgttatcatctagtgagtgaggagtctgtgtactcctaagctgggtggtaccacggttagtccaatcgtccctgttgcgtctatgacgtagcggggacgatttttatttagaagggattggtaacgatggaaaagcggtcgaacgttaaatttggtgaagcaatcgctgtgttattgatgatgttagtcgtcatgggagtaggggtgattggttttcgaattagcccacaaattccggtactggtggtcattgcgttggtcattctttgggcacggattcggcatttcagctgggatgacattcataagggaattactgaaggtgtttctactggaatcgtaccgatttttatctttatcctgattggggtactgatcagtgtctggattgcagccgggattattccgtccttaatggtagccggatttcacatgctcagtgttcagtggtttgtaccgtcagtctttctggtgtgcgcgttgattggaacttctattgggagtgcttttaccaccatttccactgttggcattgcgctgtttgggatggggactacgatgagtcttaatccggccttagttgccggtgcgattatttccggtgccatttttggtgataagacgtcgccactttcagattcaactaatttagcggccgcgattgcggatgccgacttgtttaagcacattaagaatctgatgtggtcgacgattccatctttcttggtatcgctgattctatatgctgttctaggccatggtgctgctagcagtgatgcactgacaaaggtcacctcgacagttaacgttcttagcggtcattatgacattacctggtgggcagcattacccattctattgatgtttgtctgtgcatttatgaaaattccagcgattggcacgttattgatcaacatagctgtggcggtggggatgatttttattgaagatcctgcaacgaaaatcccagccttggtcaaaatgatggaaaccggttttgtttcccatacgggtaatcaagcggtggatgccttgctcacccgtggtgggatttcttccatgatggggaccgtttcactgatttttatgaccctttccttgggtggcttattgatgaaattcgatttgatccaaattgctatgaagccattggtagcccgattacaccgtaatggcgatttggtcactgctggtatttttgctggcatcggtgtgaatctgtttgttggtgaacagtacttatcgaccattttacccgggaaagcttttaagaaaccgttcaatgatcatggtttggataacctagcactaagccgagtattggaagatggtgggactgtaattaattacttggtgccatggggcgttgccagttcctttgccgctggtacgttaggtgtcagtacgctggctttcttaccgttttgtttctttagcctgctgtcaccagtattttccattttgagtgggtacactgggattgggttgaagaagttgccgcagactagtgttgcggatcagtctaattaaaaagtgtcaatgaaaacgcaggtacgtgggacccaactcgttagattctggaatttaacgagttgggtcccacgtacctgcgttaattgttgatatcaaatggaaagtgattaatcgccattttcaacggaaataatatcatagaagttatgaccaccaacggtgtatcgatcccactgggcgacggtgaaatcctcatcggtattatgccaagttttagagaatgttggcccctgtttggtaattgttaaacgatagctgtggctggaaacctttttttcggttaaaccataaattggttttgagtagtacaaataagttgaatttcccttaattctataagttgagaccttccttgaagcagttggcttgatgagattaaggtagtagggtgtgaaggcggtgttgctgccatttggtaggtcacgcaactcgttaatttcgtttggatcgtaaatttgatatttctttagcaaagctgaattatagtattccaagtaaccatccaaagtaatgtggaacattggtttatagcgattagtagcatcgtgcgtatagccagtaccactctgaagcacacgagttcgaacgctcattttagggtgatatgctttaaaatcgcttgatttaaaggtaattggccgacctgtttcatcgatgtgcttttcaacatcatggtgcagatcaccgcggctgaggttaatggagtatttgaatgagccagttgacgtgcgatcttcgccaaccccgtcatttcttaaaattgtcctttaggggtgataattttactgccacgtttaccattattccagtagtattggccggtatacatcgctcgggtggtctttacatagtcagacctactgattgtattgaatgagtcggcatttgctgttaattgaccactggcaaggcccaaaagacccagtaccgtgctaaaagtggcaatgacaatccttttagttaattgaattttcatgtttttccctcctgcgcatcaaaccctgtaatcgatttaaattatacacataaattaggttggttgccgttttgccgttattgctgtgcctgattaactttacgggagtgaatttagtaattaacaggtgatagacaaaaaagttcgacaagtaaaattgccgaacttttttgtttaaatttagtatgaatcaccattcaaaaccgagttcttaaccactacgtagtcaactaagcgaatatccatcagcttgttgccaccagcgtatgagattgaactctgcaagtcttgttgcatttcagaaagggtgtccgcaatgtcgccacgataaggtactaacatttgcttgccttccacgttacggtaggcgcctttttgggtttccgaagcagaaccccagtattgtttgtagctcttaccatcgattttgatcatcgtaccaggtgattgtaaatgaccggccattagtgagccaatcatgaccatggtagcgccaaagcgaattgacttagcaatgtcaccgttatagcgaatgccaccatcagcgatgaggggcttgctggcagccttggagcaaagtcgtagagcggctaattgccagccaccagtaccgaaaccagtttttagcttggtgatgcaagccttacctgggccaatccccactttagttgcatcggcgccagcgttttccagttcgcggacggcttcaggagtaccgacgttaccagcaatgacgaaactaccaggcaggtatttcttgatgtgctgaatcattcggatcacagagttggaatgcccatgggcgatgtcgatggtgatatattctgggacatcgttggcatctgctaactcttgaatgaaatcaagttcttcctgcttgacgccgacactgattgaagcgaagaggtctttactgtgcatcattttaacaaaatcatgccgcttttctggttggaaacggtgcatgatgtagaaataatcgttttgagccaaccaaacagcaaggtcatcattgattacagtctccatgttagctgggaccactggaattttaaatgtccgcgggccaaatttgacggaagtatcggcttcggatcggctctcaataatacatttatttgggatcagttgaatgtcttcgtagtcaaatacttctgggttcatcattgcattactccttattctttaacggttgtgtccgtatcttgccaagcgtcgattaaaacgttggtttgagtccggtcagggccaactgagaaggtggcgatatcaacgccgaccaattcagatagacgatttacatagttttgggcgttaacgggtaaatcttcaaacttcttaacgccggtaatatcttcgtcccagcctgggaattcttcgtagactggtttgcagtttctaagttccttcaaacttgctgggtagtggtagatcgtttcgccatcaagttcgtaggctgacgcaatcttcaaagtcttcagaccagtcagcacatctaaacagtttagcgagaggtgagttaaaccagatactcgcttggcgtgacgcagcacaacggaatcgaaccagccgattcggcgtgggcgcttagtcacagtgccgtattcgtgaccggcttcacggatgaagtcgccagtttcgtcgtttaattcagttggaaatggaccgtcgccaacacgtgaagtataggctttgcaagcaccaaccacttcgtcgatcttagaaggaccaacgccgttaccgatagtgacaccaccggcaactggactggaactggtaacgaatgggtaagttccgtggtcgatatccagcatgacaccttgagcaccttcaaagagaacgtgtttaccggcgtcaatagcatcgttgatgactacggaagtgtcagtcacatactgtttgatttcttgaccatattcatagaagggttcgtaaatatcgtcaaactttaatggctcatgatcgtaaagcttggtgatcatttcgttcttttcttcaagattttgacgcagtttttcttcaaacgtatctttttcaagtaaatcagctacccggataccgattcgttcagctttatccatgtaagctgggccgatacctttattagtagtaccaatttttgctgttttagcttcttcttgtaattgatcaatgaggatgtggtagggcagaatgacgtgggcccgattagaaatccgcaaattatccgttgaaacgttgcggtcgtgtaggtaatggagttcttcaaccaatgacttggggttaagtacaacaccgttaccaatgacacttaacttgtctgagtagaagatcccagatggaattaagtgtaacttataagtttcacctttgaagacaatggtatgtccggcgttgtcgccgccttgataacgcgctacaacatcggcctgcttgctcagaaagtcggtaattttacctttaccttcatcgccccattgactccctactactacgatagatgacattagaacacctcatatctataaattgctgagtgagttaaacacgaacaacccagcaatttatatactaacaacttaagattgaaaaatcaagttaaaatacgaatattattaataaatatgttattaatgttcctaaaatctatattttctaccaataataaaggatagaaacaaaaactaaattaattaccatataaattagttatgcaaatgcgttgatattatgttatgattttagtggaaattcagcagtgaatttcaattaatgttcgtattttaatgaaatcaatcagaaatgaggactataatgctcgaaagatatacacgcccagaaatggcggaaatttggtcgctccataaccagtatcaatcttggctggaagtcgaaattgcagtggatgaagcgtgggctcaattaggggtcgtccctcaagaagacgttgataagatcaacgagaaggctacttttaatgaggatcgaattgctgaaatcgaagctgttactcatcatgatgttgtggcctttacccgtgatgtgtctgaatcactaggggaagaacgcaagtggatccattatggcatgacgagcactgacgttgtggacacagcgcagggctaccgtctgaagcaagccaacgaactgttgcgacaagatttattacatctaaaagaagttgttaaaaaacaggcacttaagtataaggatactgtgatgattggccggacccatggtgttcaggcggagccaaccacttttggactgaaattagcccgttggtattccgaaattaaccgtgatattgaccggttcaatgaagccgctgatgaagtggaagctggtaaaatcagtggcgctgtggggacgtttgctaacgtgccaccgtttgttgaaaaatacgtttgtgataaattggggattcgcgcacaggaaatcacgagtcaagtactaccacgtgatctgcatgcaaattacattgcaacgttagctctgatcggcactagtttggaagaatttgctactgaaatccgtgcgctgcaacgttctgaaattcatgaagtggaagaacatttcaataaaggtcaaaagggttcatcagcgatgccgcataagcgaaacccaatcggttcagaaaatattaccggtttggcacgggtcttacggggccacgttcaaacggcatatgaggacgtggctttatggcatgaacgggatatttcccattcatcagcggaacgtattatactgccagacaccactgcaacgctggattatatgttgcatcggttcgcaaacatcgtggaaaatctaacggtcttcccagaacggatgaagcataatatgaccttaacctatggcttgatttatagccaacgggtgatgttgaaactgatcgacgctggtttaacgagagaaacggcctacgatttagttcaaccgttgacggctaaagcgtgggatgagggcgtccagttccgtccattggtggaaggaaatgaaaccattatggctcatttgtcagaggacgatattaatgatgcctttgattatcattatcatattcgtagagtggatgagatatttgagaggattggattagagtaaggtgcggaagaaagcgtttagagagcggagtgtaaggcgtcccagctataaatcgtgggcttggatttatggctgggacgccttacgtgcagctctctgctttctgtagcccgattcggcaatgtaacaagaaaaaaacacataaatcgtgggcttggatttatggctgggacgccttacatgcagctctctgctttctgtagcccgattcggcaatgtaacaagaaaaaagcgcggatgggcacgcccttacatgcagctctctgctttctgtagcccgattcagctatgtaaaaacaaaagaggctgtgacataagtcccttaattcaaaagcaggtagttaaaaatccaaggatttttaactacctgcttttttgatataatgacagaaaaaaagagtaccggtcacacccgatacatcatcctcgaaaggcaatccaacatgacaattataacaggatcaaacaattttaacctctaacgtaccgaacttaatcgttcaaaaagatatcctgctgcttactctatattaatgaaaactggctgagtccctcaataggagcactatcctattcggtcgtcctcgagaatatgatttgggtgcccaactgagacgctggttctttttcgcctaccctcgcgggtccttagtatcgcctgaatcgaaacctttttggcggtggagaacttaacagctcgctggctgacccaggaacagatggccacgtatcggacaatttgtccgccttccctcctccggatttccgatgagtttagaaacttgattcatgatgggttagaccatttggttgacctacttgcgtcgtcaaaacttaattgacgatttggacctttattgatggtaccaagatttggggctgattccaataaagtatagtttttctgggcgtagaatcaccgtgctctttgatcagatgaatcgtggaagcatccaaacagatcttggctgatagtaaagcactccactgtgcagctttcgttcccgaggggacgaatttaaccctggaaatgatggttaggtgattactcgacttgaggatcggctcgataaactggataggaagcacaatctcccaaattatcgcccatccagctaacggatcgtcgaaaaatcaataagatcaagcgccgctcactcaacgcaaaggcaaaatgattgacatcacatcaattggaaaactttggtgaccggcaatagctaactctaaaaccgacatagattagcaccttcatgcgcgtcaaaagatccaatgtttgaattgtcatttgaagccatctataacttacaaatcgccaccaataatcaattcgtcttaggttcggtttattccgcgtccaccgatacgaagacgtttattcctttctgagtaccttagcaaaaacaacacgttggctgagaatattgtgggcttgattgctggtttatggttcaagaagctaataaccgtcaaatagaagatactatgagcaccatccagcaatcattccgtacggaaacgatgttaaagaccaaagccgtccagtggcagtctgatgatcgtaaatcatgaactggaattcaccgctgatgacgactattaattgatcaacggggcgttagatttaacttccagcgtattctaagcgcactgacagagtggtatcacgctgatttcaaaaatcctatcgggcagaatcgacgaggatcaccagttcatccagcagccctgacgcggtctggacaaacccgaatatcattaatcaatcccagttgggaatattttaaagctcagcacgggaccggtaaaccacagaacgaacggcacaaatttgccggcgtaaaatagatgtagaaccagtcttcggtagaataaggcttattagggttcaaaagatttatggtcgaggtttagcgaaggttactaaggaaacctggtatcgtcattaaggccttaaatatggcaaaaattgttaatcccgattttattcagaaaaaaaggtttatcgagaaatcaaattttgatttcttcgataaaccttttttgaaagctatgatttacgacttaagtcacagcctcttttaacagtttcagaaaaattatttgtgtacccaataatagtaagttttgtcattatcaaaagtgtagagaagtgctttcttcccgttatggtgagttggtttaagatacagaatttgaaggtagccaaggtacttcattgggccacttggtgagatttcgtactcctttgaggaataccgataatcaatgtaagcaaaatatttgcgaggaaaagtcattttcttagtttttttcttgttaccttgatatttaacgtacatcgtataggaatcttttctgattgtgtaggtatactgtgtttttattttaccgcctttattccatccgctctgccgccacgttccgcgcagaacagatggaattgttttataaagatggtagtaagcagcgtttggatttgcagcatgtgctgtaggtgcactcgaaaaagtcgcggcaatagcaatccccaaagtagctactattgctaaaataacatgtctaattttcatcgtctatttcccccataaaatatgattaagttccctaattgattagtatttatgaaatagctgctattgcaaggaatactagtgatcattcaatcatttttccataactaacccttccctccctgattaatcgtcttttacattaagcgtttgcataagaaaaatcaatatcatgatagattttgtagcaaacttgattaaagtacagcacaaaaaaaccaaactccaacgagtttggttttttaatagggattaactttccaatttaaggggggaaattggaaggtattaaagaggagcatggaatccgttttctagggggaggaggatggattccacatgcaatcagttcctaggggggaggaaactgatggaacaaggaagtgtaccctcttaaaattaagaggtatagcttattacctttgctatgatataaatatatcaacaaaatgtgacaaaagtgtgaaattcaaacgggatatatttgaagtttttcttatcttagaaataagtttttaagaacgctgaaacgcgtgcctgataagccgctggattataccagaaactttcggcgtgagtagcgtttttaacgatccaaagttgctttggtgctttagtagcgtggtagttttcgtaggccattctaactgggacgtaggtatctttgccaccatggatgaacaggattggtcgatgattcttttttagttgttctttagaagatacatcgcccagatagtagcctagtcgatgacgattgatggtgctgaccattggttcaatgggatattcaggtaaatggtattgttcctttaacagataggtcatctcttctttgatactggagtaaccgcaatctgcaataatggcttttacctgtgtgggcaggttttcacccgacagcatttccatagtagcgccacccatgctgacaccgaagagcagaatcttttcgtcttcgcccttgatgtcgatcagtttgttaatccagctcatgtagtccaaacggtctaaccagccaaaattaatgtattttccggcactgtccccatgagcacggtcatcgggcattaaaatattaaagcccaagttgtagaacatttttgcataatttgccattgtctcgcggtttcccttgtaaccgtgagaaataacgaccgtttttttcaagtgatcagggtgttgaataaaagttgccactagtcgtttatgtggatcgttttcatgcaaataccaagtttcctgtggcacgtttttgaaccaatccacgtaatcatagtattgctgtgcgtatttttgcttttctttagaggtttctggcacgtagttgacccgcttaaacgccatgttaaataggtagtgactcacgtaaagtgcgcctgtagcgacagctgccagtgggagtccaagtgtaactgtttttttcaaattctaacctccattgattagtgagttaagtaaagtttcttcaaatcggcaatatcttcactagataattgcagtgcttcatttaaaaattgcggcatggagccgtaatgttcatcgatggccttcatcgcagcgtcaaaataaccgcttgaaactgacatttgagctttgatggtagctaacatcgtaccagtaacgccctcgtttttggctttagtcatccgcgcctgaacaaacggcgataaaacatcgttagttaataggtaatcttgtttgatgattttttgtggcacgcctagcgctgaaagaaagaacgtcgcgcccataccagtccggtctttacccgcagtgcagtggaacaggagaacgttcttttcattagtattactcaacaacgtggcaaaaaaagtttggtaagcggaatgtgcttgaggttcgattatcatttcttggtagacactgaccatgtgatcaaaaccgcttttctttcgtgctttcagctcagcgttgagttgcgcctgcgtttttgacgcatcagttttatcgtcaggaaagactgggaggtgacgataaacgatgttgctgggaatttgatctggtgcttcggctacttcaccgtcggaccgaaaatccacatcgtatttgagcccataatcaactaaagtctgctggtcgcgatccgataagtgagccaacgttccagttcgaatcacgcgctgccattttaccgtttggccatcgcgggcgggatagccacctagttcccgaaaattatagccgtggtccattgtcaatacgcgctgattagtttgctgcatgaaaaatccccccttatttatgttgtacatgcgttctttattgtaacccaattagcggaccatttcatgtacaaaggtattaggtaggtacgatactgaccggcaaattgcttttttaaagtaaatgaaagcgctataattgtcgtattaatatcgttaaaggaaggtgatcatgatgaaaattgggattattggtggtaatggcaaaacaggatcagccgtgtatgcggaggcaaagaagcgcgggcacgaaccaacagccattgtacgtaatgaggaacgggcacgtgaagcgttgggggacgatgcccagctgctggttaaagatgcctttgacttaaccaaagctgacttaactggttttaacgttgtcgttgatgcctttgcagttccgatggggtcgccactggcgtatttacatttagacttactgaccaaattagtgcatgatttacgtgatactaacacacggttgttcgtgattattggtgcagccagtttaaagacgcccgatggcaagcgcctgttggatcagttattggcaatgccagatcatgatcagtggattggaacaccgctgaatcaaacctacgaatacgaatttctgcaaatgatcgataacgttgattgggtggccgtttcaccatcacgtaactttgggtcgggtccaactaacgggtatgtttcaggaacggatcaagttttagttgattcaaagggtaaatctgaactttctcatggtaatatggcattagcgattttggatgaaattgaatccccgaagcatcaacaccagcgatttacagtgcgtaatcaggagggtgagtgatagatgagtgtacgtggtgattggcttctatttaagacaaaacgcagtcggctgaaacaacaggtagcgaccagctttctgcatcctagccggcgaacggatcaccttgatccaagcaacttcaagcaacctgaccaagtgaaggtggtgccattggaacgtggccgcttagtcacccttctgccagagacagcaacgcgcaagcacgtggtgatctttcatggcggtgcttacacggttcctgcaaccgacagtcaccggcagtgggtggaaacgattgtggctagcatgggcgctaaggcaaccatgttggatttcccgttggcacccgaaaatacggcagtggtcacggtaccggcttcactggatgcctatgtggaactgcaggcagagtatccagatgatcaattttactggctggcggattcttctggtgcaggcttagcgctggtacttttacagcaactgcgcgctaagcagcgccccatgccagctgccacggtattagtgtcaccatgggccgacttggccatgcgtgatccggaaattgtcaagcgccaccaaaccgatccagaattaccgttgcaagccatgcgtcaggtagctgctaattatgctggtaatttggtattagatgatccattagtcacaccgttgaacggttctatggatcacttgggccgcgttagcctttggtatggcacaacggaactgttattgcctgatcaccgcaaattggccgatcaactaaagcaggcagatggtacgcaagttgatgtacacgaaatgaaaaatatgttgcacgatttcttgatgtggccgggcttaccggagagtaaacaggtctttacgacgttgcaaaaaatgatgcaaaaaaacgaccagtaatttggtcgtttttttactttcggtctcgttcagctactttttggctacgagcaattaagtccgcaaaaagggctttcgattcttcatgatgcttatacatgttttcgggatgccattggacagctaaaatctggtcgttatcgatggactctaaagcttcgataacgccatcgtctgctcgagccgtaacctttaaactgttggcaatttttttaacggcttcatggtgccgggagttcacgtaaggtcgttcccccgtaattttaaaaagtcggctgtctgggtcaacggatacgtgatgtgacggcatgttaccagcagcagcttgattatgttttaaagtagcatggggattttctgacagatcctggtagacggtaccgcctagtccggcattaatcagctgcatgccacggcaaataccaaagatggctttaccttttgcaacggcctgcttaagcagttcaatctcaaacaagtcccgtttacggtaggttaccccgagtttttcgtggggttcttcaccataaaaagtgggatcaacatcagcgccacccagaaaggcaacaccatcaaataaatctatgtagtcaataacgtcttcgggatcaacactagggaaaataatcggtacaccaccagcttttacaatagcctcaatggctggccggggcgcaaaggcagcgtttcgttcgttaataatattggtagcttcagctaaagtatcagctggtagtgcaattcgtgggcgcaagggcgattcctcctcttctttgaaatgaacttaatagattgataatttgttttcaattctaacatagaaagtcccatctctccgttaaaatatttaacattcccccgaaagagggttacattagtaatgtaactaaaattaaacgaggtaaatgaagatggcaatgacagaacgacaaatgattcaagaaattttgaatacggtagatgttatctacgcatttgaagacgttgatgaagacgctaaagaatataccctattggttacgcaacaggataacgacaaacgcccgattgaaaacgttaacgcggaaattaagaagtatttccaagaagcggatttcaactataaagaagaattgaacccaacgaataccgacaagccagcggatattcgtgtcgtcataaaacgatagttaaaaaataaataaccctcatgcagcggttgctgtgtgggggttatcttttttggagtaaaataaaaaccattccgctaactttggctagtaccggaatggtttttacgttctaaacatgccaccgtcattaacggttctgcaaggaagtcctattttagtagggcttctttttataaagtggcgtcagttgagaaaacttggtattttaatgccgagatgaatcaacgtctgggacggccaccattgtattgatttaactgtgaatcgatatattgactgacaacttcttcagaaacatgaccaagtgtactcataaagaaacttggtgaccagagatggccattccaaagcaactgtttagtttcaggaaattgaatgaaccattgtttagctgacccgcctttaaaagcttttacgattgaagaaggtgccagcttaggtgggaagctaatggtcatctgtacatggtctggcatgatttgcatatcggtgatatcaactgaatgacgtttggcaatttccaccaagaaagctttcatagcgacgatccgttcttcagtcgtaaaaattggtttgcgatacttagtcacccacactaagtgaaaattaaaatcatacacatttgtccgttcgtatttaatcatacggttacctcctaatgtctgaatattagcgatcgtattcattcatatcataacatatgctaaaatattgtgagtaaggaggtgaggcataaatgacctatcaaggccttaaattacggctgtatcctaaccaagagcagcagctgaaaattaaactgaattttggctgtaatcgatttgtttggaatcaaatgctcaacatgctgataacgcgtcaccagaataatcccgcagcccagtttttaaatgccttcgacttgaataacttgttgccggcgctaaaggctgaatatccctggttgaaggacgctgaaagcactagtttacaagtgaccaatcatgatttaattgaagcttttaagcagttcttcaaaaagcagcatggttttcccaagtttaagtcacgtaaataccccaagcagagctatcagtgcaaagcagttaatcaaaatattaaggtagttgatagtcatcatatccagttacctaagctaggcagcgtctcttttagagcgggtagattgccggtcggaaaaattaaggctgtaacgattcgactttcaacaactggtaagttctacgcaaacgtgctggtggataccaccgttgaagaattacccaaaacttcaaaagctgtgggcattgacatgggcgttgctgacctgataatcacttctgctggtgttaaataccccacgattcggtttgataaacggctcagcaaaaagctgcattactgggagaaacgcttggctcgccggagacgtcaagccgaaaaggagattgcctgggacaaacataacaagataccagaacccagagaactcagcgactttaaaaactacttgaaagccaaacacatggtagctaaatataatgaaaagattgccaatcagcgtgataactatctacacaacatcaccaaagaactggttgaacaatatgatgtgattaagattgaagatttgaaaaccaaaaaccttctaaaaaatcaccaactcgcccgcgcaattgccaatcaatcctggcgaaagctacgtctaatgctggaatataagtgtgcttggtatgggaaacaactgatcactgtaaacccacgaaagacttcccagctctgttcagcttgtggctatgatgatggcaaacacacattagagattcgccagtgggtctgtcctaactgtggcagcaatcatgatcgtgatatcaatgctgccaccaatattctaaaagcgacagcgtagtcaaacgaccaactgggctggaacagcctttagttaatagccgtaaccgctgcgtaccattctctgaatgatgcgtaagtcagcggtgttcctagaagctcgttactttagtgacgagtagttcacaccgatataataacatgtccccaagctaccgtggcagttttaagcatgaaaatactactaagaaagactaataattggctgagattgcgtcataattaatgacatgaactttgtgaatgtgatacagtaggactagttttgaaaccgtttacttaccacaaagttggagggatttaatcgctatggcaatgaaggagccggaacattatatactcgcaatcgatcaggggacttcggtgacccgcgcaatgttgtttgaccacacaggtcgcaaagtgattgagagccagaagtcgtttccacaatactatccgcacaatggctgggttgaagttgacgctaatgaactttggaactctgttcaatcggtcattgcgacagcgttgatcgatgcgggcgttcatcccgaatacattgatggcattggtatttcaagccaacgtgaaaccacggtgatttgggataaggctaccggtcagcctattcaccacgccattggttggctgtcgaagcagaccgcgccgattgctaagcagatggtgacggatggctactctgacttgatccacgaacataccggtcttgtgattgattcgtacttctcagcgacgaaggttcgttggctgctggaccatgtttccggtgctcaggagcgtgctgagaagggcgaactattgatgggtaccgtggatagctggttagtttggaaattatccgatggccaattacacattaccgattataccaacgccagccgaaccatgatgtttaacattcacgatttaaaatgggacgatgagattctcaaaattttaaacatccccaagaagatgctgccagaaatccactcttgttcagaagtgtatggcaccactaaaaattaccagttttatggtgttgaagtaccaatttgtggattagtgggggaccaacaggccgctttgatcggccagatggctttcaaacctggtgaagttaaaaacacgtatggtgacggggccttcatcgtgatgaatacgggtgataagccacaactatcgaagcacaaactgctgaccacgattgcttacgatttagatggtaaggtaacttatgcccttgaggggtcgatattcgtggcggggacagcgctgaactggctgcaagaaaccatgaaaatcattgataatgtgccgcaatctcgacaagttgccatggcctccaccaatgacgatgaagtttacgtggtaccggcgtttaacgggttaggggcgccatactgggatcaggatgctcgtggtgccgtcttcggattaactcgcggaacgaaccgcagcgattttgtgaaggcaacgttacaatccattgcctatcaaacccgcgatatcatcgaaactatgcggcaagatacggaaatgcccgtggtggaaattctggctgatggtggggcttcgcggaaccgttatttgatgcagttccaagctgatattttaaacctgccaattgtccgttccagcgatgaggaaaccacggcgctgggggcagcgatttgtgctggtctcgcaattggctactggaaagacctagatgaagtcagccagattcacgcggctggcagaacgtttacaccggaaatgaccgatgagcggcgtgcacgcttatatgacggctggcagattgcaattaaggctactcgggcgtttaaaccacaacactaattgaaggtattcaaaaggcacatgactgacatgaaaatcagtgatgtgctttatttgtgggccggctgataatgcaagatatcgccaggttggcagtccaatacttgacaaatcttttctagtgttgaaaaacggactgccttagcctttccggttttcagaatcgacagattagcaatagtaactcccacggccgacgaaagttgcgtcaaggtcatatggcgcttggctaatagttcatctagcgtaattttaatcatattttgaactcctagatcgttaaatcattctcgtttttaatctgtaaagccgcgttccatagacggacaaggacagctataaagacggttaaaactaacggtgcagcagcaagcacgaaaccaatcagtaataaaccaggggcatcatctaattgcgttaccgcgtaaatgaacggtaaccacagccaaacgcccgcagtgaccgttactagggcccattttatacgggtgaggtacgttaccgcggtagtgctaaaggcttgattgcggtcgatgacgcctagtagttgttcagcaaagaagacggctgccaaaaagccgatgatggcaaggtaaatgccaatacctaagaccaccacaacgatgttcaagtggtgcggtgcatgggtaaacatttctcttagcataatcggaaacggaatcagtccaactgcgataactaagagtgctaatccgcctaatacaatccgtaaaaaccaggttccttttcgcatggtgatgcctccaatcttgttttcattgacgttagtatagcatggactttatcgaaaaacgataaaggattgattaagttttctaacgttaatgtgtaaaatggggaaagtttagttgggtaagttatactaaaaataatcataacaaggaggattttccatgacaaaagtagattttaaagccgcagtaattgctggtacagttgctggggttgcttcgggtttagttaagttaggctgggaaaatattttaccaccacggacaccagaacgaaatcggaccaatccgccgcaacgactgctggaacagattggtgtgccagaaaaaataactcacgcgacgtacacgtattctgaccagcaaatgccgtgggtcagctttatggtacacttcggtttttcgacaacctttgcggtgctctacagtgtggctgaacattacgcgcccgctattcgtatcggtcaaggaaccctgtttggcttaggtgtttggagcgcctttcatcttggcatcatgccagcaatggggactgtgcctagtgcaaaagatcaaccggctgaggagcacgtttcagaagtgctgggtcacatggcctggatgtggacaaaccacatcatctcagacgaactctatcacgaactaaccaatacaaagtaaagtcggtgaccaactgtgaatcaaacttggcaaacgaagtggccggagcgcatcagctatgggctgagcgacgcggctgacaacttagtctttcaggtgatgaccacctacctgctgttcttttatacggatgtttacggtttgacgcccggtgcggtagcgattttattcatcgtggcacgggtggcggatgtgattgagagtccgctgattgggctaatgatcgatcatacccattcccggtatggcaagagccggccgttctttttgtggtatgccttaccttacgtattatttgcagtgttaacctttgttactccagatttttctcatacgggtaaattaatttgggcctatgtcacatacttggggctgggtttcttctacacggcggtgaacctgcccatcacgtccatcctgcccaccatgtcacaaaacgaacgcgaactgacactgctgggagtgatccggcaattctttggcagttctgtgcaaattatcgtggcggtttttacgttgccgttagtggcgttcttcggtcatggtaatcagcaacagggctttttgctgacgatgatgttgtttggcgtgatttcattgatcctcatttggaacaccttttttcacgtccgcgaacggtttaccaacaaaaagattgctcaccaaccggttaagcaagttctgccgatgattttaaaaaatcaaccttggattcgtatttctatcgtaatcttgctattttggctagtcactgctattaaaaatcaaacggcgatttactatttcaagtacacgctgaataaggaatcgctggtaccactggccaatagttttaccttgacctcgttaattggggtggtgctgatcatgcgattatccagtttacatgggaataagaaaaccatgttaaccggtatcgtgacagcgtttggcggtcagctagtgctggcagcgggggtctatttgaacacgttaccgattttattcaccggcgtagtgatcaacgccattggtcacggcatggtcgttgggctagtttccatcatgattgcagatacgattcgttatggcgtcaccatggggattcaggcagaaggcattctggctgctagcgataactttggggtaaacgttggccttggggttggtggtctgattacagccgggctgtttgggcctagaataaaaagtgtacaagttaaatagagactttgatttagtataattaaggaagtaaattggaggatcaaataatgacgaagcacagttatgacaaggaatttaaggaacaggccgcgtattaacttagataacaaggatcacatgaccatgaatgaaataagtaagaatctaggtattggggctagtacattacataaatggattaagcttttcctgagactggggagtttggccgtggctctggtattttgccagcgataaggacaaggagattgcacgactaaagcgtcaacttcgtgacgctgaagagatcgaagtgttaaaaaaaccaatcgggattctgagcaagtaactaccgaaaaggtataccagaaatggacgttcagcacctttggaatccacccttccataatggtatgtgtgattatgttggaatctcaagaagtggttactatcaacgagaaaagcgtcataatcaccaatcaccgcgaaagcttcggaagaagtttattcaaggtgaaattaaagcaatttggctcaaagcctttgtatttacggtgccggcaaaatcacccagaacttcgctcaaaaggatataagatcgctgaacgaactgttggtaagtatatgcgtgaacttggcattcacgccgtttacctaaccccttggacgactacactcgcaattctaagtttgataaacagctaataaatattttagacgagcagttcaatccattgcgaccaaacgccgtttgtgtgcattacaccacttatatttcagttcatgacggattcgtttatttaaccagtattatggacttgtcctcccgacgatcattggttgggacttatctgaaaccttggaggtatcgaatgtcatcccacttattgaaaagactaagcacagtcgccatattagcagccattaatcatgcacagtgatcgtggtagtcagtttacgtctgaagcttacaatcaagttacagctaacatgacattaagctattcaaagaaagcttatccttgggataatgcctgcattgagtcgtttcatgccttgttaagcgtgaatggataaatcggtttaaaatccattcatactccgaagctaaacgactagttttcagtacattgaaacgttttacaacacagtagatgtccacatccactgtgattcaaactcactgtggattcaaatcaccaaagcaacttgaagatgagtatcaaactcaaattcaaaatttagtcgtggcataggacaaaaaagtctctatttaaattgtctattttattgacaggggaccagttccaactatccggctatgcacctggacagcgacaaaatactgccacgctaacgatgatcaattggaattatgtgtggattccgttggctatttacggactcatgtttgcggtattatggttttacgatgagcagacgatgcaaaaggcgttaaaaatatagcaacaaaataagcgtgaagcaaaaattgcttcacgcttatttttagtcttttttggtttttaagtagccactcttagtcaacaaatctttcgatcgctgtgttgccggtttaaaaccacgattgaacaagtgacggaagtacatcagattgtacaagtagccccaaacgaagctcaacacgaattggagaacgctggtaaccgtactaaaggtttgcatcgaagaaaagtgaatggaataaagtcctaagacaatcccaaggttcacaccaatcatacaaaggaaattgtaccaatctccccgaaaaatgggaacgaggaaggagaagagaaaggtcgtatacgagaaaccgactttgccgattcgaatatcaccattaccctcttttacaacggtagcatagttaggcggcactggaataccgtttgggccttcgttattgtcgccgttatcgccgtttccaaatggattttgcatttaaaccctcttttctacactgaatcttttaaaagtcaaacttggtcaaactgtttatttcactatgataagcctaaatgcaatttttggctaccgttaagcccgagtaaatttcacaacggcttcgcaacgagccgtttgtggcatcatatcgactgattgaatgtagtccacgtggtactgattggttagtttcactaaatcacgtgccagagtagaggggttgcaggaaatgtagacaaattttttcggcttagcacttaaaatggcgttgatcagaccgtcatctaagccggtacgtggtggatcaacgatgagtgcatccggccggaagccttcattgagccatttaggaatgatcgtctcagccgtgccagtttcgtaatgcacgttgtcgatgttattgattcgagcgttttcgttagcgtcatctacagcgtcagcaatcacgtccatcccgcgcacttctttagcggcgtgggcaatggataaaccaatagtacccacaccggaataagcatcaatcacagtttcgttatcggacaaggccagtgctttcaacgcctcgtcgtagagtcgaacggtctgataagggttcaactgtaagaatgctcgtgcggataagttgaattgcaagtcattgagaacttcacgaatttgcggtttaccagccagtaacgtggtcttttcaccccaaatgagtgatgttttgtcatcattgatattttgcatgatggaaacaatctctgggaatttcgtcagcagttgatcaaccatctcagcttcttgcgggaagggtgccttagcggtgacgaaaaccacttggacttcaccagttcccttagcgacccgaacaaccactgtccgaaccaggccggtgccgtgcttttcgtcgtaggtgctgacgtccagttcttccattaaatcaacgacgccacggatgacacgcatggtggctggcatttgaacggaacaggtctttagatcgactagatcatggctacgttcccggtaaagaccggcaatcacgtggccgtcttcgtcccgacgaacttggaactgggccttgttgcggtattcatagggattatccatgccaatggtgggctttaactcgaaatttcgataacccttaggctgaaatttttccagtgactgtaatacgacatcacgtttaaagtctaattgcgctgggtaagctagatgttccaactcaaagccaccaacttcagcagcatagtcgtcacgaggtttaactcgatctggactaggagtcttgagacggtgaatcttagccgttagaaatgagggcttgatgccagtgacttcggccacgataacttcgtttggcagggcacccttaacgaagaccagcttacgtttgaagtagccgataccttcgccgttgatgcccagacgcttaatagtcagcggaaaacgctgaccaagggtgacctggacgccagtttgctggtgcgggcgaggttgatgattattatgattatttgaatgatgataacggtgttgcggttgatttgtattcaatgatttttatcctatctatatagtgtctaatggttttgcgtcttcgtctttcgtattgtagcgtaaaagagcggtccagcacaagctgaaccgctcttttcgttgttaaaaagaatgattattcttcgtaatagtggtatttaatcgtgtaagacttcaaatcacctgggtgcaaggtgatgtcaccgaaaccgtcatggttaggggcatctggcaatgtttgagcttcagtagccaaagcattgtatggttgaccgccttcgggaaggttagcagtgtaaaccaccagtgcgttacggtctgagtagatggcgacgtgacgattgcttgatttatcgctcaaaacggcgattggatcagtatcgcttggggtcacttcataaatatcatcgatttcgtccttatcgtactgtgacttgatgtctgccaacgcactaggaatatcgcgaggtgtggagaagtcgtagccggtaccagcaagtttattgaacttaccagttggaaccttatctgaagccaagtccaaacgacgagtactgttgaccttaagtagttgctcatccaaagtcttttgaccatcagtcaaattccagtagatgtggcaagttgggttgaacagtgtcgtggcagttgaagccgcactgaagttgattgagacctcgttatcatcattaaaggtgtaagtgatgcgagcatctagatcaccggggaagttgtcttctgagctagcgatgttacgtgagaaggtaacgcttgcgtcgtgatcacggacggactgttcagccttccaaacgaggctggcaaagccgtgagggccgccatgcaaggtgttgccgttttcgttggcatcaaagtggtattctttaccatcaattggtgcttgagccttagtgattcggccggcgacccgtccaatggacattcctagacaggatgcagcgggggcttcgtaatcagaaagtttatcgaaatgagcaatcagtgggtgattgttgacgttatagttcgtccaagttgcaccaagttcactcacttggatgaagttaccagcagcatttgtaattgtgtaacggttaatattttgaccgtcgtgttgaccaaaaatatcggatgtaatttgcatcaaaaaatcctccttgtgtaaacgctttatcaattaatattatacgctttctagctggaaaattttagtaaatattttttgaaaacgaatgaaagtgacgtcttaaccatttcccaacaatttcttcacagtttcgagacatttagttggtattcttaatattgtaatatcaaggatgcaattttcgaaaggattgatagaaatgttacttgataattcagaaatcgagacgattgccgttcagctagttgacgtcaatgagtctcaaatgaccgcaaaaaccgaaaataatgatttaattcaaattaaacccagtggtgtgacaaaagaagataagtccttctggcaaagtatgaaagatatcgccaaggcaaagatctggctgccagtaaccaagggcacgcaccagttactacaatatgattggcttagtgcaacaccaagtatttaaatctaggatttagaggcatagcccaccttcaagcatagtttgcttgaaggtgggctttttattttattgatgatttaagattcaagttttttaatcgatttaagagattgttaatgtaccccaatcagacatcttttataggaagaaatacagggttaataaaatgatgattaagagcgcaatcccttgtaagagtaatagcttcgatatgctcaattagttacatgatactgattttttgtaagtgttaaattttataattaacggggacaactaattcatgaaagccttttattataaggattttattggaataatattattgaactattattgactatttttataaatgagactacattgggtacatgtgtcaattggagattcggtttgttcgatttaaaggagaacttaatttatatgattaatttggcaaattacaagtttaatccgaacaagcccggaatctttcaatggcagtctgttgatgatgtatttttaatggtcgttgattaattagttcaagtgctgctaggatctcatcagtcgttactggctaaaattggtctttttcgggaagaaccagcgtaaccgtctattaaaatattcattggaacctcgctcccatggtgaaataggatggcaaaaataaactttgatctgataatcctgttctaaggccgataattggcaaactcttaccatgatcaacagtaatggatttactggggaccgaaggcccctaaacttgccaaaggcggtgtttagagccttagccgttctattaggggctttgatggcccatagaagtcgggtcttacgttctacgaagtaacccgaaatgatcgtgactcacttcgactagaaagcacagtatctattcccaatgaccaaaagctaaccgttgattaacagtttgttggccgttgttcgatgggaagtccccattgtaaatttccacgattttcgctcactcggtgctgggggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgactgcatcttgctgagctaattctggatcataaggtttaacccggtccaactcatagctaatgtagctttggcgacgcctaaggcgtcagccattacttggtaagatttattcccctcattgaccagttgtgctgtgcgcaacgtgataaagtagatgtacccaaagtaatcactccctatattggttggaattagctactaccattgtaagtgattgctttgggctttttaatttctgttcggattaattatagaatttgccattttaaaaaatttagtacggtactgatgagtgcaggagttctgttgggtgttttggcagcgccttttgtgggacatgcggatacgaaaaattctacgttaacggccaacgtttcacaagattctaatcatggatcacttagcttggtgcaggtaccagattttacctttcaatcacatatcgttaacaatggtacggccactggtacggctaataaaaatttaattgttaatgacgcaaccgactctgcttcaggttggactctttcggccaacttaaattcttttagttcggacaagaaagagtcgatgtttgatctcagtggcgtttatatgggactgtcacctaagttaaatactggtgccagttcgaagattggagctgagccagtggttgatgcgccaactttgaatgaaggtgctaccaatgggcctactgttgcttccgctgtcggtgctgcacaacataaggataaaaacggaaacgctgatggtattggtgcgggcgttggtcagtgggacattgcttttgctccaacaacattacatgctaagtttccaatgattgcagcaagctacagttctaccatcacttggacattaacttcagggccaacttcagatgtagctgcaacgccaactaagtaatatgaaaagaatactaaagctagttctcattgtattaatgtttgctgcgggtgtcttcagttttgacactatcacagcaaaggctgcagtcaatgattttcaggtgaaagcaattttgccatctaacaacaatcctcaatcgagttattttgatttaaaagtaaaaccgaatgctgaacagactttgcgtatatggataactaacaatagcagtaaacgacaattgtttaatgtgaagcccaataacgcaacgaccaattcgaacggggttattgattactccctgcaggcgaaaaaagatgcgtcagctactacatcattttctgacatgttaggtgatcaaacaggtaaacaggtttcggttgctggtaagagcagtgctacagtttcattcaaattgagaacaccaaagcagtcttttgatggaacagttctgggtgggtttatcatttattcggcaagcgctgctgagcaggctcaaaagagtaagcaaagtagcaatttagcgcactacgttattgcagctcggttagtagaatctactaaacagatcacaccagacttggtttaccacggtaccaaatacgtggggactaatggtttaccaagaattcaggttaatttacagaatacccaaccaaccattattggcgatgttcatcttaaagccactgtcactggagaaggtaataagaaggttgccaaagttgatcaaaaaatgttgaactttgcgcccaattctagttttgggtaccaaatacaaacgctgaataataaggcgcttaaatccggtcaatatcgtcttaacatgacggttaaaggtgataatggttcatggaaatttgataagttattcacggtttctgataaagatgacaaagcagctaagattgccaaacctggcattaactggaagcagattatcatgtggatcatcgaaggtctcgcagttctaatcgtgctgggctacatcattaatagattccgtaagtggatgaagaaagattaaccagttgacgtaagcctaatcacttgcgtcaaacttcaaaaaaacggtaaactcaaagttgttaagacttgagtttaccgttttttactataaaggaggacttggtatggctctcacagatacttatacactcagcaacgggactaagattccggttattggacttggcacttggcagacgccagatggcgatgttgcttatcaatcagtattagatgccttgaaagcaggctaccgtcatattgatacggctgccgcttatggtaacgaagaaagcgtcggtcgggcaatccacgattctggtgtgaaacgtgaagatttatttgtgaccacgaagttatggaatgccgatcacggttatgaaaaaacgaaacaggcaattggaacctctctatcaaaattaggtttagagtacgttgatctttacttgattcactggccaaatccagttgcttttcgtgataactgggaagaagctaatgctgagacttggaaagccatggaagaagcttacgaggaaggcttagtgaaggctatcggagtttcaaacttccgcccaaagcatctggatgccttgttgaagactgctaaaattgcgccaatggttaaccagattttcttgaatccatccgatttgcaaccaagcgttgtggaatataacaacgcacacgatattttatcagaagcatacagtccatttggaactggtaaaattttccagattgatgggttaaaagacattgccgaaaagtacaataagtctgtaccgcaattagttctgcgctggcacttacagcatgggttcctgccactgccaaagtctgtacacgctgaatatattaaggcgaatgctgacatctttgactttgaaattagtgaagatgacatgaagaaaattgacgggttccagggtgctgctggcttggcgacggatccggatacgacgtcgttttagaatttatgtttggaagagttcaaccttttggggatgggctcttttcttttacctagattagttgggttccagcaagcagagagctgcatgtaagggacagccacctaaaatccaagttcgggatttttggcgtccgtcccttacactccgctctctaagcgcttgcttccgcaccctgttttagttgggctccagcaagcagagacttgcgtctaagtcacttccggcataaatccaagcccgggatttttgccgaaagcgtcttagtctccagtctctagtcgcttgctttcacaccctcaatcttttacaattaacccaaacaacacgaggggtgtccctgctttttgctgggggctgagatgtgcttgcactatccctttgaacctgtaagttcagacttgcgaaggaacgtgttcaattcggaccagttttactggtgaagagtcgagctaacgttttgattagctcggcctttttcggtatctgactgttgtttgtactaaaattttgggaggattttccatgaaaatcgatttgctgaatcagattcgcgagaccaatcccgttgttcttaacatttcaaactttgtgaccgttcaggatgtggctaatggtattaatgctattggtgcgtcacccatcatgtccgaagaaattgccgaaactgatgaaatggtgggtatcagcaatgccgttgcgttgaaccttggtgccttttctaaaccgcaagtggaccatattcttgctatgggcaaagcggctaacgcacagcataaaccgttagtcattgatccagtggcagttggtgccatcagttaccgtaagaaagtcgcactagacctcatgaatcagttccaagtggatgttattcgtggtaatgctggtgaaattgccgctttggctgacgttgcctgggacgcgaagggcatcgatgccggttccggcaatcaagacgtggtggaaatcgctaaagcggctgctaagaagcagaactgcgtggtgatccttagtggcgccactgacatcattaccgatggcgaacacgttgccaaggtatttaacggcacaccgctattccagttacacgttggttctggtgacatgctcagcagtattgtgggtgccttttgtgcggtcagtgatggtgactattttgaagcggctcaaacggcttgcttagtctttgcctcaatcggtcagatcgttgctgatcagttgaaagaagaacggccaggtactttttctgctcgtttgatggacgaattgcatttagcaactgttgctgatattgaaaagattgcccaatttgactgaaaggtgtgacatttaagatggctgaggaagttaattcatttccacaaacactaacgattgcggggaccgactccggtggtggcgctggagtcatggccgatatcaagaccatgcaggaacgccacgttttcagtgccgcagtgattgtagccgttacagcgcaaaataccattggcgtgcaagatttcgctgcattgtctaaaaaattaatcgatgaacagttcgcgtcagtggctggtgatttaaaaatcaaagcctgcaagacaggcatgctggcggatgcggaacacgtggaaatcgtagttgagaatctgaaaaaatatgacttggggccgctgatcgtggatcccgtcatgattgctaaaggtggggcaccattattggctgatgatgcgattgataccgttaaacgtgatttgctgccattagcaaccgtcgtcacacccaatttgccagaggcggaacggctaactgatatggccatcaagacccctgaagatatgcaactggctgctaaaaagattcgtgcaacgggcgttaagaacgtcatgatcaagggtggtcacggggacaccgataaagtgactgattatgttctactggaaaatggtaaagaattctggctcagcgcacctcgagttgacaccgttcggactcatggtactggcgatacactgtctagtgccatgacggcggagattgctaagggccatgacattgaatcggctattcgggtggcgaaagacttcgttgaagcagccattcgtaacaccatccaagttggtcacggccacggtccactaaatcactgggcttacggagaggagcgtccgggcaaatgaaattcaaaccagaaatgttaaaggcttacttcgtctgcggatctcaagatgtacctgaaggcctgttcgagactatcgtagaacaggcaattaaagcgggtatcacagcttttcaatttcgtgataagggcaacgcttcaaccttgtcaccaattgaccgcgctgccatggccatgaaactacgtggtcgttgtgctgaagccgggattccgtttatagtggatgataacgttgagttggctaagcaggtcaatgctgatgggattcacgtgggccaatccgatgaaaagattcagcaggttgttgctgaagttggtgatcagatgattgtgggactatcttgttcaaatgctaaagaggttgaggctgctaactctattgatggcatcgattattacggtagtggtccgattcacccaacggggtctaaggcggatgctgatccggtaattgggtttgatggtctaaagcagttagtcagtctaactgatcggccaatcgttgctattggtgggattaccgttgatgatttgagtaatgtaatcaaggcgggggcttcaggttccgctgtgatttcgatgattgcacaaagtgatgatattgatggtgttgtgaaagcgatgctggaagcttaaagagggatatttaaatagataatatcctatttgcatttttgatgtatatcctatcagtcaatatataattacactactgttagtaaagcatgattacattccaataaattgtgtatttctttttgtcccttataatactataatcaagtcgaatctaattactattatgaggggagtcatttttaatgacgaagaatgtttggaaaaaggctgcaacagttgtattaggggcaacattagttggtggcgtgtttgtggaaatccctaacgctgtgacaacaacacaggcgcaggcatcgtcagaaattccgtattcacaatatcaaagtgatatcagtggtgtgaagggtgccttggggaaggcttcaacggatgttcaaggcgatgttactaacgattttccagatcctaacgatcaagatgcttatttggagaatggcagttttgacgtttacttgaataatcttggttttgatattgagcttgatacagatactaaggaacaggcgattgaaaatcttagtgcccttgtcgctacctacaatgttttcaagaatagactttccgttggcgaacagagtcaactggagtctatggctaataaaatcaatggagaaatagcaaattacgatggtataattgccgatattactgtaaatttagagggctatgctgatgcattagacagtgccgtattgaattacggtaataattttggtggggttgcttccaaaccaaagaccgtcactaggaagataactaccagaaaagcccctgctaaaaagagctacatctccaaactatccgttaaaaaagtctcaaaaaagtatgttaaagtcactggttcagctaaactttataagtcagctaagtacgttcgcgttaatacctacaagggtaataaatatgctaagttaagcagtaagcacaactttagcaagtcggtatacgcaccaaaggctaaaacagtgaaggtaactgttggtaattatagtcatggtcattttagttctgttactagcaccaaaacagtgcacgttaagtaatttaaattgcatataggttcgctcaatcggatttggttgagcacgttcaaaagggtgacttgaaaaagccgcccttttttgactgcctaatataaatcaccaccacatttatgattgacaacatagctcgttggtcttaagctatccccaataaaatgagttaggggtgtcgacatggcaaaaccaatcattggtattccggctgaacgacggctggttggcgattcgtaccgcaatactgttaatcaaaaagaggtggccgcagttgtgaaagctggcggtgtgcccgtaataattccaactcgggaaccagatttggcagctgaatatagtgaactgattgatggattattgctaccaggcgggccggatgtggcacctcgtttcttcggtgaagaaccaataccgcagatggatgaagctgatgatcttttggatgcgactgaaattacactgactaatttagcagttgctgctaggaagccgattttaggtatctgtcgtggtgcacaagttgttaacattgcattgggtggtgacatctatcaggatattgccacgcaaattgatcatcaaacttatcagcaccatcaaaaggcgccgtctgatcaggggtcgcactatgttgatatcgcggaagggtcgatgttgcagaccattttccacggccagtcgcgtgtgctagtcaatagtttccaccatcaatcagttcggaagttagcaccgcagctaaaagtcactgcgactgctggtgatggtgttattgaagccgttgaaagtaaggataacgatttaattttagcggttcaatggcacccagagctgttgtataaggtaaatgcggatgaattcgcaattattgaagctttcgttaatcggtcaaaaaagtatcagaatagtgaagcagcttggagttgattccaggctgttttttaattttttcttgttggattgcgtagttaatagaacaaccttagttaacggtcatcattgtgggatgaattgttcgaacaattcatcccacaatgatatactaacccttagaaaggactgagtactatggtaaatatcatgccggtttcagagttgaaaaattacggtaaagtgttagatacagtagagccagataaccccgtttttttgactaaaaatggttacggcaagtatgttgtcattgatttggctgattacgaagcttttgagaaattcaagaaaagtaagcaattggctcaaattttaaaacaggccgaaaaaagtggcactcggcctctggatgaggttgctacggaattgctgaagtagttgacctatcagttagtgattataaatgatgcgacattagatttgtgtttaatacaagaatacttaactaagcgttggaagaatgactgtgcatgaaaacgcacagtcttttaattttctgcacattaaaaatatctaatcgttatatcgtttcacaaaattgcactttacgctgttttggtagataatgaaagcggtaacaaaataacaggaggccttgattatgagtaaagtctatttatcagctcaattaccagaagtggcaactcaacaactgaaaagcgctgggttggatgtcagtgtttacgagggcgacggtttgatctcacacgacgaattactgaaaaacgtcagtgatatcgatttcttgatcacaccattgtcaacaaaagtagataaagaaatcattgatgccgcaccaaagctgaagttgatcgctaactttggggcaggtttcaataacattgataccgcttatgccaaagaaaagggtattccagtgacgaacacaccagcagtttcgactaacgctgttgctgaagtcactattggcctgatgctagcactgagccaccgagttgttgaaggtgatcaaaagatgcgtaatgaaggcttccctgggtgggcaccactgtactttttgggtcatgaaattgctgggaagacattgggtatcttcggacttggtaacattgggagcgatgttgcgcggaaggctaatgcactgggcatgaacgttcagtactacaagccaaaccgtctgtcagatccagaagagcgttccatgaaagtgacttacaagcctttggatgaattgattaagaccagtgactttatcaccatcaacgcacctcaaacacctgatacactgcacaaatttgatgcagctgcctttaaagcaatgaagaagacggcttatatcgttaacgttggtcgtggaccaatcgttgatgaagcagccttgctggatgctttgaagtccggcgaaattgctggcgccgctttggatgtttacgaaaaagagccaaaggttgatgacggcttcaagtcattgaagaacgttatcctgacacctcatgttgggaacgctaccgttgaagcacgtgacgccatggctaacattgtagctggcaacgttgtattggttgacagtggcaaagacgctaaattcgtggtcaataaataaacatttttcgcaccactcctcgcttggacgcgctcaccaagaaaaaagtcttgtattttaatgaaattaaagtacaatgagaatataataatacttcacagagagctggagaaggctggaaaccggcagtattaatatggcagaaacacttggttgcgcaaccaatatcagcgattagaggcagttcaataggaactgtgaacttgggtggaacagcgttacgacgccccttggtactcagatagtgagtgctaaggggcgtcgtttttgcgttcagaagaggagtttgttatgaaaaataaggatcaaaatttatcacgctcgttgcaaagcaggcatattcaaatgattgccatcggtggcgcgattggaaccggactgtttctgggatcagggagtgccattcacacgtctgggccatccattattctggcgtacttgattgtcggtctgttctgtttctttatgatgcgggccattggtgaactgttaatgtccgacacaagcaaacactccttcttggacttcgttagtcagtatctgggtgatcggatggaattcgtcactggctggctgtactggttctgctggattagtttggctatggcggatttaaccgctactggaatttacattaagttctggttcccatcggtaccgcaatggatagcgccgtttgtgatccttatcttcctgtacttcactaaccgaatcaacgtgaaggcttttggggaaatggaatcgtggttctccatgattaaagtggctgccattattgtgttggtcgttgtggggttcgcactagcaatcctgcacactaaagtggatggtcagacggcttcattcagtaacttagtcagtcatggtggtttcttcccaacgggtggttacggcttcctgatggcgtttcaaatggtggtctttgcctttgttgggattgaaatggtggggctgaccgctggtgaaaccaatgatccagtggctaacctaccgaaagccatcaacagcttgccaatcagaattgggttgttctacgtagggtctatgattgccattatgagtgtttatccctggaacaaaatcaccacaactgccagtcccttcgtgcaggtgttctctggaattgggattgctggtgctgctggcattctcaacttcgtggttctaactgcagcattatcggctaccaacagttgtttatttagtactagccggacgctacacgctcttagttggggtggtaacgcgccaaaagggctggcaaagctcaataagagcggcgtgccaactaattcactgaacttttcggctttagtactcttaatcattgttgtgctgaactacttgatgccggccagcgtatttacaatgatttctggtgtttccaccattaacttcgtactggtttgggtgattttgatctggtgccatattcgttatcggcgcgtccatcccgaaggcgcgcaaactttccggatgccaggttacccctttacggactggatcagccttgtgttctttgtgggtgtgttaattttcttactgatcaacggttctacacgaatttccatgattatttcgatggcagtcttcttagtaatgttgggtgtttacgagctgatttaccgaccaaaacgtcaggttcatgcttccaagtagttgcaagtctcgcgaaaaaatgacactatattaaagtgattcagtcagtacttaacggcataagtaataacgaaggagaatcaattttgattaaacacattttttccgatatggacggtacattgcttaaccagcatggcaaagtttctgctgggaatacgacggccattcaacaggccggtattccgtttacgttggtttcggcccgctcaccacgacaaatgatgaacgccatcgaaacactgaaactaactgcaccacagattggttttaacggtggcttgatttaccaggtgaaagacggacagttgcaggtcatcgaagactcaccagtggactctggggtggctaaacgagtcgtggatttggtggaagccaagttcccaggtaccggtattagcctgtttggtttaacggactggcaagtgacccatatggacgacggtgtagctttctttcaagaagatatgccgcaaaagccaacggtgcttgaccctgtaactttctgggagcagccgaagccaatctataaaatgaccttttgcgttttgaatcgtgatgtcatggatggcattgttaaaattttgtatgaagctgatctgccaggagtggcgatgcaaaaatccagcgatatttatttagatatcacggcaataacggctaaaaagtcacgtggcgtaaactacattgctcagcgtgaacagctggatctaagtgaaacggctgcgtttggtgatggtcccaacgatattccaatgttaaaattagtaggtatgccaatcgttatggcgaacggattaccggatgtgaagcaagttgcccgtttcttaaccactgataatgaccatgctggtgtcgggcaaggaattgagaagtttattttagaaaattaaaatggttgtacgcaaaaaacacagtcaattaccagttggtagtgaccgtgttttttgatgacttaacttaatcctctggaactcgtttagtaattagtacaatttcaattcgttgcgggacctgattgtgaaaacctacgatagcgtctttgttagcgtgattgctgggacgccatcttcttcgtaaggttctgacgatacttgatagccttgacgctcatagaagcccttagctgtcatttcactgtggataacggatttggtataaccgtgagcgaggccgtattcttccaaggccttaatgatttgagcaccgaggtgttgtcctcggtactcttttagggtggcaattcggcctggtcgcatagtagtgtcatcaacggtttgaaaacggccggtagctactggctgcccatcgtccgagtatgcaactacgtaaacgcggtctgattcatcgttgtcgtcaaactcgtcttccatggcgatggtgcgttccaaaacgaacacgttcatgcgaacgtaaagtgcagcggcgtggttccagggttctgatccagtgtgaaatttcataggtatgtactccttataggtattagtgtctcctagtatacctttatttgagttattgtttaagagccatttcgctacgccgggcgggcaggtcgaagtgggtcgtggtgaagctagcaccttcgcttcgctcggggcggatctccaccatctcccatgtcactaaactaccaaagaacggtagtcaagtgacatcgacaccacgacctgcccacccggatccgctgcatacttttatatagcgtttggtagccagatttgcgtcagcaacacttcggtttagttgattgaatggagtgagttcaatgcagtgagttcaatgcagtgtagtgaaactggcaaatcgtggtgaaagtagtggttagtgagtgttatttgctcacttaccactacgggagatgtaggaaatcctttttcggtgaattgtccgaaaaatagttccgtagcgaccccacgacgagttgccggtttcacgaaacggaatgcaattaaagtctatctcaagtctttcaaaaatctttagaggcaaataaaaacccgcagctctaaagtctgcgggtaatttacgtaacgacaggggatgtacgttacgtcgttgttgtccttagctatttgggagaataggaagaaggatttagaaatgtttcaggttgcaggggatgtaacctgaaacgaggggaatgtaactgtcgcaagggaatgtggcagttacttgctttcaaaagaaagtggtttttagggaaaatggaacgatcaggggagatcgtttcagtggtacaaggattaatatactgtgatgagcttaaacgtaacttaaaattgattttaagttgaagaatttctcttcggcttagaaatttcttacgatttgcgtatttaataccataaaggccagtaattcgttaaacttgatactgggttgttaattgaaacaggtagcacacttgccccaaccccttaaactatgattaaataccagtaaaccactattagtatggaggtaaaaatgagcagtattttatccgtgcagaatttaaataaaagttttggcaacaagcacgtcctgcacgatgtctcgtttgatttgaaaccgggacatatcgtggggcttgttggcccaaatggtgccggaaaatcgaccttgatgaaaactatgctgggcctatttaattatgactcaggcagcatcaagattgcgggagaaacggtaacaccgcagaagcatgaatcactgtccaaggttggtgcactgattgagtatcctgggatttatcctttcttaaccggctgggatcatcttcaactgtttgcagatggtgatcatcaactgattcatattcaaaagattatttcccaattaaatatggatagttttattaaacggaaggctaaaggttattccttgggcatgaagcagaaattaggcattgcgttggcattggtcaattttcctgaattagtcattcttgatgaacctatgaatggtttggatccagaagcgaccaaggaattacgcgatttgattatttctgaatctcaacatggcacaacctttcttatctcatcgcatattttgagtgaactgcagcggttggcccaagatctgttgattattgatgaggggcgaatcgtgcaacagacgaccatgcatgaattattagcttcgcagggcaaacagaccattatgttgatgaccagcgatgataagaaaacccgtcagttactgaaaaaggctaggtttaaaaccacacctgatccacgagtggaagtggtggcgacggatgataacacgatgcctgaagtgttgcggctgcttgttgaaggtggcgttgatattctggacgtgactcgccttgaaggtaacctcgaaagttccttgctggaagttttgaaacagagtcgaatccagaaaagattagccgaagaagaggcagaatagggggtgcgaggacagtgtggactttagttagacaggaaagttttaaattaaccagaagagttagtacttgggtcagtacggcgtttttagttggtattgaaatcgtatttgcctttttatcccgggtatacccgcaaacctttgttccagccaacatgtttgagtcgctttatttttcgcggccaatcatcaacttctatatgattgctgcaacggccacaatcatcaccatggagtttcagtacggtacgatgaaacaggtgctttatcggcgttattcgcgaggacaagttctggtcagcaaatggctagcaatttttctttataccctttattggtacgtgatgagtactgggattgcgctattgatgaaagcattgcttttccggcatacgctgagtattcatcaaggtgcgggagatggcatgtcgatttttaccagagggttagcaatctcggcagctagttttgtgagtttatggctattattgagcgtcgtttttttgttagcgaacttatttagaaattccgccgctgctgtgtcagtcggtattattggttactttgcttccaacattgtgacccaattgttaacgatcctgattcaaaagtgggattgggctaagtggaatccagtgaccatgaccttgtatccaagcatgttatcgcatccgggttattatcagccactactaaggatgcagggctggcagatgttacttgggaacgttatttatatcgccattttcttgggtatcggctactacgtgtttaataagcggaatgtttagggatgctaaggtgtgtaatgtgttcacgtgtgataatggggggtcctaaatttgaatgaaaacgaattaaatcctaatttgagtgccaaagaggtcgaagatattcatgctttcattaatcagtttcgaccactgttactgcaacttaagggtcggtaatgttgtttaggcataacaaaacctcacaaccagaagttactgctggttgtgaggctttttgtctttattagtttatattgctgaaacgtgttccagcaagcagggacttatgtgtaagctactcccaacacaaatccaaacccgggatttccgttggaagtagcttacacgccagtccctaaacgcttgcttccacactctaagcctctattgccaaaacgtgttccagcaggcagagagctgcatgtaagtcacttctggcacaaatccaagttcgggatttataccaaaagcgccttacactccgctctctaaccgcctgcttccacactctacaaccttgacctctccatatcactctccatccgatagaccaacttttcaaacagtcgcctcaacggcatgatgagcgtgaagaacaagatgaagaagaacaagaacagcagatcgtggccaattacgccccaatttggcgtcgtcatgacctccctgaagagctgcatggcatacgtaaacggcatgaacggtgccaacgccgccaaatcttttggcacgacttccaggggatacatgccgccagttccaaacagctggatcagcatcatcaagacgatgaccactttaccggcattccccagcataaagactaggttgaacatgatgatggcgaaggtgaagctggcaacgtagaacgctagcaggaacaagaaccagtgcaccggtctgacccccaggatgatttcgcccatccaagcgaaggttgcttgcgcgaagcccatccccagatacagtggcagtttgccaaggtaagattgtaaatggtttggtcgctgcaggccattcttactttctggcaagatatactcccatgccaggatagtggacatcaagagcatgcccacccacagtgccaatacggtgtagaacggggtaacctgccagccgaagttcttcatcggataaacttctttggtttgcagcttgattggtgaagagaggattgacgatagacttggatccgtgcctaacagcttgatcaagttatccaggttcttaccattcaaaaaactcatctgtttgtccagtgtctgcaaggtccctttgattttatccaaacgggagttgatgtcgctggtttgcgaagcggtgatggaaccggcatcagccattgcccgaagctctggaatcactgaccgcatggactgaacgacttggctgttaccgtttaaattgtcgttcagcgaattattcaaactgtttagcgcaggactggtagtggcattgaagttcgtataagccgtatcgagtgccgtattcagcgtgttagaggccgcttgcagttctttgatcagcgactgctgtttcgaagtggaatgggtgccacgaagttgactgactagtgacttttgacgatcaacgctttgcttagccttcgcaacggaactgatcagcgcgttagtccggttattaggcacaaagttattgacgatgtccaagatgcgcaaagtatcactcaggctatcattgatgccattcaacagcgaagtagctgaactagtcgtactctttaacgtggttgaggaaagatgaccggatggtagaccattaaagctgttttgcagccgggtaccttgagtctgtagactgttaataccactgcctaaattagattgcagggattggtttaactgctgggtggcattgttgatagcttttgtgttattaactaccgactgcaagtcatcaatttgcgaggaaatctttggtaagtccgacttcatcgtttgcagtgccgctcgggttttctgattcgtttggttcacatcgttgagtgttttttccgtcttgttgatggtactaatggcgtcagttagagatgaactgatttgtagaatctccggctttttggttgcaagggtagcaccagccttattggcagtttggagggcttccttactggccgttttgatgaagctctgacggatgttatcggtcagactgttctccgcttgtccaatgatcttagtagcggcaggatttagcttttcgtttgatttataaatgatggctggtttttgcgggttagacgttgcaaaggtggttaatttagatgaaaagtcatcgggaatttcaatcatcgcatagtatttaccattttcgagaccattgttggccgaccaatcattggtgaatacccagtgaatgtcatggtttttatgcagttgcttgatcacttgattcccaacgttgaatggttggctcttgagtgaggcaccctcgtcgttgttcaccaccgcaatttttagccggctcgtattcttcggtgagtacgggttccacgatacctgaatgttgaggaccgcgtacagcattggaataagggcaaatgccagtaaagtcacccaaatcgaccgggtatgaaagatattataaaagtcttttttaatcaggttgaaaacgttacgcatattgtcctccggtagttagtttgataaatgcagtttctagttgctttgctggctttcggcaaagcccataaggagaccctgatgaaatcccacggcaggacacatcagagtctcttttggattattagcctttgagctggtcaagtacgccattaatcaaggttgttaaattcgtgttgacgttatgcaaaatttgcgtggtgttatatagattgttgataccgttagaaacatcactttgaatcagtgtgatgatctgaccgagtttagtaatgtctgaattgttattaaggctgctctgcagtttggttaaattattgatcaaagttggcagcgtggtattgttgttgactgagtttaatagtgaaacaatctggtcgtgggtcttagtagacgtagaatcgatcaaatctaccagttcgtttagctggctcaactgtttttgagtatcgacaacgcgaacgagatgaccgcgccaaatccagcccttaactttaccgttggcatttttaacgtagtagtaaacggccttattaccattagcttttcgcacggtgtcagatttataggtgtagaacaatgtgaaaggatagttatcagcgttgtgggctttctttgtcagactagtgctggtataaagatagccgctaacggcgtgatagggtttctttgaaatggatcgtgatgagatcaccttagcacctttactcttggcagctgccggtgtgctaacaccgaaagcagtgaacaggccagcaaataatgcgatgatcaaaaatggtttcttcattttaagcaaactccttatataaattaatatcggtttgagaccgtttaaacgatttatctgacagttgtcagcaaacgtttaatttgaaaatagtataacatcaaatcggccaaaatcctgtaaacgaaatgaaacaactacttgaatagtcaaaaagattaaaaacgtgaccgtttgcctgtcgcttattctcctatattttagtacaatttacggtagaatgtattgtttcttaaaactgtagtgatgttcagtatcattctaccagtgcttgaaatcagccagtttctcccctaaaattagtaacagtatgccaagttccatttggccgaagcgtagtcaacagaaggatggtttaaatggaaaacatcaaagcaatctatcagcgtgatttaaaagccatgatctcatcgccgcttgtaatggttacaatattggcgctgtgcatcatgcctagcctttacacgttgatcaacgtccgggccgtctggaacccgtatgacgtttctgaaatcaaaaatatcccggtggcggttgtcaaccacgataccggtgctaacatggcaggacagaagcttaacgttggtgacaccgttgtgcagacgttaaaaaaagaccatcagttaaactggcagtttgcttcggctgaaaaggccgataccaagctcaaagagggtagatactacgcggaaattattattccaagtaatttctcgaagtccttgtccagtattgcaggcgatgatccgcatcgagccaaactcatttataaggcgaatagccgagatgcgcccatgggtggcaagatcaccgaaacggccgctaaaacgctggttaatcaagtccagactaattttctgcaaaccgtcaatacgactttattctctaagctgaatgtgctgggggacaaggctaagagtcagcagggacagatcttggaactgaaggattggatcatcgcgttaagtgattccatggatctcgccactggcgcattaggagaagttaatcatacctctactaatatggaagctattttaaccggattgaagccggtgatgtcagcttcgcaaaacgtggacgtgttgcagcagagtaactcggctacaatgtcatctctgcacagtgttcaaggttcggtggataaggcctttaacagtctggacactaacctcaatagtgcatcggctagtgccaaccgtttgaatagtatggttaatcaactgaatcggtcggccagttccaccaacaaaagtgccgtgaacgacatgctgaaccgggccatttctcaggtcaacctgttgaaagggcaggtaacaccgctgcagtcattcctcaagagtatcaatggtcaatcgcatttgtccgccatcagtgggctgaatgacagccttggtaacgtggtgtccttgctgaataccgaaaaatcacagctgcaatctttgaagtccacgctggctagtcaagggcgactgacttcgggtgaaattgctagtgcagccaacaacacccgtcgaatcacggtggggatgaattcggcactggggcagtataaccgctccgtcaaaacgcatttggacagcattagtggcagtttaatctcggcggtatcaaagtcacagtcgattcttagtgaacttaagcaggctaagggaatcaatgaagactatctgaacaacgcgattcaaggcaatcagctgattgcacaaagcagctctaatctagaaagtaaattgactacctatcaagatgacattcaaaacattgctaaccagttgaagctgactagtaataacgacattgttagcgttatcacagttttacagaataatcccaagaccatggggaatacgctggtgtcgttatttaacgttaaggatcaaagcatttaccgcgttggtacttttggggcggccttcttaccgacttacatcaccctgtcgatttggattggctgtaccatgctggtcatgattctgcacaccacgattccccgtgaaaaacggcggttccataacatgaccgttcacgaagagttctgtggcaaaatgctgacctttgggacgttatcaatgattcaaaccatggtcatcatcttcagttcgattattttgcttcgtgttcaagtagaaagcgtctttatcatgctgctttttggggtgctgtcgtcgttgctgttcacgggcattgtctacggactagctgcgacctttggtaatctcgggaaggccattgtcatcttcctggtggcgattcagctggcgggatctggtgcgctgtatcccgttcagcttgatccagcattctatcgtttcgcttaccgctttgcaccgttcgcttacagtgtgggtggtttccgtgaagcggtgggtggaccaaacatgcaaacggtctttattgatgcaatcgtattgatactgatgtttattggtgtcttcttgctgggattcttcctgaaaattaaagcgcagaactttactcgtcgcatcctgtcagactttagtcggactgggattggccaatagaatattgattgtgagccttaggatagttttcctaaggctcttttgatatgtgcgatatttatgtcgccttcggccgctggtggattcgttgctgtggggaccggtgaaagcctgagaagcggtctttcacctcgcatccaagccacgcctaacccgcgtgtctcggatgtcgtcccgtgctgtaagggcatccgccctaacagcaccgtcacagcagatgaatccaccagcgcccttcggctacggtgaggatgatatttttggagttagcgctttgtaatatccctaaaaaagaacttaatttcgaatcaaaattcaattcaaggcgaaacatcaagtggattacgacatacgcattttaatgcaaaaaagttattgaaatgcatattactatatagtaatatttaaatttgagatgaaactaatcctattaattaggcatttacatgagaaaaacgttagaagtagctaattttattaatgaataatgcatatttaatacacattttaactactgtaatgagagcgcttttaccgagttctcattaaattattgaggtgttacttgattttatcaggctttattagaagtatatcatataagtctggtaaatctggggaaaactcattaattttttatctcactgctttcgtcatttgtattcagtggatttagtttttatctcgttgtttttgtagcggaacgtgacatttttgttaatttgtaggcatttgagtgaggggcgggtgatgatggatgaagcgatggcggttactaatgctaagttgcttaatgccgttgatggcgggtttagggataatggcgaatcgaccactgaccggttttgcggcagtatcggttcgggtacagttacctgaaaatgttcgggcaacgggccaatcggtgacgatgagggtttatgaactcgatcgtcgggttcagcaaaaatctaattggcatgcattacagcaacaagtagctgaaaaaccgccaatggcaattaatcaatatgtcaggcagaatcatttgaaggcgttagcagcagttagtggacaagcagaggttaagtttggcggacggtctggacgagcttatttactggtacaggataccaagctacagccgtttgtgtcacagagctgggtgcaaccgctaatgctaaaagttacggatcagatggaaacactggatgcaaaagggacttccattgctgagcgaccctatttttataagtatggaaccaaaaccaacggggcaacgcatcccttagccggcgcacaatttgttctgacccagcaggtagctggtcagttgttgtacctgactaagaacgggggttggagcagcattagaagcgagtcgtctattcagcggtttacttcggataaagaaggactggtccgctatgacgggccgacactttcgcctggggactatgaatttcgtgaggtagatgcgcctaagggatacgaaattagccaggcagcggaacacgttaacgtgcatattcccgctaacggaaaaatccaggtgcaagggactgcacttgaatcactggttgctggtcgtgtgccgaagatagttactacacaaaggtcgcttcgggtttacaatccgcagcaattggctaccggtaattctgaaacggatgataaaagcgtcaacggtgggacgaataacggacaggctattgtttcaacccacgataacgataaacgaacgcggtcgtcgaaacggaaacagccgttttggctgccgcaaacgaatgaagaacgaacaacgtttgctgttgtgggcgggttgatcatactggccgcaacaggattgctacgtcactacaggcacacatacacttccaaaaaggagcgttaggattaaatgaataaattaagacatatttttgcggcactattattggtattaccgttggcgtttactgggttaacaagtatgcccagcgctaaggccgctagcaatgaaacggcatatattcgactacacaagttagcttttagttcagatcagacactaccagatttaccaggcagcgatgatttattaggtaaagaattatccggtgatcagcttcagggtgggaaaccactgaacggggttgagtttaccgtttatgacgtcactaacagctatcagcatctatctggtacttcggctgaacgtcaaaagaacattcaagatcacgcagttaaggctgcagctggtgggtatcaactcggcgattcccaagttactaaaggaaagggaacagctgattttgctttaccagtgaaaagtacgcatgaaactggtaagaatgcggtgtacttgattcgcgaaaccaaatcgatttctgaagagattaatgataaccagtcagttgtgaagaccgctgacccaatcgttttggtgatgccacttaaccaagcaagcaccaaaggtaacccactgcacatctatcctaaaaaccagactaaaaagacgttgacgaaagatttaaacaagcttgatagtctcgacaaaattattgataaaaaacattcaaatattaccgatgccgttttaggctatggggatgaagttagctatacggtaagcgttgtcgtgccagcagatatcacttctttggataaatttgatgtcactgataccccagatgccggtttgaagattgatacttccagtattctgatccatggcgagcagtctagtgtaactgtgccaggttggcagtttacaccagcccctgatggttcaccgaagtttacaattaattttgatacgtcaaaactggctgactatgcaggtaaaaccattttgatcacctacaacgcaactgttaataaaaaatttgaaccaggaacaacgattaacaaccatatttccttgaacaaccagcctaaagttcacggaaccacgccaattacaacgggtggtgcgaagtttgaaaagacggatgctgataccggtaacgggttaaagggtgcagaattcttggtcactagcaaggatggtaaacaatacctgattgatactggtaagggttacgaatggaaagaactaccagctaattttaatgctgagagttacgaccctgcagcgttggataagactgcagttgtgcttacttcaggtaaaaacggtgatttcgaagttacaggactaggcttcggggattattcattaaccgaggtaaaagcacctgaaggacatgcgctattaactgagccacaaacatttaaggtggacaaggattcttacgatgaagatcacgttatcaaaattgctaatgctgcagagggtgttttaccacacactggtggtatggggatttacgtgatcatgatcgttggtgcagtcatcatcgctgcaggtattttcttccttaagcgcaacaaacgacacgaagaaatttagatagtcatctaagtaaaaggggggattaattgtgcctaattcaaagccacgtaaatcacggtttactgtgacacacatcattggcagtctactactgatgttgggtgtggccgttgcactataccccttttacattgggtctctgaatgatttgctggaccagcagcgagtggctaaagttcaacgtgaaaatgagggtaatgctaagcaacgtctagccgatttgaagcgtgaaaatactgctgagactagcggtaccaacagtgatccattctctggcttaagtaaaaaggcgaccctcaatttaaagcatgatatggttggcacggtcacggttcctaagctggcacttactgtaccgatgtttaagacgttgaatgatgcgtctttagaagttggatccgctgtggtgccggggtcatctatgccaacgggtggacgaagcactcacacggtggttgctggacaccgtggcttggtggacagacggctattctctgatctgaaccgggttaaaaagggcgatcttttcgttttcaaaatctatggcaaacatttggcctatcgcgtgttccagatacaggttgttgaacccaccgacacgagtactttgagaattaagcctgggcaagatatcgcaacgttgctgacctgcacgccgtatatgatcaactcgcaccgactgcttatcaccggcaagcgggttgcctatacgccaacagtcgcaaaggatgtcagtcacgctaaacaggctgaacgatggcagcaattggcaattttaattggctgtacgcttgctatccttgctgtgctttggctgatgatgcgtcagatttatcggtcaatgctgaaacgacgaaactttcggcttcaatttcagtgtgtcgatgcagctggtcagccagctgagggtcaaacctttagcttgcgtaagcgtaatggcaagacgctgtatcgtgatggtcagccattgatggtgacttctgatggcgatggtaactgtttgattgaaaacttaccgggtgcgctttatcggttagtttggaatgatcagtcaacagcttattttcgggttggggttaaacggcttaaacagtctgaaatggcgttttacccatctaaacgacaggctgagattgttagtcaacaagagggtcaatggcggattttagtagatcgttaaattagtatttgaaggatttcgagggatagtttccttgaaatccttttttagttgaccgctttcggctgccagccagttcattgctgtgggaaccggctcgcatccaagtcacgcccaggaccgcgcgtcttggatgtcgtcccgtgctgtaaacagcaccttcacagcagatgaactggctggcgacctgcagctaagtttgagaaaacgaatctaaaaaggcttcaacccatctaaaggttgaagtcttgatctgcatccttaatattctgttcatttaatttgagggttttgatacgttgctttaaggctgattcgctgtagtgggcaatgatgttttcaaacggtgttaaatcacctgaaacgcgggaagtttctagcgcattcatgtaagctgaacgttcttgaacatctggttgaatattaacgatagggtatccggcctgtgtgagtgccatgttcattagtaatcgcgcagttcgaccattgccatcttcaaaaggatgaattgatacgaatttttcatgaagatcagcagcgtattggacaggatgtaatttaatttgagctttttttgaccatttaattaaatcgtccatcgctggctgaatttcaaaaggatcgacatatggatgatttagtagtccatttggccaaactgaaatagcgcggtaacgacctgatgaggccatatctttagccgttttagcagttacaaaacgattgaggtcacgaatgacgcgctgtgttaaggcctgtttacgactaaccagatccatcatgtagttgtaagcgtcattcaaatctaaggtttctaatacatctttgatgggggtaccctgagaagttagcccagtttgtaaaattgacgttgtttcatatttctttagtgtattaccttcaatagcgttggaggactaaacgtgttcgtaacgtgtttgagcgtctagaatttcaacttgttttttggaaagcggctgaaagttgtccctttgttcctttaagcctgtcaattcattttgtattctttttaagagtgtcaaagtttcaccttcctcacaacctagtaaactatctaaactgtactgaatgtatagagcaaaagcaatttataatgatattgagaggaagcagtgagacacaacaaaaagagcctaaagtaagattatcttactctagactccaagttaattcatatgtttaaacttcttgcttaacattaggcaacgtttcaaacttttcacggatgaagccggctgattcggccaatttctgttcttcctcatcagtgattggcagacgcaatgcttctacgacaccgtctttaccgatgatggcaggatgaccaacgtaggtgttgtacttgtcactgtagcatgagcaagggcaagccaggttggcatcatccaaaacagcacggcttaatttaacggcgcaggttgcaatggcgtagctggtataacctttgcctgagtgaacggcccagccaccaccacgtgcttgagtttcaagatcttcaaggtcgagacccttttcttcggctaattcttcaattggtaagccgttaactgaaacggtagaccaagcgacaaattgagattcaccgtgttcgcctaaagtgtagccagtaacgtttttggcatcaacgttgaagttttcacccacgactttttgcatccgagcggtatccaggaaggtcccagtaccaagaacacggttagctggtaagccggtagcttgttgcaggtagtaagtgatacagtcacaaggattcatgacgtcgattaaaacaccgttaaagccggatgctttgatcttaggtgcgatatcttgcacaatttcacgggtatattcaaattcagcccaacggttgccactggcatgatccaaggcatgaatattaccagaagtaacgaataaaatatcagtatcagctaattctgaataatcgttgatcttgattgtcgtgtgagaatcgagacgagcttgcgaatcctgtaagtctaattgttcagcacgtgcctttttctcatttttatcgattaaaattaattcatcagcaattccttgacacaccagcgtataagcgactgttgctccaacgtgtccgaccccgataattgcgtattttctcatatgtattgccttcttctcataagtttttaatatgtgttgatggcactaagataccagttcattgttgcgttgtcaacagtgtattcatgaataatggatgctgaaatgcaattaagcttgttatatcggggcttacacgctataaaaaattgctcaataattattaaagactatctgggggactgtttaatttgaaatgagaaagtatgaagatcactacctacttcagttgacgatttatgggatatgttccaattcttttgattcacaaaaaaacagtataccgtatgatatactgttacagcaggagttccatgggtggtggtgtcaattgcgaaagtgagtgatgcctatgatttacgaaatttacaaaggaattagattgtgtcagtttacgacacattatcactaatgattgctttcgcaacgttggtggtactaatcgaccgtagagaccgtaagtaagaagccacccctatataaactttggcgagtttaaggtgacttttactgttaaccgtagcttaccaccgctcttgaagcggtctgcaggaggccggtgttcaagcgctggcctctttttatgattctattatatcatattctaattaccagaataaaataaacagtctgtaagaaaaaagccgcatgatcaacagatcatacgacttttatatttagggcggtatgtgggactcgaacccacgcgtgccggaaccacaatccggtgtgttaaccaaacttcaccaataccgccatcacaacaataaccatcataccatagaattggtgaagttgaaaagtaaaatttaattattttgcggatgcgtcattatttttgtctgtgtcatcgtcttgaatcatgcgcaatgctttttgatattcgttaactgactgtgaaaatggttcccagaattgtggtgtaaccgtaccggctttacgcagttcgacgccgagcgcagtcggtacgaggtcgacgtcatcaccctcgttgagttcaagctgtttcacaaattcatcgggtatcttcagatacagttcaccattttcgttgcgttgaattttttctgactgagcgtccatgatgccggcccctttctgctttgttgattttagctacattatacggcaaaacagtggtggtgggtatagttggagacaattgttttggggaaacttatcgagatgagtgaaagtgttaacacacgggcagtgtaggggtgtatgagtaggctaacttgttttctcattgcagtctgcttgctttcacatgttgttatgttacactacggttatcctgaaagtgatcgagtacgatatcgtgttgtgaaacttccttgaatttgcaaagggggcaatggtcgtggctaaacgctacgttattaccaagccagacgagcacattgtacaccggacggatagcctgcaaacggttacccaaattactaagcgcccaaagtgggtcgtggaacagtatgtaaatagtgacaagttgcttgatggctggaagatagttgatcagaatcgagtagcaagttaacaggaaacgaccgccagtattaattgctggtggccgttttttggtttcagttaaatgatgtcatgcttcaggagagctctctatttgttatctagaataagttgttttgaggattagtggttatttcttgtattaatggctataattaaactatcaattacacgaacaatattttgaaatagtattttatagttcgctatcatcaaaaatatcgcaagcgaggtgcatgatcatttcttattcaaagattatcgaaggggcgagcttttcacccttgtcgcaaacggaagttagttaccaagcacagcaattaatttgtctagacgacagtggctacattgctcacgttatcgagcctagtgattcagattatgcgtctgtcaaacaaacggcacaggcaaacgatactctgaccacattgcggccgaaccaatatctcttacctgggtttattgatttgcacgtccatgcaccacaatggcccaatgcggggttggcgttagatcggccactaaacgaatggcttgatacgtataccttcccattagaggctaagtatcaagacctcgacttcgccaaatcagtttataataatctggttcaagaactactggcgaatggcaccactaccgtactttactttggcacgattcataacgctgccaacttggaacttgcaaaagcttgcatccagcatggtcagcgcggattcatcggtaaagttgccatggataacccagaccagacacccgattattatcaggatgcttcggcccaagttgctgttgaccaaaccgaacaatttattcagcaattgggtgaattgaatcaaaccacgaatttgaaacaaactcccgtaatcacaccgcgcttcgtgccgagctgtacccctgacagcctgaggggactgggtgacctagctcgtaaatacgatttgcccgtgcaatcccattgcagtgaaagtgactgggagagcggctatgctttggaacactatcatatgcgcgatgccgaggttttggatcactatggtctgttgacggataaggcagtgatggcgcatggcacaaaactcactgaccacgactatcaactctttaaaaaacagggtgttgcggtggcacactgtccaatctcaaacgtgtactttggcaatgccgttttgcccgttaagcgggtattggcacatcaagtaaaaattggacttgggaccgatatttccggtggctattcaccaagtctctatcaaaatatgaggcaagcggtgatgtcgtcacggatgttacaagatggggtggataatcaattacctgctgataagcgtggtgttgcggatagcgcaatcagtgtgaaaacagccttttacctggctacacggggtggtgctgagagtttacacctacagaccgggaagattgccgaaggatatttggccgatatgcaggtggtttcgcttcaaaacgattttcaaacgaagacttcagataatattttcgagaagctgatgtatcagactagtaaggcggatattgatcaggtttatgtgcagggagaacgggttaaataactgtgagcttttaaggtagaaaaaggcatctcaattgaggtgtcttttattttgcaggtaaacattgtgtaaccacgtcatcaatcctcgcttagccatttttccatttcgtcattatttgttggtgtcttgggatcgtggctcaacgcataactgcgaatatctgactctgcttggcgtaattgtttatcttgggttgctattaattgctgatacacatctttggacattagtacataacctttatttgcgttagtagtaatttcgattggctgttttgtgttatctaagttttctaaaatggtgtattgatgtttgtagaaatttgtcagcgtatatgtgtccatttacagtcgctcctttttctaagacttatgaagttatcatggcttaatctagattgaatttcaattaatttagctggtaaatcaggataccagttttacagacaaatcaaaaagcactgtataacgactaatttgttctagtcgttatatagtgcttttggtgtttgctttttacattgctgaaacgtgttcaaacaagcagagagttgcaaataaggcacagccaacagaaatccaaaaccgggatttccgtcgcctgtgccttattctccactctctaaacgcttgttttcacactctattttttgaaacgtgttcaggagagcagagacttgcatctaagtcacttctaacagaacccacgtcaaagtgcgacgtgactcccgtcagaagcgccttagactccagtctctaaccgctctccttcacactctattttctatactcatccaagtccaacacaataaaacttacggtctggcccggttttgttttcagttcacctggtgtgcttggaaccggtaattcatcgtttgattttaccagctccttgccgaccgcttccgccgccttttgcgccgcttgttcgtttgttgtacccattacttttacaccgggtacatccggaaccgtgatctgaacacggttaatcattactgttgggtcaaagattgctggatatacaagccgttgagccatgaaatagcctcctgaatttaagttacgatttaaatcatcctctccattctaccgaagattagcgttaatttcaaaatttttacgaattgcggttgacactttggcgagctgatttgtttgtataagtgtagggcgttggccaacacttacaaaactaacttactggagagattaatatgaacactacttggaataaaactaacctggttctggttatgcttgacgcaaacgacaacaagatccgctacacctacaacaacatgattgaaaagccttctgacgaccaaattacaaagtttgccgcagttattgagaagttaaccggcacatcattctttaatgcctacgtcaccaccaccgataacaagacgcaagttgcctaagccacttatctaaaggagattagaacatgaatagcgaagaaaaaacagtattgcagttacgtttcaaaggttcagacgaaaaggtccacactttcagttttccaaaggcggtttctggtttaacgactgaaacaattgccgaagcgatgaacgccattgcaacgcttggcctctttagtcggaagggtgttaccctttatgattcagcggtcagcggcgcatacgtgaagacgactacgcaagaactctacaaagtctaaccagtaccgcccccaatttattctctactcaatgaacggtcgggggcgatattgatgaagcaacacgtgatactcgcagcgcttgtcttttacgcggcgctgcacctgaaaaacacggaattgatcatgattgcactgagtatctggtcgattcgttagtgagtgtgacacaactcggtagattccagcatacaacagccggaatctgagttgtagaacaggttaagactgcccagcaccacgtcactatttgacggtgctgggcagtctttgtatgcttacatatttcagcgaaaataggtaacgttaaaattaatttcacaaattaagtgactttgatagctttaatctgattttcagtctacaataaagaaggttttaacgatgagtcgttagaccatcattaaattaatatgatctaaactattttacccataaaagatagttcggactgagttacaatccccaacaatatatacatcaagcactgggcgcagaatcgaaaagcagacacctgtgcagtcggcgatagacagtaccaacgttatgggtatattttccttctttaagggatataggtagcatgtcttgccaacggttaaaaccgttttcgctgtgtgggatagatcgtgtagccatcaaaacgatgacacacttttggattgtgcgaacttcaggccactttggtggtgctgaggttgttacccaactaagagaccttttctcttatccatttaaggggagggccttttttaatgggtaggcacatgatagattccaattagatattaaaactaaatcaaagtccatcacatagttatccttgtaacgattaaacgaaaacggggtaacacgatggacttttttaataccgcagattcacttgcaccaatgtatctcacttattctggcttaattcgccatgatgaacgagaagaactgccttaccagatgtacatgccagtggttgatcatacagtaggtggcaaatccatctatgacgttctgactcgaggacgggaaatgattggaacactgctgatggaacgggtgatggatcacgaggatttacctgagccggaagagacactacctgagggtgacgcagatgaaatggcaaccttcattaacgtggaactagaccgctttaagcacctaattgcaccgaaggaaacgttgattcggccaatgagtgcgttgaaacatcccaagcagttattatcgcatgtgtatgattttcagccggtcttcatcacggaagagggtatcggtcgttatgtcatcgtcagtatgaaggattatgatatgttccaaaatacgattggcatggtgctggataagcaggatattgtggatgcgctggatgatgattagagtgtgaaggagagcgattagagactggagtctaaggcgcttctgacagaaggcacgtcgcattttgacgtgggttctgtcagaagtgacttagatgcaagtctctgctctcctgaacacgtttgggcaaagttgccaaaacaaccgggtaagccaaaagcctagagacgagtcttgtctctaggcttttaaatatagccattaattctctaagcttaatcagttgaaaataagagcggcatcctatattctaaacgcgctggagtaggacaagtactttaagttttcaaatttgattattggaggggttaataatggttcaaaaatatgttgcggagattaaaccgctgaatgaagcaatcattggtaccaagccacacggtaccgctgaatttattgtgagtgacgatgcgttgcacattgaagttgagatgttcgatacgccaaagaacacgcagcattgggaacattttcatggcttcacggatggcaaagatgcgcagccagccaccatggcacaggatgtgaatcatgatggcgtggtagatttgccagagacggaagctgtttctggtacgacgatggtgccgtttgacgccgaaccgcatcagatggatattgcgaacgacacttatccagtttctgatgatcagggtcactttaaatatgtcaaacacgtaccgttagctgatttaaaagcacaatttaagaaattttttggcacggacaatctggatttagataagcggatcatttacatccatggtgtgccggatgcggtgaagctgcctgacacagtgggtggtaatctgaatgagaagtatgataagcatgtgacgttgccgatagcaacgggaaaaattgtaaaagtatagagaataactagattagtttgatgcttgatgatacaacaaaagggttttccactatgtttggaaagcccttttgttgtaagtatttagacggcacgccatgatctaagattgtactgatctaactttaatatttgtgccaaacttgaacatatcccatttcggcgtaattgattaattctttgtgaccgtgtttataggcaatgcgccacatgtggctactttgatattcatatttggcattattaaattgataaactttgtgatgatgaaaatttcctactctagaaaaactgattctgtgccatccatggccactacttttataaagagttttgccatcaaaagcaacagaatacgcttttacactcaatgaccggccactagtggtatagtacgatccacgccaactttttggcatataatgaacagcggcatgcgcacttgtctgattgatttgaaatccaatacccattgataggacagtaataccaactaaaacacaattctttaacttcaatgaaaatatctccttagattgcagtcgttgaggctgttttatttgcttcacatatctcttaaccagtctgtcaagatgatctggtgcttgtcaacaacatagaatctccttattttcggtaccacacaactttgtggccttgattttggtaattgattaggattcttttaccatctttatgtgataatttccagctttgactactttggtagccaactttagcataggcgttaattaagtattggccctttgcaagtgttgttgcaaaagcaagtttgtgatgaccatgccaagtactcttataaagtgttttaccattaagagtgattgagtgggcgttaaacttcatagttttatgatgatgcgtgtatgaaccacgccaactttttggtattgaatatcggactgaagtaaattgatacgcgtatcttttggcagctaacgctttagaagtaatggctgttgtgcttaaaaataggatcgcagtaattagtaggatatatttttttaacttcaatgtaaaaacactccttaaaattcagatttatgcttatttgtaataccaatgtccattaccggtgggcactatgaaaaatgtccggctattgtggtaataatatttttttgatttaattatccaacctcctgtactcataaaccatcgagaaatacgtaccttagatcccttatgtagcttcttataaaaagtccagtggttattagcttcgcagttaccagttttgattttgtagactgaaactgtttttcgtacagtgacaaagcgagttgcttcttgtgcatactcatttccgtttaagtaatagttggcatgagcatccgtccgagaagctgctagaccaataccaagtgatacagtagctatgcttagcatgattatttttctaaagtacataatttcaatctcctgcatattattaattatttatatttcaaatgaagcaaatttttttgcataagacttagttttgatatatctatctagttagtttgaaaatgaaccttacttctaaatgcatagctgtcgctggcgccccagattgcgccaacagatgttactaatgcagtacggtatttatgatgaatatagatacgtttcactctccagtaaccaggtactacggtggctctgccatgatgtgaagtgggagaaacctgagcggagaactttctacctataacgtatacttgttttttgccattaaaggtattctgagcgctgtggtcagtaatataatctttccatatttctctactgtcaatttgaatgactttggtagatgtgaaaataatcttggtatagccatctccaggaatatattcataccagttacctctcacccaagtcggaaaagtagcataataatggcccttagccttagctttagcgtgagtagtgaatgtgaaaaacatcaagaatgcacatagtaagacagttagctgttttatcttcatgctcataatcttagaaatatttcccttctatttgtttaataatataagtgtagcattggttttaaaaaatagttcataaaaattcaaattagttcatttatatatagtaaaagtcacttgatgtaggcaatatcaagtgacttttattaataattatcgattttctgaattttcgttaattaatttctcaccaacagcgcctccggatacttcttccccacaaacgccttaatcgtctcaatcatcttctgcgtagaaggtgccttcgcttgcaccgccgacgttgccagcccaattgaccggtagaagggatgctcaaacggatacacggccacatctccaatgattttctgcaacgctagttccggcagaattcccaatcccagtccggcttccaccatggcaacgatggactggtcatcaatggagaagtgaatcaggtttggctgaataccgtagtagtccagtgctgctttagtatcacggtcgtaatcaccggattgcaggatgaagtcgcggtcttccagatcttcgttggtaacggatttcttatttttcggaacgaagccttttggcgccacacagtagatctcatctttgaccagatcatctacaatcaaattttcgctaaccggcatcacagcaaatcccagatccagcgttccgtttttgacattctgtacgatttcattaaagcctgattgactcactgaaatgtcgatatttggatattgcttcttaaatgactgaatgatgggtggtaaccagttaatgcagacggatgagaacgcaccgatgcgaatcgaaccggaattcaacccgttgatgtcagcggcctcttgttccagccgagcttgactgttcagaatctcttgaataatgggtaatatcgttcggccgttcgccgtcaattccgcaccagaacgggaacggatgaagatgggaaagcccagttcgttttccagttgggtaatcgaatggctgatcgcgctgggcgtcacgttcagctttaaagcagctttttgaaaggtaccttcctgaatcacggtactaaagacttggtaagcaaaaggaatcatgaatcgtacctccattagataacatcatcaaccaattaaagcttgctcatacattaacagcacaggtgaaggactttcacctaaatatgagcaacttgaactatacgaatactaacaaagagtataccatataggcaaattagtaaaatacaccgtgtcatgagatgaaaggtgaggtatacattatggataataacctgtttgcaacccgtgttcagccagaggtaccgtcacgattagccggactgttcccagtgatggactatgaagatgccatcaagtttactgctggggcaccagcggaaagtttatttcctgctcaagccatgcagcaggcctacttggatgccatggcagcagaaggcaaccacacctttcaataccacacggtggacggtcccgtggaattgcgtgaacgcttagcccaacgtgccatggataagatgcagattgaaaatgtaaccgctgaaaacgtcatgttaacggctggcggtcagcaagggatcgacttggtggctaaagcgttactgaacaagggtgacgccatggtggtcgaagcaccaacctatgtgggcgccctgtcatcgtttgatatgtacgaacctacctattatgaagtcgaattagagaacgacggattgaacactgatcagttggaagcaactttgaaacagcacccagagatcaagtttctctacaccgtttctgacttccacaacccaggcggtgtcaccatgtcattagaaaagcgtcaaaaagtagttgaattagccaacaagtatcacttcatcgtactggaggatacgccataccgcgaactgcgctataccggcgaatcattgccaagtattaagcactttgacaccgagggcagagtgatcttcctatcaagtttctccaaggtgctgatgccaacgttgcggactggctggctagtcgcagataaggcgattatccatcaactctataagctgaaggaagccgctgatttggaagtgccgaacatcaccgcacaggcgattaatcacttcctagctaataacagtctagatgaccacattgccaaccttaataaggagtatctggtgcggatgcaggccatgattgctgcttgccataaatacctgccagaaggcgtatcagcaaccaagccagaagggggcttcttcacctgggttactgttaatgatgccatcaataccacggatctcctatataatgaagcaacgcccaaccagcacatcgcttacgtgccatctaagaacttctatgcgtacaagaatcacacgaatggcatgcgcctgaatttcactggactgacaccagcagagatcgatgatgggatgcaacgattgggaacgttgctgacacgtgcaggacaattaatatagtaaaaatgcgaaaaaagtgattaaatcttacaggcctgaatgctattataaaggggtacttatgtgtcacgttgctagaagggaagccgtttgatttaggaaggggaagtgtcatggaacacaaatacttaaggaaactgacagtaatcgggcttagctttggtatcttcgctgggggagctttagtaccaacacaagctagtgctaagaccaaggtgcggtcgtatgagaacattaagaatgcaacctatacggtgactaaatcaagcgcgacggtttattccacggcctcattaagccacaaaaaaggtacgttgaaatcgtttggtactaaggttactggctattatgccgctcacgtgactaagaatgggaagtcatcgatctactataagtttaaagttggtaataagacggggtgggtctggcacggttacctgaagaaagccgcgccagcacaagatctatctaagatttattcaccgactgaacttgcaacgattaatcagtttaaggccaccgctaaaagcattggtaacagtaccaaaaatatgtatagcgtaaaaccagtgactaagagtcattttgctgctggaaaactcagtgatagctatgtaaacaacactgtacgtacgattaatcttgctcgtggcctttacggtttgccgtcagtgaccgccaattcggcgtggaactcttcagcgcagatgggtgccgctacgttagcagctgctgatcaaggactgtcacacggattagtcggattcagcaaaccaagctttgtttctaactcagattggcaagccggagtagatgcaacgaaccaaagcaacttggctgaaggctatgtcggtgcgtacgacacggttaccggctatctgaacgacagcggtaacgatgatcctggtcaccgtgaatggctgttaggtggtattaatgaagtcggtgttgggcaagccggggattacaatgatctccgcgtgtttgatatgaacgactattctgacgcaacgccaagtcaaccagttgcctttccaaacaaaaccgtctttccatgggaatgggtagccggtactcgctggtcgctgtcactgccgcaatccctagatactaaatcggctaaaattactgtcaccgataatacgggtaaaaagaacgtgccagtttcgggcgtgcttgtaacggatggtggatatggggagtttaatacctctatttcctatgagccaaaagatgccatgattcaagcaaatcattcttatacggttaagattaccgctgatggtttaggctccggttatacttatacaactaagctgtttaaggtcggagatattaattaggacgtttactagtcatcgtatgatttcttagattaatactgaattcaacttttttaaaataaaaaataattattttaaacacgataacagcgctttcctgcataaacttttatgcgaaaagcgctgttttaatttgtaatgttaatgttacagattatgacacgataatatggtaggcatcaccaaagttaagcatgtataggctttcatcgtgatttttcatttttcaaatatgtgaaattattacaagcaagctacaaatcgggcattattcttgaagacctttgggggatgcgttagactctcttatagagtcaagaactcaatatgcagtgttcaatggttgtgacggtaattattttacttaacattccgctggatattgtgtatactgtttatgcttgatgagttacataaatatatgtttggaggaatttcacatgcaatctagtttaaagaagtctctttatttaggtttagctgcagtttcatttgttgccgctgctggcgcaacaactgctaacgcttcagctaaagctgctacagtgaagtcagatgttactatgaccactgctgcaacatcacgtaacgttacattaacaggtactaacgctgtttacactaagccaggtactgttaagggtgctaaggtagttgctacaactactactgctaagaagcttgctgcatcaaagaatggttcagctaacttccgtgcataccgtgtagctgttactgatcgtggatcagtttactacaaggttgtttcattcgacggctcataccgtggatatgtttacggtggtaagagtactagcgactttgctggcggtttaactgcttacaacactacaaaggatgctactgctcctaagtcaactgattcatacagtttaaacactgatactagtacaactgctaacacgttgttctatgcacaacctgcatacgcacaatacaaggttggccgtgctacagttaatggttcagtattaaaagcaactgataagtacaagggtgctacattcacttttgacaaggctgctactacatcacgtgaaggcgaaacttggtacgaaattgcttctactaagttaagcgatggtactgctactaatgatcttaatggtgcttgggtaaaagcagcaaatgttaagaacaatgatgctcttaacccagatactgaagtagctgttactgttaaggatgttgctaatggtactgaagtaacttcatttaattacccgactggtgttactggcaatggtactgcagcaacttcaagtctccaagctgacaatggtgcatttacagataaatttaacactgctgtaacgaatgctttgactggcaagggttataaagttactggtactgacgcagttaacaagttatcagatgttaagaatggcggtagcgtaacactttatgctgttaagaatggtcaaaatacttcaaacgttaaggcatatgctagctttgatggtactattggtaacaacaagtcattgaaggcagttactactactaccgctactgatgctaaagctgctcaaggcgaagtaattgcacctgaaaatggtacaactacattatttgctggcactgatggcacctcatttactgctgaccaagcattagcattcttaaatggtagctcatactacaagtcattgaagtcaccagtattccctgacacagatgctaatggcaacaaggttaacgctcaatacgtattaactcctgcttcagctaaggctggtacttttggtactccatttgaagctcaatacaatgttactaaggttactgtagcaaatcctactgcaccaagtgttacaccagatgcagggaacccattcgcttaatgattcgttagagatgcgaataaaataaatagaatataaattgaattttagtggtttatattcagtttgaagaccaattctgttatgaattggtctttttttgcagattataagtatttgttattcgaattttgatcctggcttcaaaatatattctcaaaagtccatctttaattaggtggacttttcagtttagaaagagatacaccttttatgtactaattgtaatttagtgcagccatatttaatttgctaataggtctttaagaactttgtatcagttaaatgattggtttacgctgaatttttctaattcgtttcaataaatggtaaaatgtatctaactagtctatctagacttaccaggaggccacaatatgggtttacgaaatttatttcggggaaagtcagaacaagaaccagatacaacaaacgaaaaccaaattgttcaaaatagtcaatctgattccggaaataatagttcaatgtcttatgatgaatcggtaactgaaaacgaaaataatgtagataataatccaattgcatcatctgctttaacagctaagaaaaatttagaggatattgttcgacaatacaatagtcgacgtgaagacttgcaggatttattgtttgataaacaaaaagaaatccaaacgaattttgattctttgaaggcacaggtttcagacgctcagaagttagttgatgacactggtaaccaaattacacaaatccaaaatgaaatggagcaagccagccaagaagtttcggctccgttagttgaaaaacagtctggattaaatcaacgaattgaagataataagagtaaggcgggtaatctggtcactcaattccatgaattgaatcaggaattaagtgatttaaataaaaaacagcaacaactcattcaagcagaaaaagatatttcttcaaagtttgaaagtgagacagatccagctgtcattgttacgttggctgaccaatatcgagatgatattgaaagtaataaagaagaacgcgatagaaatgcttcaactattcaggctgttgacaaaaaaagccaggatgtgaaagatcagttacaggtggtgcgtagtcaattgactgcagaccaaaaagaattacaagatcttactgatcagttggaacaagtccaacttaaggttgccaccgatgatgaaggacgttcaaaacaacttgattcactgacgcaggagctaactaagaatcaggacgacttatctaagttacagagtgacttggataccaaaagtgcagaactggttgcagccaatcaggatatcagtaattggttgggcgtttcggtaccgattaagcaactcgaattgtatgaagactctgagattatattggatgtggatgggctgactgatgagcaaattacacagctagcgacgtctgtgagagtattgactagtcatggcattagtcattttagtctatttaccagtcaatttaccttaaatctggatcgtgaaattgctaaatgggtgactaaactgcaggttaagggcggttttgtttccgtgtataacccactttatagtttgcaaaatcaaggtaaaccgggcgctaagtaccagctgccggataatacagttagtgacgagtggaacgatgctcgcacagagcggacaatggtattagacaacggttggacgcttaaggtacactactttgaaggcagtggtgctgttgccaatgttgactcatatcagggtgatcatttggctgaaagcagcacgctgaccacggaaggccagctaacggctaaccggttctttaacgatgatgggactaagaatcgtgatgagtactacagtcaaagtggactgggtattttaaacttgcgctatgagcaagatgagctaagtaaggttgagctattgaacgctgtgggtatgcaggttcaaacctttgatactattgctgactttaccgagtggtggatgaagaacagcttcgatcagcatggtctgctaatgggtgcaatcgaaaacgagcagtatcgtcatttgctaggagagacgaagggtgaaccgattaccttggtcacgggttcgagtttggaacatgatgactttaaggcttgggcgatggcactgccaaagcagcaatatttggctgataattatcaaactgagatgaagctgattcagcgcttaaaccaaccattgacgattagtttattagaccgacgtaatctgccggtgtcattgggtgttccagctagtgatgaatagtttgagttcggacgtgcacgatggtgtacgtcctttttattacaaaagttcctcgtaaagattaaggatttctcaatttcttctcatctatgatattaagtgttaaaattaattcagttaatcaaggggattaactgaagggtactgtttaacataaaggagtgtatttgataatgaaatcaagtttgaagaaaacactgtacgttggcttagctgccgtgtcagttcttgccgcttctggctttgctgcacaaaatgctagtgccaagtcttacgcttatgtcactaaaccagcctacttcaagactgcaccagaatcacgtaatgtggttcctactggtgataatgctttgtatactaaaccaggtactgtaaagggtgctcgtgtgattgcttctaagaccactatgggtaatttagctaactctaagaagtcatctgatttcttccgtgcatactcaatcgtgtcaactaaccgcggttccgtttactacaaggttgtttcatttgacggtcattaccgtggctgggtctatggtggtaagtcgactactaagtttgatggtgggattgcacctgcaactacgactaagtcagctacaatgccaagtacaactactggctataccattgctgatgcttctaagaacaccatctggactgctcctaagaacacccagtacaaggctgctaagatcactggcttcgattccactgatacctttacggtaactggtgcggaaactaaggctcgtgaaggttcactttactaccaagtaaaggatgaccagaagccttcagttactggctggatctattacacaggccttaaagcacctcaaggcaattcagttaaggtcagctacgttgataagagtactggtaaagaagtcggtaccagttcagttgcctttgacaagagcgcaacttacaccaacgtcacgactacggataacttgaagagcatccttagcggtgtcccttcaggctacgtaccttacagcaatgacaacggcggttcagcttcatttgaaaaccgtgacaatgctgcattagctaagaacggcgacacgattaaattcgacgttaaggctgcacctactaacgctaccaaagctatcaaagttgttcttgttgaccaaaacgggaatgccctcaacttgagaaccaatgaccaaaacgctttggatgcttccggtgctaaggctgccttccaagtttctgctggtagcacggttactgctaatgatgttcaaaacatcattaacgatgccagcctgaataacctgtatgacaatgccggtattagttatcagttcgtaagtggtgcagataccccaacaactactaacgatgctggaaataccgttactgtacgtgcggtttacaaagctaatttttaattattaattgaatctcaaaacgtcgccatttgagcggcgttttttattcgaaaccgttaaacgaaggggtgtcttttaattgaaattgaatttgaaaaaaacattatacgttggtttagcagctgcttcagtccttgccgcatctggtttcgctgcaacgactgctagcgctaagtcctatgcttacgtgactaagcccgcgtactttaccactgcaccggagtcacgtaacgtggtgcctactggtgaaaatgcgttgtattctaagccaggtaccattaagggtgcccgtgtgattgcttcgaagaccaccatgggcaagttaaccatcacgcctaagtcaactgactacttccgtgcgtatgccattgtttcgaccaaccgtggctcggtatactacaaggttgtttcatttgacggccattaccgtggctggatctatggtggcaaagataccactcagttcggcggtggtattaaagcaactcaaactacgaggacacgaaggcgtaccccgtaggcaacgggttacaccattgtttatccgtctaagaacaccctttggacagcgcctaagaacacccagtacaaggctgctaagataccggcttcaagtcaaatgcacgttcacgattattggcgcagaaaccaaggtgcgtgaaggttccctttactaccaagtcagggatgaccagaacccgtcagtgaccggctggatctacacgctgctgtccgggcaccacaaggtaacttagttaaaatcacgtacattgatggtgaaactggtgccgtagttggtaaaggccacagttccattgataacaatcggcaacggacaaatctcacgacaaatcccgatgtgaagaccatattgatgtattccttctggttatgtcccttatgacgctggtgagggtggtgttgattcactagggactcgcacatgtgctaccgcagccagaacggttctcaatactatttcagtgggacaaaagggcattaataatcttcaggatatccaagttgtcccggtgacgaaaacaaacaaaccaattgagatgaatgagaccgatcaaggatttgcatttgcatcttcctcattcgcttttgctcaccattgttaaagcgggtgacacgattacttctcaagacgttcaaacgatgcttgaggagggtggttctaagtacttggacttacgataaatcagggattcgtttaccattttgtcagtgcacctaatacggtaacaagcactagtgatgctcgcggaactgtcactatacgagcaacattcagagctgaaaaattatgatgaatgatttaagtttaaaacgtcgtcctatgaggcgacgttttttgctatgccaatgggacgcgtaaattaatagtcccatataaacgcacattttaaaaataggcaaatctataattaaatccgaacaagaaattaaaaagccccaagcaatcacttacaatgtagtagctaattccaaccaatataggagtatgattactttgggtacatctactttactacgttttcaacgtggcgcactagcacaactggtcaatgaggggaataaatcttaccagtaatggctgacgccttaggcgtcgcccaaagctacgattagctatgagttggaccgggttaaaccttgatcagaaatagctcagcaagatgcagatcgcaaaaggcggaattgcggtcgtcgttcgatgctgacggcagcattagcgactttaattaccaatcacttacgattaacctggtcaccagaaaccattgcggcgcttataacttgagcactgcgtcaatttataattggcttaatcgtggctggctccccttcaaattgactgatctacccaatcggaatgtcgccagcaccgagtgagcgaaaatcgtgggaaatttacaagtgggacttccatcgaacaacggccaaaaactgtgtaatcaacggttagctttggtcaatgggaagagatacggtgctttctagtcgaagtgagtcacgatcatgtggtacattcgttagaaacgtaagacccgacttctatgggccatcaaagcccctaatagaacggctctaaggctctaaaacaccgcctttggcaagtttatgggggccttcggtccccaagtaaaatccattactgttgatcatggtaaagagtttgccaattatcagccttagaacaggattatcagatcaaagttatttttgccatccatttcaccatgggagcgaggttccaatgaatattttaatagacggttacgctggttcttcccgaaaaaagaccattttagccaagtaacgactgatgagatcctagcagcacttgaactaattaatcaacgaccattaaaaatacatcatcaacagactgccattgaaagattccgggcttgttcggattaaacttgtaatttgccataacaaaaaaagtttattacttttaaacatttcatatgtaattgaaactgtttacattacgttgtaacattttcacaaaccatgtataacccttatatagcagggtttagaatttaaatgacaaatattacatcactgtgaaaacaagctttcacgaatttattattttttggaaaactgttgtattccttaaaatagggtgtatagtactatatattgcgttggttattgggggtcaataatcagcatgggagcaacgattcaattttcacagtttcaatgcttcatggtttagcaattttatttataacgtcaacacgactctctctcgtgtgttatatatttggagaatttcttagaaaaagctgattgtcgagacactttagaatttaaggagactttcagtttatatgaataatcgtttaatgggtacattgttgacttttgtcgctgttgttgcaggtttgagttttgctacacctagtcatgccagtgccaaggtggtcactgacgcggatgctacagaagctgttaaaacagcaacatcatttggcactgcaaaagccgatggcggcgcagctactggtaaagcaagtttgacaccagctgctaagcgttggcaatcaaagacaattacctacaaaatcgccagcggatcaagttattacaaatccgtttggaaatcagccgttaaagtttggaaccgtagcggtgtggttaaattagttgcaactactggtaaagcaaatattactttgtcaaacagtaattcaccaatgggtaataatgattcaaccgttgggattacttattcttcatactataacaacaagagtttgaatggcttggctgttatggctagtgctaaatcatacgttttcactaacgttgccaaccgttatcactattcaaagggtgaacggacgaacgttgctgaacatgaacttggccacgctttaggcttagaacataacgttggtaagcacagtgtgatgtattacgctaccagagatcaatccgtatcaaaacctgatgttaatggcttggtacacagttaccgttaagataaaaaaattaaattagaaatgaaatatccattccgggggggaatggatattttttattgtgtgaagtttacgagtgaacattaaatcatacgtataattatatatgtctaaaaaatagacaatatttgtaacgttccttaaaaaagactaacttttttaaaaaaatatgtgcaaatgaaactgttgatatttttaaattttaaaagaaatagctacccttttgaagcccgtcaaattaggatttgataataattagtatatgttataacattttcacaatatcgctctttaggcttttccgtagcataattgcacttgtattttgtaagtatgaatgatatatttcacttgttaagttgattgttgagggggtcaataatcaacgaacggggacgacggttgattttcataaccatttctttttagtgattttatttgtatcaagcacgattctttttcgtgtgctacttttggagaatttctaagaaaaagctgatagccgaaacactttagaatttattaaaactaaaatttaaggagactaatcagtatattatgaataatcgtttgataggaactttattgatattctttgtcgttgtgggtgtagggtttgctacaccgagtcatgcaagtactaagattgctaccgatgctgatggtgctgagcctgttaaaacagcggaagcagccagtgctgtgaagtctgatggcggcacagccactggtaaagcaagtttgacaccggctgccaagcgctggcaatcaaagaccattacctataggattgccagcaaatcaagttattacaaatccgtttggaagtcagcggttaaaaagtggagccgtagcggtgtggttaggctagttgctacttcgggtaaggcggatatcacgttatccaacagcaattcaccaatgggtaagtatgattcacccgtaggcattacatactcttcatactatagtaacaagtctttaaacggtttggctgtgatggctagtgccaagtcatacgttttcaccaatgttgttaatcggtatcactatactaagacggaacggacgaacgttgctgaacatgaacttggtcatgccttaggtttagaacataacgttggtaagcaaagcgtgatgtattacgctgcccgagatcaatcagtagctaaaccagatattaagggtttacagcacagttaccgttaagattaaaaaattaaattcagaaatgaaatatccattccggggggatggatatttttgtatttcatagcattgagccattgatgataacttgataagggctagaatatggtatactgcaattaaatccaagtgaggagttttatgaatatgaatttgaaacacggaattgctgcactgttgctgggcctatcattaggaatcagtgcagttgccactaatactagcagtgcaagtgctgcgacttacgcaccggtcaccaaactgactaaggtgagttactataccactatgggggctaatacgtcgcagaactacggtgtttatgctaccggtggctaccaaacatcggcgaagaacgtgacacccattagttacggtaaaaactttgctgggaaaacgatacatattacgcgtgaagaggttgctaacggtacgacctggttgaagtttacttataaccatacgaagacgggttggatcaatcaaaaagccacagtgacgtctacgtacaggctatacgcgccattgatcggtcagcggccagaattaccgaccggttgcgaaatcacggcaacggccatgatgttgcagtttggcggtgccaaggttacgaagactagtctggcgaaggaaatgccacgaagcagtgacccgaataaggggtttgtgggcagcccttacaaaactagcggctggtacgtttatcctggcggtctcatgggcgtggtcaaagcgcacatgggaacggctaagaatatgactggctacagtctgaccagcattaagaaacaagttcgccgcaatcatttggtggtggtctgggtcggtaacttcgacggcttcagtaaccatgcactgacggtgacgggttactctaagtcacggatctattataatgacccgtggacgtataaacgaacgagtatgacaaacagctcgatgacatcgcaccggaaattagatgctaatcgcgcgctgagttattaatttaagcaattgggaggcttatttatgaagtggaagtggatctttgcgttaagtttaggggctgctttggggatagcaggaacgacgactcaagcatcggcttaccagaatcctaagggttattatcaggtacaagacaaacagatcaaaccgtatggcaaggtcggttatacggtcaaacgtggttacgaaggcatcaaaacctggaaaatcatgaagaagatgcatacctttggcggctacgataagtacaataccgcgacttattatcaggtgaagaatttccagcgtaaacatcacttgaaggtaactggaaacgtggatgaggcgacttgggtcaagatgggcttttcgaagtcgtcatggaccagcattgacagctacgtggcaccattgacggtgacgactaaggatagccgtaaagcccacgtggaagccatgatcaagcaagcctacaagtataagggtaacccttatttagtaggttcctcatctagtcctagttatggcgtggactgttctggtttggctatgcaggcactgtatgctggcggcattaatccagcacctatcagttctattaaccacgctcatccaggcaacgaatggaattctcgtaacctgtgggcatccaagaaactgaagcgagtggcttataagcaccgtgaacgcggcgatttgattttctactatcaaccaggtacgcacgtgatctggcacgtagcgatttatctgggcggtaacaaggtgattgaatcatggccgccacgcgtgatggttcaaccgatccgtaatggtcagcggtcagatattgctggggttaagcggccgtttttataaatagagtgtgaaaacaagcgtttagatagcggagtgtaaggcccctttctcataaacccatggtcttggggtttgtgagaaaggggccttacatgcagctgtctgcttgtttgagcacgtttgtgagttgtagaacatatccacataacgagcgaaagaggacttatgtgctgatttcaatcccaaggccattaaatttttgtcgatattgatttgtatcactcttcttttggtataccggtaatagctgtcgtgacatgggatcagcggctgaactggcctttattttaaaaatgaaacgcaacgggaattctgaattaatttcaaaaatgttatgtacgaatttaaccaatggtatatgccacttttcagaacataaaaaagcaccagtgaagggacagttcactggtgcttttggcgtaatctctgtcatagcaatcacttagggatatgattaggaacgacacaagtgtttccgattggcattcatcaatcgaatatatttaggttatcatagataattttaaaaatcaagaacacctgttcgattcttatcttttgtgatatccggtaaaataattattgttcaggacaaacacctgacaactttctgcagtcgatatcgttactcagcactcaactcacaggaggaaaaatctttgaaaccaacccaaaacatttttgacaaaccggcatttgctaagaaatttcaccagagcagcattcgctataagtatgccgttgagattcatgctttgcgggccgaggccggtctcacgcaaagtcagttaggtgaactgatgaaggtaccgcaatcgtcaattgcacgctgggaaaacggtggcaccaacatcaccattgaaacgctggaaaaaattgccattgctatgaacaaagaactaaagattgattttacgtaaagtagcgcatcttaagcaaaatgacttgttaaatatggtagaataaccctagatagattgaggagtattgcttaaaagtaatacgttgttcaagggggccttctaggtatgaaaaaacttggtattatggttgttgcagccatgtcatttatgggtgtgctggctgccgcaccagtagcagtgacaccgaccgtacaggcgaagacaaaagtgtctatcacctcaaaaaagtcaatcagtacgcaaaagtaccaaattgaccagtcgaaagccaagaaagcctatgcttataagagtgatatgaagaaaaaggctttcaagctttccagtggtcatagcacagttttttatgccaaggctcaagagacggtcaaagttggcaagagtagccggctttactactatgttaagtcctcgtcgaacagtaaaatggctggctgggtttggcacggctatttgatgaaaccgctgatgtctaaatcagcgttggctaagttagtggcttccggtccagatctggatccttcatcaacgttattgaaacagccatcagctttttacagtgctaaccgcgcttatttaacaaaagagtttaacatgtcaggtcaactgacgacctttaagaaccatcaggcacggatctacattgcggatccatccctgaagacttatacccaaaaggccatgagtgtctggaacaaggcgctgggtcgttcggtatttatcagcggaacttctaaaaagcacgatctagtggtgacgactaagtcttctaaacaatgggatggcttgaacgatggttcgcatctctatattagctccaatgcgcttaaggataagacctatatggacagtgtggctgatacaccggagattcgagcactgtataaccagtatgaaaacgtggcggacgcttataagaacgcgcctaatgattcggctgaaaaggatgcctatttgactcaaggtcataccctatacgatgaattaatcgcggctcaaaaagcagcggcaccatccgcgactgcatactgggaaggcgtgattgtccatgaattaggtcattcattaggtattgatcacacaccatacctcacggacattatgtacgccgaaactagtgatgatggctttagcagcagtgtgaatggtaagtatgactggagtgcgccaaaggatcccagtgatacacgcttggaagcaccatccttatctgatcgggatattgatcgggcaaaattaggcatggagcttgggtactggtagtcaattcataaagagtttaatagcctggtgactggtcttcggactggtcaccaggtttttgcatttacgcaatctttacacaaccaaaacggaatcaatatattgagggcgtatacctaagctagaagttaatgagaactagcgaggtgagcgtgatgaagatggtgattatcgcattacttttatttggactaagttttccagttacggtgaaagctgctacgactcaacgaactgaaccgacagttgcaaagatgaacgcacagattcaagtcggtgatcaggagagtcaaatcaagttctggcggactgataatcctcaagaacggcaagcaacgattatgggcttatcagcactggttgttgttggactggttgctagctgggcacgacggagattttactaacagtaaatgacccactaagagatgatacacatgcgtatcgtctcttagtgggtcgttttaatatatttggagagtaaattaagtgttggtcaactgttgatgagccatttgtagattcggtttaacccagttgcccgctcatcaggatcttgtttgataacaatcagtttgattgattcacccagttgaacgtttttcagagtattgatgtttctaagatcagtctgatcaaacttgtaatctaacggaatgtgatcgttgataccgctgcctgattcaatgatgtcactgttaaaaatatccgtgacgttagcgccacgaccagaagcgtggctggttgaccaataataagttttaagctgttttccgtgttgcgtcacaaagtggacagtgacgtgattaccgagcatttgatgcgtgcgaggcattagttctccagattgaaggttacgtcctcgcgtcagaagtgatgtgccaaataccgtcgacaaacaaatgatgatcaggacaacaacagtatgtctcctagaaattcggcgtgtcacaacgcacctccttcagatggtctctcttattgattgatagtatctcaaataaatgtagccaaagtaaggtagatgtttgaagattttatgaacagaaatcgttttttgttgattaatttcttcacaacttcaaagaactatcagaaagacatggcctacgaactggttggctgatgttaacccatgacgcagagaatgagaaaaagttttttaggcgattgaatggctgattagtgacaaaataggcctagttcatttaaaatatgaacatattttgaaaatatggttataatgttcggaaaattaaagcggtttcgaggctcccacgaaaacaatcaaaaaagcgctgttagcgctttttttgatgatattgtggatttgctattctatcttcgaccatagcgctatggatcactttataaaaaggggttcatataatggatagaacagcacaagcagcttttgactttttagcagaggacgaccaccagttgattatttacagtgcgttgaagaaactgggtattcgccaaaatgacgcccgatttgaggatctcgttcaggaaggctggatcttatttgtcaccatctatcaaaagtatccgcaagatcctcaagaattgccgaaacggtttttagcttatgcacatcaagctttatatagaagatttttaaatcaattacaggccacgcaacgggaagtcaagcatttggaaaccagtgaagtcgacttatcgggagtaccacagatgctggatgtggtggctgaggcgattgatgctgaactattgaaagggtggctgggtaaatgcaatgaagcggaacgtcgcttcttgatcgatcgcatctactatcagctgacgcccagtgaaattagtcaaaagtggggtgtctcgcgtcagaccatttataagtggcaaaaacgcattcgtagcaagctaatggacgagtaacacaatcagtagcgtcatttcaagaaaaaggctcttcataaaaatattacaaaaattccaaaatccgcgcacatctatttgttattgtgaatgtattagataggtcagcgcttatacacgtgaatggaggcattcttatgaagaaattactgattcaagttgtctcagtgatcacgcttgtattcggaacttcttaccaaagcgtgctggcactggcggatgatcggtccaagaccgaattatctggagtccagttaagtgacgcacagggtaatagggccaggcaagtgaaggtcaatgagaccaacaatctggaaatgacggtgacggtcaataataaggatggtgagaacgctgatggtaaggcagacatgtggctgccagaggaccaactgaaagtgatgcaagaacaggtgaaggctgagtctgcagtgacggacaccaacgccaccctgatctttgaacgccgtaagaataaacaaccacagctggaatggaagaacgtggaaaccagtgcaactttcaaactgaaggtaccggttcaattcacggcacccatgaccagtatgatcctgccaattgcgctgggttcgcaacgtgaacatcttcagccattagcagtggtcagcgaaaatgcaacggaagaagagatgaaggaagctgggacaccgactgagctgccagctaatatggtacagtcgctgacttcattcattgacgcgcagcaggctcaagaagcgcaacaggcacaacaagcgcaacaagaagcacaggataaagaagatgcgcaacaaccggagcagaacgctgaatcagaagcgcctgcgaaggatgaaaatgaagataaggctaaggaagacaaggccaaagaggacgcagctaaagaagaggctgaggctaaacgagaagctgaagccaaagctaaacaagaagctgaagataagaaaaaagaagatgaaaagaccgctgacactctgaagaagaacgctcgtaccgctaatgcagagagcgaaaaagatggtgtggagcgggaaagtaacgataagaaggaaactcgggctgggacgaacctgaataccattttacaggagaatactggcgaggatagaagcctgtttgattcgattgaaattaaagctgatggtcaaacgattaaacttgatcccaataatccgatagacgttagcaatctaaaagactttgaattgaactacaaatgggattcaagtactttactgagtaaattaaacggcaatcggattcataaagacgattactacacttttagaataactggtttagacaagtacagcggtaagtcaagcggctccttactcggaactggtgacgaagaatttgctagatgggaagttgtggaaaataacgatgagtatcaagagtttaaaatcatttttactaatgaaaaggccaatgacacacaagttgattacagattatcgctagaacaaaagtatagtggcgataaaccaattgattttgaacaaaatgaagaaggtatttggacaggaaagccgattgaaattcagtctcgtctgactaaagatggtaaatttgttggtaatcagaagattgaatgggaaatcacggtagatgctaaagggcttaaattcagtgacctcaagttagaagatgtgattaatactaaaggtgcaaaacataattttgttactgatagtttaagggttaactatgtaggtcaaaatgatattagcttacttggtatgtttaatccgcctaactttgatggtaataagttaatgcttacaggaaaatctcctgcagaatctgcaaatcccgatgatgatatcattaatgatgatattatcattcgcctggatactagttatactaatgggacaagcggtactttctacaatcaaattggtgggcaagttagtgatgatatccaaatggagaacgtagaagcccatgtaacaacaactgagttagttaaaaccgcaaaagaatataaagacggtacctacacttgggaagctagtgtaaagtttgatatcgatcagtttaaaaaggatggcgttttagatcgtgaagcggctggtaaagcaattcaagaaatggtcattactgataaactgagcggtccacacaaatttgaaggtgacgccaatttagaaattaaaataggtagctatgttgctactgatgattttgacctaaaaccagatgtattaacagatgaaatggttctaaaaccacatgctgattcagccgagactttattagataaattagtagagaatccaacgttaacgctgacttatgaaactaaggaaactaatcaaggtaatgttggtaatcttagaaaccaaatttcgctcgaattccttggaaataatcaagtcgataataagccaggaaatcggccgggtttgattcgcaaggatagcgaactatcaagggaagtgcatgacactgatgataaagcacatatcaattggacggtgacagcaaaccaaggtaaccgaaaatttgatgaacttaaagtaaccgatgtattaccagaaggtacagaacttgacgatgtgtcaaagattaaggttgcgggaattgactatgatattggagaagaaaaaaatggcgttaaagtggtggccggctgggttgctagtactaatcaagtaactggtactaatccgtacgattttactactacgaagccagagagtggtaacccacgagtggcgctccagtttgttattgatgatcgttattctgaaaaagaagaaataaagattacctttgaaaccgtgcataaatggggtagtgactcccatacaaacctggtaggggccgcgacaaatacaagactttatgaatatactcataaaacgcaagatattgatgaagaaactcgtgatggtggaaagaaggaagctaagctccttctcaatccaaatgcttcggggccacaaagtgacaataattatgttaattggaagatccgttttggtagtcacctcaaccactattttggtaagggagataaccagactgatacaatcaaaattattgatactttgaatggcgatggtccacgctaccttagctttcctactaaggagtctgatttcaaactgtattcattggatgaaaatcgtggaaatcctaaattaatttcccaaaatgagtattcactgacatggccgaaagattcagacagtcgtggtgaacgtgaattcacgattacgtttaatgataatgctaaggataaaaaatataccaattttgaattagaatttaacacaccaatcgattttagcgcatgggaaaaggtcgataatccaccatcgaaagttcccgatgaacataaattcgaaaatacagcggatgttatatatgctaacaaacatctgaagaatcttgaagccggtacttctgttgattctgaaggtcaatacgggcagaagatagctaaatcaagcgagggaaacttcctgaattgggaaataatcattaatgcgatgggtcaagatattggtaaaccagaaattcatgatacattgacttctaatcagcgacattcagtcgatcctaaagatattgaactggcgtttgtgacccctaagttttctactgtacaaaatggttcggcatacaaggtagaagttgatgagacgaagccacaggaaattctgtcaaaagaggattattcggttgattttaatggtaatcaagaaatgacaattcagttgaaaaagactgttgatcgtcctttagtgattagatataagacaatcatggagaaccaaaatggtccatatttaaacaacgctaggatttcctttaagggtcactatacacagtaccatgcgactcatacgatttctggggatgcgtttatgaatacttggacactacggttcttaaaagttgatggctcggacaatgataagccattagctggagcaactttcaaacttcaacaatataacagtagcagtcaaacgtgggatgaagccaaacgaatggatacaggtgaaaactatggtgaagttgtgtcaggtcctgatggacttcttcaatttcattcattgggaacgataacaaaataccgactcgttgaggtttcaccaccagagggacactccagccaaatggcacccatagaatttgagaaaaaaactgcagaagctgctggctggattgataaagcacatgaaattaagaactatgcgatatctcgtggcaatttaacaatcagtaaagcaactaaaaatcttgaaaatttgaataacttcaaatttgagattcgtgctgtagataaagatggtcacgttgatacagaccttcaaggcacttacaaacttcaaggaagcggtgaagtaacattcttgaatggtgtgagtgaagaaattacagtgcctgctaatagagagcgaacaattcttgatttaccaactgaaaaagtggatgccagtggtaacacatcagagcaacattacgatgttcgtgaaataagtgatcgcgatgactacaccacacaaatccaagttgacaatgatgaagcaatctcaggtaaacaaactgcaccattcctcttggattcaaattcagttaccgtgtacgtgactaacacagctgccaaaggtgagttggttgttagcaagactgtaagtagtgaagttaaagaagagctggaaggcaagtataacttcacaatcaaggcagaccagaaggataaagttgctaataaggaatacgaaactgaaggcactggtggcgataagctgaaattcgacgagaatggtgaggtaacctttactttaacgaatagtcagcaaatgagagttaaaggtttacctgaaggtgtcgaatttacaatcactgaagatgatactgatactgacatggaaactacttggtcaattaatggtggggactacaaggacagtaatagttcagtgacaatcgatgccgataaggcacaaataattgactttaagaacagcagcactaaaactggtcagttgcagattactaagcaaattgctggtaatgtcacgccagacgaagaatttaagtttgaaattgaaactgatccaaagaatgatggcgaatactcatacgcgaagtataccgtttccaaccaacaccctggtgatactggtaagcttaatattacgaacggtaaagctacattaactttaaagggtgatcaatacgtaagaatcaataacttaccacttagacaagagtttaaagtgagtgaagtgatttctgatgattcagatatggaaacgacttggcaaatgggtgaagcaaagggtgaaggaagcgagcctgctacgttcactctgagaaacgaaaatgagaccgctaacgttgagtatactaacgcattgcctaacggttcattaacactgaacaagaaggtaatgaaccagttacctggcgaccaagcgactcggtttacgttcaacattacaggcttgaacgatgatgacgtaaacaagattaaggaccggacattcactgtttcgggagacaacggtatggatgacatcagctttaacgataagggtcaaacgaccttgaagctgacccatgaccaatcagtgaagattcttggcttacctgcgggtgtccacctgcgaatcactgaagataaccatcctgacttcaatgcaacttataatgtcggtggtggtgaagaagatgacgatgcagacggtccgaccgtaacggttcctgatgacaagaacgtttcagtgaactacacaaacacacggactaaatctggtagtctgttgttagaaaaacaggcggaaggttcgtacccaacggataagggcatcggctttacgattgaagctttagatgctaacgaagctttagatgatgaatttagtgcaactttacgacagactgatggtacaacgcttaataagaaagttgaatttaatggtggtaaagccgacgtttcaattaaaccaggcgaaaaattggaagttaagaacttacctcttgggaaatacaaagttactgaagacgatcaagaagattcagtgacgaccacttggaaagttgataataacgatggcactggtttagttgcggatgacgctaccgttaaagaaaacgacaccactcatgttctgttcactaacaagattgctaatggtagtttggaactgaataagaaggttttaaacccattacctggcgatcaagacactgagtttactttcactattcaagctgctgacgatgatatcggtaaagtagcaggtgaaacttatgatgttgaaaccaactttaatggcagagatcatgttaagttcaatgatgagggacaagcaacacttaagttaagccataaccaatcagtaaaagtgcttggcttacctgcaggtgttcaacttaaaatctctgaagaacaacactctgatttcaacgtcagttacaccgttaatggtgatgaagatgatgacgaagacggtccgaccgtgacgattccagatggtaagaatatcgctgtgaactacacgaatgcccgaccaatctatggtaatttaatgctacaaaagcgggctgaaggttcgtacccaacggataagggtattaagtttaccatcaaagctttagatgaaaatcaagatttagagcgtaaatttgatgctactttgacacacaccaatgggacgacgacttcgcaaaaagtgagttttgaaaatggtgaagcggaagtcacaattttaccaggcgaacagctgttgattcagaacttaccaactggtcaatatcaagtaaccgaagaacgtcaaaatcggttagtgacgacgacttgggacattggtacaacgcaaggtaacagagaaaaagcggctccagtgactgttggagaaggtgacaccgcacatgtgcgtttcactaacaagattgccactggtaagctggaactgaataagttcgtggcctctcatgatgacgcggacaaggataaagactacaagtttgaacttcgtgcaagtcgttcaactcgttggatggtcgctaataagagttacgacgtttctggacattcagagacgaagcggattgagtttgaccgtagtggccgagcagaaattagcttgaaagatggccagacgattaacgtttctgatttaccagaaggtgttcgcttagcggtcatcgaaacggattcgaatgatttgaaagcaacttggaacgtgaatagtgagggcagctacgaagaattaagtcagcgtaaccgtccgaacatcactatcgcagaagaccaaaccgaagttgtttcttaccgaaatgttcgagatccagtaggtagcctgcgagtagataagattgtcaagggcgcttacactgacgaccaccgtaagtttgaatttacagtggatgctcaaaagattgcggacaaagatagcaacgatgcagacactgaagatgcggatgacacagatgaatggattactaacgaagagtttaacggcaagtataacgtgaaggtttacagtcgcagcaacaatgaactgcaggaaaactcagaagtagaattcaccaatggacaagctactcttgaattgaaagcagatcagtacgcagtgattgaaggcttgccgctgaatgatgacgaacagttccaagttagcgaaactgatccagatatcgctaacatgacaaccacttgggccaaggacaacgggtcaccagaagaaggattagtagcggaacctgtgacattggatgaaacagacgtgccacggattacctttaccaacagtcttgaaactggcaacctggttcttgataagaagctctcaggtgaaattagtgatactgacagaaatcgggcgtttgaatttacggttgatgctcagattgaagacactgaaacgggcgaatggaagacggatgaggcgtttaccggcgactacacggcgactaagacgactgctgatggccgacagactaccagcaatgtgaccttcgaaaatggtcagcttacggttgccttaaagggtggcgaacgtctgcagatcagtaatttaccggcaaacatgcacatggttgttagcgaaactcctgatggcgattacgaaaccagtcatcagatcaaccacggtagcgaaatgctaggtacgaccactgatccaatcatgattcaaaacggttcagatcaggcggtaaccttcatcaacgatcggccagcacagccacagactgcttggctaagcttaactaagtcagtgatcggtgaaaatggcgaacgtgatcgcggattcgaatttaacattcgcttcctcgatgatcagatgaatccgttgactggtacagttgatgttgtcatgacaacaccacttggcgaacacatcaccagtcaaatgatgcttgatatggatggcagcagctcgtttgcattgatggacggcgaaacgattcgttggcaggtaccaaatgggactcactatcagatcactgaaagtgactactcagcagatggctaccagactagcgttagtcagggacaagcaccagaacgggaaggcttaacagccaccggtgttgtgatgactaacgatcctggaagcgccaaagttgtttactacaaccgtgctgacccagcacctgaagatgaaccgcatacgccagaagaaccagatacaaccgttccaggttttgttccgccagcgtctgaaccaggtaccggaattggtacggataccgaagatactctcggtggttcaggtacgttaggaactggtggttcaacagcaccgcaagctcatacgagtggtactagcggttctggtacggctgccaaaggcttcttgcctcagactggtgaatggatgaagcaaaactggctactcttattaggccttgtgattctgttgagtaccattggcttaatggtaagagcaaagcgtaaaaaaggttgatcaggtttcagataatgcatagttgaggtgtttcaacgaattgtgcaaataggaccccggcaccatttctgagtattcggagatggtgtcggggtttcttgtggtcacttggtccttgaccgtcctctaacaaacgcatagaataacatctggaattcaagttaataaaatcgttttactaactcaggaggatacgtatgaagactcaagatgaacttaaaaaaattgccggttataaggctgctgaattggtggaagatggtatgactgtcggcctcggtactggtagtacagtgcgttacttattagacgcgctaggtgaacgtatcaagaaggacggcgtgcactttaccggtgtcccaacttctaatcggacggctgaatatggtcggaagcttggtatggaaattaaatcgctggatgacgttgataccattgacattaccatcgatggtgcggatgaagttgatcctcaaatcaacggtattaagggtggtggcggtgcccagacgtgggaaaaactggttgccactaattctaaggaatgcgcttggatcgttgacgaaagcaaagtcgtcgatcaattgggcaaattcccgcttcccgttgaagtgctggcatacggccatcatcagctggttaagcggttggctgacttgggctacaagccagaagttcgtcaaaaagatggcaagcttttccggacggatgagggcaacattatcgttgacctgcatttggataaaatcgcggctccttacgatttggctgacgaattgagcaatatgaccggcgttgttgaacatggattgttcttggacatgaccaagacggtggttattggtacccaagatggtgcagttgttaaaacaaaataagcagtgaaaaaacgggtaagcacgattgctgtcccgacaagattttaagcagctcaacggctggtcaatgatgactggccgttgagctgtttgctttaatagcggggattacagccaataaattgtgctcaactgaccccacaaaatttccctaaaaaagttcgaacatttttgttgtaaccggttacatttcatgttattatataaccgtggaagagataagaagccggtaccaggacgtttctaagttgtaaagttttaccgattatgaattgatcccgttttgtagatcgaagtaaatgattggcaacaaacagcaaagacgtttggttccaactgtttaaggcttcagaagtaaagttcgaatgtttcattagtaacaggtttcacgaagtatctagtttcatcaagcaccaagtttcaaagcgagaatttctaacgaacgctagccgcctaaggtttttgtttcaccactaactgaatatgtgtcatatgcttagcgtttctgctaaaacgtgcgaatgtcttagatgtagtgatattttcttaggggttataaagggttcgaatgtgatgtaggctgggtctatacgatggttatgtaataacctttggagtgtagagagttgagttcatgagattcaaaaagtttcatagtgtcatctcatctagttaaacggtaattgaaactgatatgtcattgacaagactattacggcagttgactagaaataagtttttgaggcgatagattattaaattaatgtttacgaagcgggtaagctggttaaacggtttcgtctcttccaacaaagtttcataggggctcaagggtgaaagcaatcatttcaaccttgagtctaattttttggggtccattttcgatactattctagcaagcataatggtataatgtaattccttggcaggggcaactttgagggatgaattcccttgtaaaaggatttactaatcattagatgaatagtagattctttttttattgccatttttgacatatcaaataacgtctattagttgatactctgtgattagtttcactcattgagttttaacttatgtaggtttgctacctggatttatcgaaggtgtatttacggaaaccctaaaacagggtaaaatgggctttgcttacttgtttatttcaaataagtgagtggtggttattgctgaagctgtgcctgcgtgtctgaagatttatgaaagcgctgaactttcttgttgctagttgcgaagtacgtgccattattctgaatttaagtagcaagcaacgatgtcagtaaaagcagttttcttaacgattcagctacccggtgtatagcaaaaataagaaagaaggtttagtttaatgtcgatgtacttaatcgtcaacattattggggtcattgtttatctcgggatcgcgttcctgttctcgaagagtaagaagacgatcaactggaagtcaactgctatcgtcctcgtgcttaacctggttatcgcttggatcttgactagttttgcttggggccgtgatgccgttcaggctgctgccaacggattcaactggttagttcaagtggcttatcaaggtatcgtctttgccttacctaactgggtaacaccacaatttggtgggactgctaagtcgatgaactttattaccagttcactgctgcctatcctgctgattgtaccaatgtttgatatcttaacttacattggtttcttaccttggatcatcaagtggattggccgcggtttatcagctattactggtcaaccaaagttcgaatcattcttctcagttgagatgatgttccttggtaacactgaagcattggccgtttcacgtcttcaaatccaatcaatgcgtgcagaacgtaacgtcacgttggctatgatgtcgatgtcatgtattactgcttccattgtgggtgcttatacccagatggttcctggtaactacgttctgactgcgattccgttgaacatcttaaacgctattatcgttactaacattttgaaccctgtatcggttaagccggaagaagacaccattgctaaaatcggtggcggttctgctgctgaagaagccgaaatggacgatggtaagaaagaaccattcttctcattcttgggtgattcaatcttaggtgccggccgtttgatcttgatcattgccgctaacgttatcgccttcgttgccttagctggtttgatcgataagctgttaggcttgatcaacccatggctgtcacttgaacacatcttggggatcatcatgttcccatttgcatggttgatgggtctgaacgtcaacgatgcattccaatttgctcaatacatggggacgaagttagtcactaacgaattcgttgttatgggtaagattgccccaacgattcatgatgttgctaaatacggtgcccattatcaagcacaattgacagtcttcttgacttcatttgctaacttcagtacgactggtatgattatcggtgccttcaagggcttggctgacaaagaatccaactctttgatttctaagaacgttggttacatgttattgtcaggtatcttggtttcactcttatctgctggtatcgtgggcttatttgtttggtaatcaccacttacgcataagtcgattaattaagttttaaaaccacgaacagcccagatcgagtaatcttttcggtctgggctgttgtggcctagggtgtcgaaactggcgaatgccagctgaaacccatcgtttggaataacgatgcaaccccgatcacaaccgtctcaacgacgaaaggatagggattatttacatgaaacaaacgcaacaacttgaagcaaagaacgggatgtcattacgacaggtgtggcagaataagacgctgctgaagcaagaaattattgcggggctgactggcttctttgccatttcgtacattattattgtgaatccagtgattctaaaagatgccgggattcccacggaccttagcgtttttgcgacaatcatcagttcagttatcggctgtttgatcatgggcttcttcgctaatgcacctgtgattttaacacctggtatgggcgttaatgccttctttacctacacgatttgtgccactatgggcatgtcttggcaggtggcggtagctatttcaatcgttgctagcgcaatttacgcggtggtggcctttacgccgctaagttcagtcttagcggaggctattcccggttcattgaaaagcggtattactgccggaattgggatgtttctggttgagattggcttggaaaaggctggcttgatcgttgctggcaaaaattcactgattgtgctgggtaatttaacagcaccagccacgttactggcgatctttggtattttgctgagtgtgattttatttctgcggcaagttccagctggttttctgattggtatcgtggttaccagtgtcatcggtgtcgttttaggcattcgtgatgagcagggtgtcagtgttcatttatcacgactagctgattaccaccaaatcctgatgcatggtgacttttccaaggcgttaacgattccgtttatcttggccgctttctccatgaccatgatcctcgtgtttgaatctatgggactcttacaaggaatcttgccggataaccggaagttcaaacgggcatttcaagctagttctgttacggctttgatttcaggctttctgggtaccagcccaactgtggctgctgctgagagtgcttcgggaatcgaatctggtggtcgaactggtgtgatggccattactgccggtatcctgtttgccatttccacgttctttgttccactgttgacgtatgtcccacaggcagccattgcgccggtgatcatcattaccggtgccatcatgatggagcccattggctcaatcgatatgcatgattttgccgcctggtttccggcgtttctgattattgtgctgattccgctaaccaacagtatttcaacgggactggcattcggctttgtcttctacccaattttacgattggcaagtggcgatggccgaaatgttagtccagcaatgtacgttttaggcggattgtttctcattgatttggttttaagtgctttactataagaaaaattttagcatggaggctaattattatgacaatcaagattatcatggataccgatcctggtatcgacgatgcagctgcaattaccatggcgattaacgatgacaacattgatttgaagctaatcacaactgttgccggtaacgtgacggtggacaagaccacgaagaacgcgctgaaattagttcgtttcttcaactccgatatcccagtggcagctggtgctaagcaaccgctgatcaagccattcgaagatgccgctcggatccatggtgaatcaggaatgccgggatatgacttcccagaagatttgccaaagccaatgaacaagagtgccgttgaagcactccacgacgccatcatggccagtgatgaaaagattacgctggtgccaacgggttcgtacaccaacatcgcattattgttctctgaatatccagaagtgaaggacaacattgaacggatcgttgctatgggtggctcattgggcatgggtaacatgactagtgctgctgaattcaacgtcttcactgatcctcacgctgctcgaatcgtttacaattcaggtgtaccaatcgtgatggttggtttggatattaccatgaaggctttgttaactcatgaaagtatcgaaaaattaccgacgttaaacgaaactggcaagatgctccatgacattatcattcacgatggtgataactcagacagcggcatcgcaatgcacgatgtgaacacgatcttctatctgcttcatccagaagcaatcaccactaaagagatgtgggtcgatgttcaaacggaaggtccagcaatgggcgaaacggttggcgacattcgcggtgcctaccacgacggtaagactaacgcctctgtttgtgttgatatcgatgcagctgcctttaacaagtggttcatcgaagaagtcactaacatgtcaaagtaaattaatttagtttataacgctgtttataccactatacaaatgaaccgccacaagctgtaaggggcttggggcggtttatttattttggctagaaattcggtggactgtttccaatgatgggaattgtctagtataatgaaaaagtatgcggacagctaaataacgctagaactttcgctccacttcaggcacttggggctggaacgcggtggctcgctccagggctaatgcaacatggcccaaacgtgttccacgaggcagagagttgcatataagtcacttagaccataaactcaagttcggggtttttggtctaagcaccttatactccactctcttaacgcatcgttccgcactctagcctcaaatggatctcctccatctcgcgtgatactagaaagcagccagggcttcgccactatcagcttccaagtatcaccgacaccgctgagccccagcgccttccgttccgctgatgttgtggggacttctctacagaaccgtatttgcgtcagcaacgtagctgttaagttgccaaaaatcgactgtgataaatgcagtggaacgttcaggataaatcgtggtgtcgatgatgttagcgagcgttctttgctcggttacatcatcaggtgacggaggagatccgccccgagcgtagcgaggtgctagctccggagcgcctgcacgacgagttatcctgaacgtggaacgaaatgagctaacagcttagcataaattccacataaaaaagttcaaaatagccagcaataaccatggtcaagagcttgcgtacataccataattaatgtaaagtatactagagcgtgaaacaaagtgtttcacagaatgtcttaggagatctcaatgaataatagtcaatttattgctgccttaaaagcccaaggaattacggtttctgagcagcaaatgcaacagttcgaccaatattttaaaattttggttgagactaatcaacatcttaatttaacaactatcaccgaaagaggcgacgtttacctgaagcatttttatgactcagtgacgcccgccttttatgtgccagagctacgtactgaaaaactgaccctgtgcgatgtcggtgctggggcaggattcccatcattaccgatgaaaatcctgtttccacaactgcaaatcaccatcgtggattccctgaataagcgaatcaattttttgaaggatttgattgctgatttaggcctaacaggtgttagtgtgtatcatgcacgggccgaggaattcggcggtaagcgatcagaacatcgggaagcttacgatgtggtaactgcgcgtgcagtggctcggatgagtgtcttgagcgagctttgtttaccattagttaaactgcacggtcagtttattgctttaaaggcccagcagactgaaaacgagctggcacattcacagtcggccattgcgacattaggtggcaaactcagcttagaccaatcatttaccttgcctgaatcaggggacgaacgccacattgtggtcattgacaaggttaaacaaacgccgaagcggtacccgcgtaaggctggaacgccaaacaaagaaccgctgggtgattagctagaaagggggacgattaggatggcgttttcgttatttggtcatgataaatctaaccagcaaaataatgaaagtatcaaacagaaagtcgtcatggtaccggttgacgcaattgtgccaaaccggtttcaaccgcgtcacgtgtttaacaagcgcagtattgatgaattggcacaaaccatttcggatcatggcttactgcaaccaatcgtcttacgggagtacgaaccgcatcaatacgaaattattgctggggaacggcgctaccgtgcagtgaaatcattgaattggcgtgaagttccttcaattattcaatctttatccgatgatgaaaccgcatcgctggcactgattgaaaacttgcagcgggaaggtttaacgcccatcgaggaggcccaggcttatcaagctttgatgaagcttaataagctgacgcaaagccaactggccactgaagtcggtaaaagccaatcgtttattgctaacaagctgcgattgctgaaactcagtgaccctgttcaagaagctattatgaatgaggaaatcagtgaacggcacggacgagcactgttggccgtaacgccaaaacagcaagaggaactgctaaagcgaatcattgctgatcatttgacagtccgtgatgcggagcggctaattcagcgtcaccgtgctaaagctaagccgaaaccaagaattaagtccgtttcagccgatacccgggtggccgtgaataccattaagaagtccttgaagatggttagcaatgctggtttaaaagtaaaaacaacggaagaagataatgacgatagttatcgaattactatcgacatcatgaaaaaatcataaaggagtgacgaaaaccgatggcagatataattgcgcttgcaaatcaaaaaggcggagtcggcaaaacgacgacttcagtgaacttaggcgcaggactggccaaccttggcaaccgggtattgttagtggatatcgatgcacagggaaacgcaaccagtggggttggtattgccaagtcctccatttcaaaagatatttacgatgttttagtcaatgaagaacccattactgacgtgattttacatacgagtcataaaaatttagatattgtgccggcaaccattcaactgtcaggtgctgagattgagctaacaagtcagattgctcgtgagactcggttactggacgcggttaagacaatccaagaccaatatgactttattttggtagattgtccgccttcattggggttactgacgattaatgcttttaccgccagcaactcgatcttgattcctgtccaaagcgagtattatgcgttggaagggctcagtcaattgttgaatacgattcagctggttcgaaaacatttcaatccaaacctgaagattgaaggtgttttgctgacgatgtacgatgctcgtactaatttgggacatcaggtcaatgaagaagtgaagaaatactttaaggacaacgtttacgagactattattccgcgtaacgttcggttatctgaggctccaagccacggcttgccaattatggattatgaccctaagtcaactggtgcaaaagtttattcgcaactcgcaaaggaagtggcagctgctcatggcaaacaaaaataataaggggcttggacgcggcattgaagcattatttgcggataatagcgttgacccagatgtagaaacagtgatcgatatcaaactcgatcagatccgcccaaatccgtatcagccacgtcaaaagtttgaccaggcagcgttaaaggatctggcaaaatcgattcaaaaatcaggtgtgttccagcccatcattgttcgccaaccagacccagaagttgctcgatacgagattttggctggtgaacgacgggttcgtgcgtctcgattaattaagaacgaaacgattccagcaatcgtccgtgaagtgactgaaccccagatgatggagattgccgtcatggaaaatctgcagcgtgaagatctcacaccgttggaagaggctgaagcctacgagatgctgatgagcaacttaaacctgactcaggcacaagtttcctcacggttaggcaagagtcgcccatatattgctaactatttgcggttactgggtctgccaaagcaggtcaaggagttactgcaaaagaagcggctttctatgggacaagctcggacattgctgtcattgaaagaccgttcgcagatggtgagcttagctaaccgtgcggcggatggtaaaatgaccgtgcgtgctttggagagcgtcgttaacaagatgaacggccaaacagccgccaagccgaagaagcgcatcaagcaaaaatcaccatacttgcgagcaggtgaaaacgtccttcaagaaaaatttgggactcaggtcaccatcagtgagtctaaagaagacggtcaaggtaagattgaaatcgagtatatgtcagacgacgacttaagccggattttggatattctcgacgttcatttagactaggagggattcgatgtacgatttaggtgatttagttgaaatgaagaagccgcacccatgtggtgttaaccgctgggagattatccggatgggcgctgatattaaaatcaagtgtaccggatgcggccacatcgtgatgttaagtcgtcgcgagtttgaaaaaaagctgaaaaaggttttagaaaagaaaccacaaactgactaaaaaggaagagtgagactttactatgtcattaacagcaggaattgtcggcttaccaaacgttggtaagtcaaccttatttaacgcgattaccaaagcaggagccgaaatggctaactatccgttcgcaaccattgaccctaacgtcgggatggttgaagtccctgattcacggcttgaccggattcaggaattgatcccagctaaaaaagttgtcccaaccacttttgaatttaccgatattgccgggatcgttaaaggtgccagcaagggtgaaggtttaggtaacaagttcttggaaaacattcgtcaagtggacgctatcgtacacgttgtacgggcatttgatgacgataacattacccacgtttctggtaagatcgacccaatcgatgatattgaaacaattaacctggagttgggattgtcagaccttgaagccgttgataagcgcttggctaaggttcaacgggccgctaaagggagcgacaaggcagctaaggctgaattggccgttctggaaagaattaaaccagtgctagaagctggcaagggcgttcggacgatggactttaacgaagatgaagcaccaatcttgaaggggttattcctgctgaccagcaagccagtgctctacgtggctaacattgccgaagatgacatggctgatccagaaaactcgaagtacttcaaagacattgaagcttatgcagctaaggaaggcgcgcaagccattgcggttgctgctgaagccgaagaagaaatcgctgagttagacgatgacgaaaaagcagacttcctagaagctgaaggtgtgacggaaccaggcttaaaccgcctgattcgtgcgtcatacaagttgttaggtctagaaactttcttcactgcgggtggtaaggaaactagagcctggactttcaaaaagggcaccaaggcaccgcaagcagctgggattattcactcggactttgagcggggcttcattcgtgcggaagtcatggcttttgatgatttggataagctcgaatcagaaacagcggtgaaggatgctgggaagctaagagttgaaggtaaggattatgtgatgcaggatggggatattgtggagtttaggttcaacgtgtaagagtgtggaagcaagcgtttagagagtggaatataaggcacttttggcgggaatcccgaacttggattcatgccggaagtgacttatatgcaactctctgcttgctggaacacgtttcaaaagtaagagtgtgaggacaagcgtttaaggagcggcgtgtaagccaatgtcggcaaaaatcccgaacttggatttatgccgacattggcttacacatagctccttgcttgctggaacacgttttggctatgtaaaatgcaaagagtgtggaacacgtttcagtcacataagaaacacacttaatcccagaagcgccatccctaaaaaaacaagaaaaaggagacccaacattgagcgaaaacgagaacgataaacgtaatgctggcgcgcagcaacacaaacgtaacgctgctgtccaccaggatcgcaatagcacggttaaaaacgaacatgaagttttcgataacattggtttgaccaagagaaacgcagactatatgttcagattcaaccaggcgttacaagcgactaagctaagcactgaaaagaaggcagaaatcgttaaaaacaccacggctgaattgttagaaggacagaaaaccggtaaaactgccaaaaatatgtatggcggtgacgttaatgcgcatattaaagaaattgttgaaggccccaagcgtccagctggtgccccagatccatactggccaagtgctttgtataatggactgaacttctttactattttcagtttcatgtttggtgtgatgttcttgattacccctgcatcacaaaaggctaatcaaccagtaggtatcttgtcaattcttttgtcgtctgttattgccgggttggcacttccattgattccacgggtgttcgactcaaaacgggaacaccgttacgcactctggatccgtatcgtaggtgctgttgcctttctgattgtttggttaggcctgttctcaatgatggcattgttaccaggatatctaaacccaacagtgggtgcatggccaatgattattcttggtgtactagccggtttggcttcatacttagtcaaacgtcagtacaagttaacgcaaggattttttggcgctacacctcaaagtcgtacaagacgttaaagcaaattaaaatcagtctgatgatcaatcgactaagatcggtcatcaggctgattttaattttgaatgtgaaatttaccaaattcacttggtggcgaacaaaattcagacaaatatttaaattgttcccaaattgtttcaaaattaaccttaaagttcgtattttaggcttcatttgattagaattcgaacttaaatcttacaagttcatgagaaggcttgcattttctgaaagtcgctggtatattaccaaacaataccaaaaaaattaataagggagcgttcatttcaatgactactaattgggattcgaagtttcaaaaacaagggattacttttgatgacgtattacttatacctgcggaaagtcatgtgttgccaaacgaggtcgatttgaaggtccagttagctgataatttgaaattaaacgtaccatttctcagtgccagcatggacactgtaacggaagcaccaatggcgattgccatggccaataacggtggcctgggtgtcattcacaagaacatgtccaaagaagcacaagctggtgaagtggctaaagttaaagctgttgctagcgataagattcgtgctaacgcagcggtagatgaccaaggccgtctactggttgccgcagctgttggggtgacttcagatacgtttgaacgtgctgaaggcttacttgcggccggtgcagatgccatcatcattgatactgctcacggtcattcagctggtgttttacggaaggttgctcagattcgtgaccaattcccagatgcaacgttgattgccgggaatgtcgcaactggttcaggcacccgcgctttattcgaagccggtgttgacgttgtgaaagttggtatcggtcctggttcaatttgtaccactcgggtcgttgctggtgttggtgttcctcaactgactgccatttacgacgctgctgaagtcgctcaagaattccacaagccaatcattgctgatggtgggatcaagtactctggcgatatcgtcaaggctttagctgctggtggtaacgcggttatgcttggttcaatgctttcaggaactgatgaagcgcctggcgaagtttttgaagacaacggtaagaagtacaagacttatcgtggtatgggttccttagcagccatggaacacggttcagctgaccgttacttccaaggtggcgttaatgaagccaacaagttggtgccagaaggtatcgaagcgcgtgttgaatacaagggtagcgtcgacgacatcattttccaaatggttggtggtctacgctcagggatggggtacaccggttgtgaaaccgtccaagacctcatcaacgatgcacagtttgttcggatttcaaacgccggtttagttgaatcacatccacatgatgttcaattaactaaagctgcacctaactacaaataattaacagttataagctattgaagcccgagagaggctgttaccaagacttctctctgggcttctttttgtttattctcggaatctgctgtaaaatttaatgagaaccttaagttaattgattaataatgattgctggcctatcttttggtaagatagacctaagcaaacgggaaggtaaaagcctaccggcgcgcgcatgaataagtgactgataagtcattttaattgaccgaattggatttataaggagaatgtgcaaacatgaaaattttagttgttgatgacgacaaagaaattgctcaattactgggcatttatattaaaaatgaaggttacgatccaatcactgcctataatggtaaggaagccttaacgaagctacataccacgccagatattggtttgatgatcttagacatcatgatgcctgaaatgagcggtatcgaagtgattaaggaagttcgtaaagattctgaactgccaattctgattctgtctgctaagactgatgatatggacaagattcaaggcctagtcagtggtggtgatgattacgtcaccaagccatttaacccacttgaagtgatggcacgggttaagtcattattgcgtcgcgcttctgatcacgtcactgacgagaagccggatgtgttagatatcggttccttaactatcaataaggattcccacgaagtcaaaactatctcagggaagttagtcaatttaactgccttggaatttggaattctatatttgctggctagtcatcctaaccgagtcttttcagcggatgagatcttcgaacgcgtttggcgacaggaatcaatcgtttcagccaaaacggtaatggttcacgtttcacatttacgcgataagatcgaagaagctactggtggcgaaaaggttattcaaacggtttggggtgtcggttataagattgaaacacactaggggaaatatgaatacagatagcaaaggaatgaaactcacagcaagggaaaaaagcgcgctgatcatggaaggtatcgtgaccgtcgtgcttttgctgttacttaatctttcggtgattgtcctgttaaacgaaatgattcagacgaacccaggccttcaagacgggatttttatcattaaacgatcggtaattattgggccagcccactaccaactctggagctgggagaatatttttattgcgttaatgcttatctttgatgctggcgtggtttactggcggctgattcgtcgttatcggcagatgcagttacggcacattattgacgaattgcattatattgctaacggccattttgatcaccggattccctttaccattaaaggtgaaacacagcgggtgattacctcagtgaacgcgctggttgattcagtaattgcttcgatgaccgaagaacgccgtattgaaaaatctaaggatgaactgatcactaatgtcagtcatgacttacggacgccattgacctcgatcattggttatttgggtttagtagaagatcggcagtatcattcagaagaggagttacttaaatatacgaataccgcctttaataaagctaagcagatgaaatccttggtggatgatctctttgtctatacgaaaatgcggcagacagatacgccattgtcgattgcggagctagatattggtcaaatgttggaacagttggaagccagctttgaactggaagccggtgaaaagggcatgtcaatcaatattgaagtacctgataaaccagtgcggattgaagcggatggtgaaaaactgggtcgggtattcaataatttaatcacgaacgctttgaagtatggtgaaggcggtaagcacattaatttacgtgctgagcaaccgaatgacgaagaagtcgtggtcagcgttgaaaacgatggtaagaaaattcccgaagcagccttatcacaggtctttgaacggttttatcgagtggaaggttcccgttctaaagccacgggtggtactggtttaggattagccattgcccaaagtattgttaatcggcacggtggttatatttacgtgacgtcaagtgacaaactgacccggtttatcattcatttaccagtcaaaaatggtacgcaattaaaagacgatcgagaaaaataattctgtggaggcactcatgacgactgttaaatctccaagaaatagcctgcatatcgggctatttttgtgcattttcatgatgatattaatgtttggcggactgactgcaaaggcggccagtcctaatctacaagtcaagtcagcgattgcggtggatgcgcaaactggccagattttgtatcagaaaaatgatcagcagaaattaccgattgcgtccatgactaagttgctgtcgacgtatattgtgttaaatgacattaaggatggcaagttgcattggaatcagcaggtggctattagccccgaaatcgccaagatgagccgcaatgccaatttgactaacgtgccgttgagtgcaaaccggaagtatacggtacgtgagctgtaccaagccagtctgattacttcagctaacgcggcggtttcggctttgggtaacgctgtttcaggtagtcctcaccagtttgtgaatcggatgcggtcaactgctaaacagctgcatttaaacagtgcacatattgtgacggcttcaggcattactaatggtcaagctggtcagttaggctattcttcagtttccaaaagtgatgaaaataccatgtccgctgaagatgttgctcgattatcacagatcattttaaagacctatcctgagatccttcagaccacacgtctaagtacggcgtggtttgataaggggggcagcagccagacactgatgcatacttggaatctaatgctgaagggtcaaagtcagtatcaggctaatttacccgtagacggcttaaaaacagggacttcaacggctgctggcggtaactttgttggcaccgttaaccgtgatggtcaccggatcattaccgttgtgatgcatgctcaaaataagaagtctggagatccagcacgttttattcaaactcggaaattaatgaactgggtatacgctagttatcaaccggtaatcctgaatgcccaaacgttccaaataggcaatgttaaagtacccatgggaaaaagtctgaacgctgaagcaacggtagctaaaccaatgacagtttggattggtaagaatcagtcgagaaagcaacttaagtacagagtcgctctcggggcggattatcgcgagaaggatgggctgaaggcaccgttagccactaatacgaccattgggaatgtgaaaattacgttaggtggtcaatcaatttcacaaattggccaatcagggactttatctttaccgattaaaacgcttaatgatataaaacgggcaaattggatagttcgcacttggcgtgactttttatcattgttctaacggtcagccgtttataaatgttaattacgaactttaacaaaataatgtttaatattgtttgtaaattaaattaataacggaaaaatgtaaaatgaatttattgtttttttgtccagctaacttgtgaaaacaccgtaggaaaacgggatgaaacatggtaaaatgtccttgtattgtgtaattgtcgatttatggagcggatgcacgactttgataagagtgacttaacatgagtcattatcttgtgtcaaacgtgctccagcagacaggaagttactttttagatgctgctccctaagcgtctgcttcgccactctaccttttatggaggcatcattcttgacaaaacaagtgccaaaccctaacgagcccaaatggcgttcaacactcaatgttgctatgccattgaacttaagttatattccaatcggattagcttgcggtgtgctgttgcatgctgccggtttcaatacgattttaaccgggcttgtgtcaatttttattttttcaggcggtgcgcaatttatgattgcgtccatgctaacgatcaatgcaccattactgtctatcgtgttaatgctgttcttcttggaattgcgttatgcgttgcttggttcaagtctatccaagtatttggtgggaacatcagaacgatttaagttgatctttgcggtttcgatgaacgacgaaaactacgcggtgaactatttaaaatttgccactgataagaagtggacgccccgtgaagcactaatggttgaacactattccttactgttttggaccattagtaacattatcggtagtttagtcgggagtgccctaaagattgatttaacggtggttcattttgcgcttactgcgctgttcctctacatgatcatcatgcaggttaagaaccggctgacgattttcatcggtttgattgcagcggtattggcagtgttcttcctcgtactgacaaagagtacgttaggattagttatttcaacgttgatttcatcatttatcgggtttgctttggagcattatttacgcaacaagaagccgggcagtcatttcctatataaagttaggagtccagctagcaaagaagcagcagtcgaagaagagtcggacgagaattagttaagtaggggacagatatggcagcagtaaatcactggaatacagcgcaacatctcttattagttatcttggggttcttcgtggcctttgcaccacgttacttgccaatcaagatttttacacagcgtaaaattccggaatggttcaacgaatggatgaagttcataccagtctcgctgtttacagcactggtcgtgaaagacgtttttgtgagtccgacttatcaatttgacgttgttcatcatataccggaaatcattgcctcagttattgttggattgattgcgtacttcacgcggtcaatggcactttctgtagtagtgggactgatcagtgtattcttactggcggttgtgttgtaagtgaacttaaatttgaatattcatgggcttttttaagcccgtgtgaatagtaaagcagcgtaacctcgagtgggttgcgctgcttttttgggtgattttgaatggttgaattttatatagccgaattgggcttcaccaggcagagagctgcatgtaagttacttccggcataaatccaagttcgggatttttgccgaaagcaccttacactccgctctctaagcgcctggttccgcaccttgtcttaatcgggctccaccaagcagagacttgcgcctaacgcatcagcactataaatccaagcccgggatttacagtactaatacgttaggactccagtctctaaccgcttgtttccgcaccttacttattcatatagcccctcgtcatcggtaactcttttgaagaaggtccctttgacaccaagaactgcatgacatcaatattacccgatgcgaaggacgccgcacacgcctgcaaataaagatcccacatcctcgtgaagcgttcatccatcattttggtgatttccgattcatgcgttttgaagtttttatcccaaatttccgtcgttttttggtagtgccgccgcaaggtttccaagtcatctaactgcagaccggcatccaaaatatgctgcatattttccgttagacctgggacgtaaccacccgggaaaatccacttgttcaaccagccgttgttagcacccttaccctgacgagtgataccgtgaatcagtgccacaccatttggtcgcagatacttagcaacgtccttgaagtattcgccgaggttttcttccccgacatgttcgaacatgccaacggaagtcacgtagtcccactggcgatcacccaattcacggtagtcgaccagtaatatttcagcaacatcctccaagtgttcatcggtgattcgttgctgaactaaatcatattgttcctggctgagtgtgacaccggtgacctttaaatgatattctttggcagcagttaacattaacgtgccccagccacagccgatatccagcaacgttttgccaggttgcgggttaagcttattgatgatgtggtgcaccttattgatctgtgcggtttccaggtcatcatctggatgttcgaaataggcacaggaataagtcaacgttttatccagccataatttgtagaaatcatttcctagatcatagtggctttggatatcttgtttgctttccttctcgtcgtgtttttgcttcggcaggaagtggatgaacttactgttatggaagaaactgtcggcggtttcgtaggctgcggtgatcaacttttcgatactgccgtcgatttcaatctttttatccatgtaaccttcacccagggcaatcgaagcattcttacgaatatcgttaattggaatgggctcgttcaaagtaatgtgaacttcggggtcgccatctccgtaagtttctgttttgccatcccagtaagtgaccttaactggaatattaaatgaacgactcagaaaggttttgtaaaacgtcttttcaagcatgaatttcaatcctttctttattaaatgcaataattaatacttatcaattatacgccttttcgtcaagcgagtattttttagcttttagataatcttgttaatcgctactgccgtaggaattggcaacatgttataatgaaaaataagataccgaaagtgggaggaattacattgaagaagtggatctggactatcgtggctgtcgtgattatcgccgttgttggcggtgtcgcctttacgggtcatcacatgacgcaaaaagcttattcgacagcgatgatgactgggaaagaagcggtcaacaaaaagaactattctattgctgaatcgtcgtttcaagaagcgttgcggcaccgtactaacgataaacaagcgcaggggtatttgacgcaaactcaaaactttgtgtcagctgaatcagcaatgtctgatcatgagtttggtactgcaaagtcagactatacgaaggtcaaaaatgccaaagctgggctgtcaacactgaacaaacgtgctaaaacagcgttgactctattaaagaccgttcagcttaaagcggaaatgttccaagatgtctacgatcaggctttaactcaaaatcaggggcagtcttatgaagcctctaatgccactttggatcggattttcaaggatgctgaagctaaagaaccctactacaccgatatttacaataaagcggtggatctacgtagcgctaataataaagctatcaagaatggcggtgacggcactgccagcacaagcacaagtcccactgatagttcagcaagtaccgacagttcagcttcaagcagcaccagtggtccatcaagtttaacggatactgaaaagcaggccgctaaaaactataagggttccaatgaatttacggttaagaagtcacagactgagatcaatgggaagacgattaccgctacgcaaatcgccagtgcccgcaaaacgttatcatcagtaggcgtttcagctggcagtttttcggatcaggatattagaagtgggttgattgctgctaataaagctggtatttcgtttaaatcatacgcacaaaaaaattataaataacagtgatggtccttgattggccacgatgttgtgtggcaacaagggctatttgaatctatccgtaagagggaagggacgccatgagtttatatcagcgatttgttaacaatgttgtcctaagacggtgggtcgttttaggtattctgattggagtactgtggctagtcagatctgaaatgagtaagattttactgacctttatcttcacgtttttgattatcaggctgatcaggggaattcagcatcacgtaaagataccctatcaacttattgtcatcgtggtttatgccttactcatcattgggctttacttcgctattaccatttacattcctaagattactgttcaggtggtttcgggtgttcagtcgatttacaatttctatcagaattcggctaatgataccaatcagacggttaaattagtttcagactggcttggtaattccaatcttttgccacaggtcagaagtggcttaaaggtcctcgtggactacattacaagtattggttcctttggtgtgacaattgtcttgtcaatcatcctaagcttcttctataccatcgagctaagacccatggaagctttttctaagctgtttctgagcagtgattatggctggttcttccaggatatctcttacttcggtcacaaatttgcggatacttttggggtcgtcttagaagcgcagttcttaatcgcgctgttcaacacggccatcacaaccattggtctcgcctttcttcacattccgcaactattggcagtggcaatcatgatcttcattttcagtttggtaccagtagcgggggtcatcatttcagcgattccactcagcattctgggttacgcggttggcggtgccagagatgtagcgacgattttgatcctgctgctggtggtccatgccatcgaagcttacgtgttaaatcctaagctgatgtccagtaaaactgaactgccaattttctatacattcgtggtactattggcaggtgaagcgatgtggggcatctggggattgatcgtcagtgtccccattttcactttcttcctagatattcttggggttaaaaaggcacacggcctgtacgtggcgcctaaagaattaaaaaagaaaattaaagaacgacgtcaacgctggcggtcggacgactaacggcgcggatgttgattaacatattggaggttttattttgaaaaaaacactctcgtggttgatacctgttgcaatcgggttactgctggctgttgggattcgttttctctggttggtaccggtcaacgtttctggtgcgtcaatggaaccaaatttgaaaaatggccaacatgtcgtggcggttaaaacagctaaggtaaaacacaattcagtgatcgtttttgatgcttctggggttgaccctaacgcggcaccaaaggaaaattacgtcaagcgggtcattggtatgccaggtgattcgatccgttacagtaagacgggaaaattgtacgtcaacggtaagtatcaatctcaaaactacatttctaagtacgaacagcaggggggcactctttctggttacaataacgggtttaacttagtcaccgctgctcgtcaaaacgactggagcaacaagtggagcttagctattggcaataaccgtgtcaataaagtgccaaagaattgctacttcgtgctgggggatcaccggagcgtttccgaagatagccgagtttatggtttcgtaccaaagagtaagctggtgggtgttgtgaaggtcggtttctggaagagcaaccacaaaatcattaacgattaccagaattaggtgtgcaaatcagttcacaaataattaatctttttaagcgggttcaatctatgaaaggattgaacccgctttcctaatgtgaaaagcgaattgggactggaattacagttgatttggtgtaaaatagtttgggtaattaaaagaagaaagaggtatttaactaatggctaaattagtattgatccgtcatggtcaaagtgaatggaacttatctaaccaatttactggttgggttgacgttgaccttagtgatgaaggtgttaagcaagctatcaacgctggtaagttgatcaaggaagcaggcattgaattcgactatgcttacacttctgtattgactcgtgctatcaagacgttgcactacgctttggaatattcagaccaactctggattccagaaaccaagacttggcgtttgaacgaacgtcactatggtgctttgcaaggccaaaacaaggctgaagcagctaagaagttcggtgacgaacaagtccacatctggcgtcgttcatacgatgttttgcctccattgctgagtgcagatgatgaaggatcagcagctaacgatcgtcgttatgctaacttggaccctaacatcgtacctggtggcgaaaacttgaaggttaccttggaacgggttatgcctttctgggaagatgaagttgcacctaagttgttagatggcaagaacgtcatcattgcagcccacgggaactcattacgtgccttgagcaagtacattgaaggtatctcagatgaagatatcatcaacttggaaatgaagacgggccaaccagtcatctatgacttcgatgagaagttgaaggtattgggaaagagtaagttaggctagagtgtggaagcaggcggttaaggagcggcgtgtaaggtgatgttggcaaaaatcccggttttggatttatgccaatattgacttacacatagctccttgcctgctggaacacgtttcggctatatagaatcagagtgtggagtagaccgcttagaccgcggcgtgtaaggtctggtctacataacacgtttcagctatataacataaaaataagtcaaaaaagtggtcactaacgggcgtttcgtctgtcccgtgggtgatcatttttctgcgctaaatcgcagtagtatcaactcaacattgtatataaataatcgaacaggagtaacagaattttggataacggaacagaagtcagtcaacgagaaatgttaaaaatcatcggtctttttagaaaaaacgggttcaaaggtgaatacgaaacctttgaaaagtctaaggaagaaacgggcgagtactttgtcgtcgttacggatgaaaatactcatatcaagggattatttaaagctaaccctagtaaagacatggttgcgtttcaacatgttttaaacgatcataatacagttgcgtagtcattaacgacagagttagtcatacctctgaagttcgccagtcaacgaattcggaggtatttttttgttaaaaaagatagtacagtcacacacaaacaattaaagattgggatggcataagagagatgcatcaattaatggcagagtttatgggcacagccctaatgattttattcggggtgggtgtccacgctgacacagtattaaacgatacaaaatatcatggttcaggtcatttgtttgcgattacgacttgggcatttggtatttcagttgccctatttatttttggtaacgtaacaatcaacccagcaatggctttctgcatgtttttattaggcaacatgaccttcattacatttattgaaacagctatttttcaaatggtcggcggggttgtcggtgcgttaatcgtgtacatgatgtacgctgattcattcaaacattcttatgataaagttgatccagtgacgattcgtaatattttttcaacgtcaccagcagtacggaatttaccacggaatttctttgtcgaattcttcgatacgtttttatttttaacttctattttggcgatttctcggattcacattccaggcatcgtaccaattggtgttggcttagtggtctgggcaatcggtatgggactgggtggtcctactgggttcgccatgaatcaagcccgggatctcggcccacggattgcacatgccattttacccattaaaaataaggcggacagtgactggcaatacggtttaatcgtgcctggtattgcgccattctttggtgcagtagcagcggcattgttcgctaaattttatttaggaatttaaagtcaattaaatatattttaaaaggactaagaatgcggatagcacttttagtccttttactatttattagtaaaatattataggcctttgcttggtatagtttattttttagcgatttaatagaaaaacaatcgtatatttttatcagaaatatcgtccgtatctctgtaaataatattatttatgaactacaatactgttgtatgagcaataatctatttatgatagatttcagagaacaggtgttgcctttacgttatggagaagttgcgtatcggctatgtgatgtttgaacagttacacctgtgaaagagggggataggtatgctagaaacgataaagattacccatcggttatcaggaaagtacagaactgaatttgtatagctattgtattgaataggtatgaacaggaattgaaatgggttttaatgaaagaaagtgtaattttgagaaatcgaaataagcttatgaaatgtaacgagaccagacactataagatgtacaaagcagggaagaattttctctttgcaagtatttctatgatggcgatgggctcttggatgtttttgaaccaaactgcatacgctgacgttaagccaagtgtttcaatcacggcacagataaagacgcctacgagcagcactaatagtgatcaggcaggcactcagagttcagctgcttctggtagtacaacacagggtcaatctactgatgggagtagtactgaccaaaaaagtaacgaagggtcaagcactgatactgcaacggctacaactcaagcaaataaatcaacatctacaagtactaaagaaacagcaacgggtaatgcgactaacaatacggcacagccacaatttaagtatgaagtagatgcgacgtctgaaacgccgaatgcagatcagggcaatgtaagcgctgcccaaactgaaacgccaactacgacttcgaatgcaccgactagtttgaaaacaattgatcaattaaatggtgaatacatcgacgataaaggtgatgtatcaaaaacaaagccagctccagcaactggtggtggtcaaactgcaagcactgctgatatgtctaaagatgttactggtgatttaacagcagttaccgataatggtaatacctattacaccacaactgacggtaacttttcaggccaaggtgggcaaaacgatagttctcatcatgttgttattgctcaaaagggtagcacgtatgataactttggcaaggtttattacgataataataagaaacaatgggtattgctggctgcggatactacgggtgctgctggttcatattcctttaaaaatcaaattgataccacttctgcttttgatattcagggtgaatggtatatgagcaaaaataaccctggtggtggtgtcggcattatcttacaaccagtcaacccgcaacttgcaggtattggcagtagtagtaatgccgcaattgatattgggattcaagggcaaaaagataccacatttttaggatttgatggttacaagagtcaggcaacggaggaccatgattccaacgtaggtgagttaactattcgtcagactgatgatactggtatagtgggtcctaatggcggtggttttaatagtttaacgttggctccgagcggtaacgttaatgcaacacaagaatatccagatactccagcggccactgttggtgctagtaataaaggcgacaagttggatgttctctttgacgtcaaatggacaccaactgatggtaccgtaagcgcaaagggcaacgttactgggacattagcagtagctgcttatgacccgagtgattctacaatgaaaacaccgttagggaaaattgttactactaataatgtttcattgccaagtgcttcatctattgcactatttggtgcattaggtggtagtggtgcaggtgtgaccgtacaaggacgaatcacatcatacaatttacaacaagtttcacaaaaagtaacagtcaactaccttaatattgatactggtgccacggttaaggcacagactcaaatcaatgctaatgttggtaacacgttggacgttgaagaaaccacttcaggaactagtgctagttacggtgcgcctgttattagcggctggacctttgttggtgctgttggaacggacactactggtaattatcaacaaactactatggacgttgttaatactagtacactgcctgatgatgctaagggtacttataacaccattaacgtctattataaaaaagttgatgctaacgcaaagagtcggactgttgcaccctatacaacacctgatggcacatctgtacccgaagctagtcaagcatctgtgggtgctacgtcaattccagctgtaaaagccggaacgaccacacccattacggatgcaaagggtaatccaattgatctttccacaactttaaaagcaattccaattcaacaagtggctggttatgtttctggttacaccacgggtggcggaacctttaaagcagctactgcaattccatccagtaatggtagcgatgcaggtacgacttacacggtacaatacgaatctacatcacctaaattagcggatgtaacaattccggaaggtgcgacaccacaaattggcttggctgctagtgacaatacagttgcgccaacagtttctttgacccgagacgatgtgacagttacgcaagatggtaatacaatcagcggtgcttattcaagcttgatagctggtaaatacgaaatcagtttgacagctagtgggcaagctaaagttgtagctgcctatggtgttgatgcaagcaaacttgattttactcactcagcaggtacgttgatggttgggactactacactgccagttcaaaaagattctgatggtgggacaacccaaataacgattgataccaaaactaaaaatgtcatcatggttgataagacttggagcgatggtgatgtttcacacgttgaaatcaacacaacagataacacggcaacgttgactgaaactgacaacggcggcagtgctgttggaccgcagaaagcaaccattaatcaagccgacactgtgggtgcgacaactttggtttatcacggtacgggccagagcagtactgacaagatgtttgatttgactcatgtaaatgccaaagcaacgacaagtgataatcaacaagtagttacgattgctactggtggtgatattacttacgttaataaaggtacgtatgatcaaggactcgctgctggtaaggctgactatgctgctggaaagactgaacaaactagtacgcaattaactactgctaataattcaactgactatatttcggggtatcagcaaggatatgagagcagtgaaggaacagctgaaggaactgctttaggcgaaaccggtgcaactaatcctggtgacatggcaggtaaatctcagatatatcaagatgcttataagacagcattcaatacggctagtggagaatataagtctggttttgcggctggtggtagtgacgctactgctagcaaagataaagttgataactcaacccagactgtagcttatcagaatggttatactgctggttatgatacgaatgctggtgcagcggcaggtaagagtgatggttcagctggtaaggctgctgtagataacagtacgaagtcacaaacttatcaaaatgcatatacggctgcatataataaagctaaggatacctttgatggtactcatgccggtaatagtgatggctcagcgggtaagccggctgccgataacagcaagcaaagtactgattatcaaacggcttattcgacagcctatacaaaagctaaggcaatctacgatacagactatcaagctggtaagactgacggtgttgctggtaagactaagagtacaacaaacacgagtgccggttatgtcaaaggttacagtgatggtcaagcgagttataatgccgattatcaaactggtaagagtgatggtgtagctaataatccaaagagtacgacaaacacaagtgccggctatgtcaaaggttacagtgatggtcaagcaagttacaatgctgactatcaagctggtaagactgacggtgttgctggtaagactaagagtacaacaaacacgagtgccggttatgtcaaaggttacagtgatggtcaagcgagttataatgccgattatcaaactggtaagagtgatggtgtagctaataatccaaagagtacgacaaacacaagtgccggctatgtcaaaggttacagtgatggtcaagcaagttacaatgctgactatcaagctggtaagactgacggtgttgctggtaagactaagagtacgacaaacacgagtgccggttatgtcaaaggttacagtgatggtcaaagcgagtacgaaaccgataagaagaatggtacaaacgctggtactacagacggttctgctggtaatcctgcagcggatgtgagtggacaaccacaaggctaccaagacggttataatgccgcatacaagaaagcaaaggccacctatgataccgatgccggtaccaaagctgggactagcgacggatcaacgggtaagccagccgctgacattagtaagcaaagcacagattatcaagcagcttataagacagcctatcagactaatagtgatgactatcaagcaggtaacgccgacggggttgccaataagactaagagcacaacgaacacgagtgttggatatacgaatggttatcaagcaggtcagacccaatacggcgaggacaagactcaaggtacgaccgatggtcagatagccggtgccgctggcgacccagccgctgatgtaaccagtaagccgcaaggctaccaagacggttataatgccgcatacaagaaagcaaagaccgcctatgataccgatgccggtaccaaagctggaactagcgacggatcaacgggtaagccagccgctgacattagtaagcaaagcacagattatcaagcagcttataagacagcctatcagactaatagtgatgactatcaagcaggtaacgccgacggggttgccaataagacccagagcacaacgaacacgagtgttggatatacgaatggttatcaagctggtcaaactcagtacggcaaggacaagactcaaggtacaactgatggtcaggcgtcgggccgctggcgacccagccgtgatgtgaccagtaagccgcaaggccttatcaaatggttacaattccccgctatcagaccagcttaagcaacgataccgatgccggtaccaaagctgggactagcgacggatcaacgggtaagccagccgctgacatcagtaagcaaagcacagattatcaagcagcttataagacagcctataagactaatagcgatgactatcaagcaggtaacgccgacggggttgccaataagacccagagcacaacgaacacgagtgttggatatacgaatggttatcaagctggtcaaactcagtacggcaaggacaagactcaaggtacaactgatggtcagacagccggtgccgctggcgacccagccgctgatgtaaccagtaagccgcaaggctaccaagacggttacaatgccgcatacaagacagcccatacaagttacgatactgatgaagctaccggtgtcgctgatggtactgccactggtttagctggtaagactaaggctgatttaactggcaagtccacaggttatatcaaaggatatacgagtggttacgcagctggtcaaacggcttataacactgaaaacactgctggtactaaagccggaagtgccgatggattagctggtaaagctccggctaatcttatcggtgaatcacagggttatcaagacggttatactgccgcttatgccacagctcatacaagttacgataccgattatcaagccggtcaagccgcaggtcagactgatggtacaaccaataagactgctgataacactaaacaaactgcaggttaccaagccggttaccaagatggtcatcaaactggtgaacagctttataacaccgctaagactgctggcaccgcaactggtactgctgacggattagctggtaagccatcagttgatttgagaaagcaaccacaaggttaccaagacggctacaatgctgcttataaagtagcccatgccagctacgatactgatgaaactattggtgccactgatggtactgctgatgggttagctggtaagaccaagactgatttaactggcaagtctacaggttataccaagggctacacgagtggttacacagctggtcaaacggcttataacactgaaaacgctgctggtactaacgccggaagtgccgatgcattagctggcaaagtacctgctgatcttactagcgagccaaagggttatcaagatggttacaccactgcttatagcacagctcggacaagttacgaaaccgattatcaaaacggtcaagtaactggtcagactgatggtacaaacaacaagactactgataatactggcaagtctgccggttatcaagccggttaccaagatggtcatcaaactggtgaacagctttataacaccgctaagacagttggtaccactgctggcaattcagatggattagctggtaagccatcagctgacttaagcaagcagccacaaggttaccaggatggctacaatgccgcttataaagccgctaagggcagttacgacactgatgaaatcgcaggaactgctgtaggtgcttccgatggattagctggcaagacaacccctaccgatttgacaggcaagtccgctggttataaagctggctacacaaacggctataccacgggtcaaaagacctatagtactgaaaaaactgctggtgctaaagctggtactgccgatggcttaagtggtaaaacgcctgttgacgtcaccaatcagtcacagggttaccaagatggctacaatgccgcttataaagcgggcaaggcaagttacgatactgatgaagttaccggtgttgctaatggtgttgccactggtttggctggtaagactcaaactgatttgacaggcaagtctgccggttatactgctggctataccaacggctacacggccggccaaaaggcatacaatgctgaaaaagctgctggtactaaagctggtactgcagacggtttagcaggtaagactgcagttgatctgagcaagcagccacaaggttaccaagacggttacacagctgcctataaagctggtaagaccagttacgataccgatgaagttactggtgtcgcagatggtgttgcaacaggtttagcaggtaagacccaagctgatttaactggcaagtccgcaagctacacgactggttatcaagacggttatgccgctggtcaaaaagcttacaacgctgaaaaggcggctggcagcaaagccggtaccgctgatggtttaagcggtaagacaccagttgatttgactggacagtctaaaggttatcaagatggttacaacgcttcttatccagcaggttatgcgaagtacattagcaactatcaaactggtatcacgtttggtatcagtgatgcgacctttggtgtttacacgtctaacgcgactaaggaagctggttaccaagatggctacgctgctggtcacagaattggtgggtagcaatacaccgaagccgaaacggctggtgctacggctggtactgccgatggcttagctggtaaatcaccagctgatttgaacagtcagcctaaaggttatcaagcgggttatagcgcttcttatccagcaagccatcagtcctacgttagcgactatcaagctggtcaaacagcgggtcaaaacgatgggactaacaataagacaacggcaacgactggtaagagtgccggttatgaagctggctatgtcgcgggtcatgaagttggcgaacaactttacaacaccgataaaacggctggtgccgcagctggtagcaatgacggcttagctggcgatccagcagctgatttagctactcaaccacaaggctatcaagatggttacaacagcacctatccaactagtcatcaaacctatgtggataatcaggaaacggttagtggtgaacctgaaaacggtcaagctgttcagaccactaatcaaccaagtgatccggtaaatggcaccgctaacaattcacagcaaagcgctccatctgacgcaaacaacctcaagacaggcgctgatgaagatgtcaacaagaacggacaggaaactgatccttcagatcatctggtcaatgatgaagctcatgctacagccggttacacgcagaagcaaactcaaaaaggcagcacaactggcagcgttcgtgggcaacagacaactgtacaaagtcaaacgacccagtacggtacggctcagccaacaagcgttaacaacaaccagttgccagctgataaattgacttcaaaggcaaacaagcaacaggcaaataagcagcagagtgcggctcatcaattaccacaaactgatgaacgtcaaaacagtgctgtcacgcttttaggttcggcaatgctgttgggtgtattaggtctgtttggtttgaaacgtaagaagcgtcacaattagaattaacttgtgacaaactaaaaggaagtacaatttcgtaaatgaaattgtgctttctttttagtttgcaaataagattaaatttacgggtttagtggaactgcatcccaccatcaacttcaatggtttgtccagtaatatagttggaatcaggaccggctaagaaggcaaccgcattggcaacatcttctggttcagataggcgtttcaaagcgatatccttggcgaaggtctgcatgccccagtcgtcatccttgccagcgttttgaccaacttggtgagcgatatcaaacatcattggggtcttaacaattcctggtgcataggcgttaaccgtgatgttttcctcagctaaatcacgggcagcaacttgggtgataccacgaacggcaaacttagtcccactgtaaagtgataggttagggttaccaacaacgccggcttgagaagtggcattgatgatcttgccacctttgctgttcttcttaaattgttcatgagcagcttgaataccccaaatatcaccggcaacgttaacgtggaaaactttgtcgaactgttctggcgtaatcgtatcgatcggtgtagttggaccaaggcctgcgttgttaaccaaaacatcgaagccacctaatttttcggctgcttcctttactgctgcgaagaagctgtcacggtcactaacgtcaaccttgacggcaatagacttgccaccgccatcgttgatttctttagcaacttcactagcggtgtcagtatttaaatcagcaaccgccactgcgaatccatctgaagataatcgcttaacaatggctttaccaataccttgtccgccaccagtaacaaaagcaactttaccgttaagttctgtcatttgaaacgcctcctaaaattgttgtttcacaacacctttagattagcataattattcagattttgaaaacgattacactttcgtactttgattagaagacactaaaaaagacaagtccatttcagtgaacttgtctttttaatctatctagtgaactcttgcaggctcgtcatctggtgtcaccttatcaactccagtggaaacggctgtctttgttttttgagcgcccttgccaacggcgtgttttgtcttatcgccaagttcaccaactttgtcctgtacagaaacggaatcgtgttcatgttcagcccgagttttgatatcggtaacggtcacgttaacttcaatcacgtctaagccagtcatgtcatcaacattttcaacgattttccgtttgatttgttcatacagcttaggaatatcgatgccgtattctgccacgatatttaaatcaacagccacttgctttttaccgacttcaacatcgacaccagaagtgacatcatttgtgttgactaatttatcagcaacgtttgcgaagaagccgccatcgacactgagcaagcctttgatatcctctaaacaaagaccgacaattttttgcaataccttgtcttcataagttaattcgcctttgatttcaggcttcgtgttttccatttcgggtttgttaagtgttgtggttggcattaaatgtcctcctttaacgtgggggttaattaaagtaatcatctaatagaccagtttgtgaaaggtaaagtccagcggcgatgccgagtccgactaaaatgaacagaaccagcgtcttccaaaaaccaatcgtgagtagcaatagcgcaagcactaaaccggtggtaccaccgatgataggccagcggtaaattctgagtaactcaggcacgggcaacgcctccttcatacaacgcgggggtgattagactgtcggttccgcttgaaatccgtcaaatggatatcgattttgcggtcatggtcaatgcctaacagttgtttcagatcttgttctagtttttctgcaaactgtttagattgcaatgttgcgttggaagatgaccgcagcgtaccgtgaattttgattttgagccgtttttgcgaaagtttagtggtaacttttgggtcgctaataaacggttcatgtcgtagtgaggaaagggtgaaattatcaatggcctttttagttatgcgcagctgaccgttattatgacgggtgcggtataactgaaaggttttcggccaagcgataatgataaagaggagtgcaatcaaaattacggctagaactaaaccaccccagaacaggtaattctgactaatcgactgcatggtgccagaatctatgaaacctaagtgtaacggctcaccgactacggaccaattgtgaagcatcaagcctaaagacaacggtattgcgaggataatcaggatcgcaagtcccgttttagttaaggtttgcaagttatcaccacctttctatgtgattccatcataacaagtagcgatgggtgatgcccagaagaatgcttattaatttattatgacatctataagatattaatattatattttagatggtactttcggaataatttgtcctattttaagacgaatgttgtttttaaaccaattcaattaattacgctggcatttggatcaccgatagcaggatcgatttccaaacgaaatagtacatcagttttctccgagaatggcagaccatctaaatacagttcacggtaagtgtcgagatgggtgcgctgataaccgttttcttcaatagcagcgtttagcgtttgcagcgttttggctttagaaccgatttcaccgctgccagttgcttgaatctcagttccttcagctaactgttcaaagtggatttgatccgcaagccctgattcgagattggcatattttttggcggcgtcgaaggtttcttgatggatgaataacggttgtttgagccaaatcttaaaggcttcatcggtaccgccaacggtccaaactgcttgaatcggatacggccggtattccttgaagcccgccacctcaatgccaatattttggctgtcggcaatgattgcagctatcttatggaccgcttcggctaaaagaacaaacgtgtcatctgtggtgtgagtctgcgcgcggccctctgctgtgatgtagctacgagtggttaatttgaccagtgaaggggttgctgaacgctgatattcggcgggttcgaaagtttcccagttaaacataaggtggtacctccttgttaaatgacagtagtaaaaggactctaatttgccgtcattttaaaacaatcacttcagctgtaccactaagtcgctctctaatcaggaaatcaatacataaggggttacttgtctgattctggcttcaattccagcttggaaaaagtgcttaatccctgcatatttaagcggatgatatattctcgcagttcatcaatggtcattgtattcggttcctgtaagtaaagctgaaatagtgacagagtattatgaatcagaaaataagccacaatggtcgcgtccttatcgctcatgggaaatgactgttttactcgatttgtcagggaatctgctattctgtcgccaattttacgcatatagggggcgtattcgttggaagaagtcagtgcccgggcaaccgaatggtgttttaagactaatttactgtattggtcgaaaaagaatcctgggtcggaatagatttctttcatgggtttgattgataggattgataacatttggtgagaaatgttatctacttgaccgttcaatagatcttcaatcgaattgtagtgaaggtaaaaggttttgcggttaatgtctgcttcttgggtcagccgggtgacagtgatatctgctaacggcatggttgatattaaacgttcaaaggcattctgaatggctttttctgttcgttgggctcgcttatctggatttgaattcatgaaaaatttcctccctaatactcaaaaaacggtaatctgtggcatatgccacaaactgttattctctgatgttgtcaaaattattatggatgtttagtatgacttaatgcacagctggtaattagccaaaattatgaaccggcattagagaatattcaagtatgagggagaaattagtcgtgatcaaagcagagtggcattatattaagcagcacaaatttatgatgattgttttaatcgtcgtggcactcattccaaccatatattccgtgacctttttaagaagtatgtggaatccatatggtgaaatgagtcgcttaccagtagcagtggttaaccaagatcacagtgttaactatcaaggtaagcagttggcggtgggtaagtcgttgaccaataatctaaagaagtctgacgcccttgatttcaaagttttatccagtgaacagcaagcgcagcaaggtcttcgacacggaaaatactatatggtaattaccgtgccgaaatcattttccaagaatgcaacgacattaatggcgagtcacccgaaacggatgcaactagactatacgaccagcgcaggacataactacactgcttcaaagatgacaacttccgcggctggtcaaatcaaggatcaagttgatcacgaagtaaccgctacttatgccaagaccttatttagttcggttaaaaaactggacggtggcttaaaaactgctggtacagctaacggtaaaatggccagtggcggtcagcagctaaaaaacggtaacgcaacggttacgaagaatctgaataaggttgctagcagctcgctgacgttggcggatggtagtaaaaaggtgactaacggtctgggacaatacgtgaatggtgttgagaaagctcagacgggcaaccaaaaggtcactgccggactaaccaagtttgaatcagcggggcaaaaattacaggcagcttccaatagattaacttctggggcaactgatcttaacggtggtgtggacaagtacgtcgctgcagcaggtcagatccgaaacggtagtcatcagctcaacgatggtgttcagaaattgaatagtagtgtcagtgggatgggcagtagtactgcgcagcttaatagcggcatgacggccatgactaacggacttggtcagttgagcaccagcagtcagaagttaagtgctgcgactaagcaattgtctgacagcagctcagccaatatcgcagcgatgcagtcgcagttaaattcagtgtctaaagaagtcgccggcttaaacagcaatagtcaggcagtccagtcgttaaatcggtcactagctgatcttcaacgagccgtggatggacttaataacggtaatagcagtgatagtgagcttagcagcaaggttagcgctacagcggatcagcaaaaattaaccccagctcaaaagtcggccatgctggcagcggtcaaaaatagtgatcatcaaaagatggatacgacagcgattacttcggcaatgaatgcagtcaacagtgcggtctctgagctgacccattcaatgccaagcagtagcacaacggcagcactatcgactgatttgaccaaattaaaggctcagcagactgctgaaaatagtgcattgatgcagattgcgaccggttcagctagcctcacgactaacttagaatcagtgtcgaagtcagctggaaaattgaatgctggtactgctgaattagccaagcaaacgcccgctttagtaaatggtgtggaccaggttgccaacggctctgcatcattagccactaatacgactaggtttgctcagtctggacagtcgctgcaaaacggtgcaggaacactcagcagtgggatgagtcaatttaacagtcaaatgccaacggtggtttctagctcgaagcagttaacgaccggtagtgaagcggtaggaaacggtctcgggacgctggcacacagtggtcaaaccttagctaatggttcagcaaagatcactaatggtaatcagcaactggctagtggcacgcagcaattagctactggctccaaaaagttaggtagtggcatcaatcaaattaccggtggcgctcagaaattgtcaactacgcttggtaacgcagcgaaaaaagctgacgttaatcccaacaatgagacttatcagcaggtctctcagccagtcaaagcggatcacaacgaactggataaagtgccgaataatgggacatccatggcaccttatatgattgctgtttcgctgttcgtgggggccattgcactcaatttgatgtataacatgtatttgcccaaagcctatccaaagtcgggctttgactggatgctcagcaagatgagtatttggggaccatttacatttttggaaagtattttggacttcacattgttatgcgctatggatggattaagaccacttcatatgctaagcacgtttggcgtcatttggctgtgggcattggttgccatggcgttggtaacgctgcttaacctggttttcgcgcaaattggctcgttcttaggcatggtgttattggtagtccaactgagtggttcgggtggaacgtatccaatccagctttccagtcatttctttgaggacattcacgactggttaccaatgacttatgccgtggaaggattacgtaaaaccttgatgatgtatcataactcggcgtggctgcaagccggtgtcttgtttagcatactagtaggacttctaatcttgatgtggttgttttacagtcggcgttacgtgcaagtttcaaaaattgattttgcagatcagcagcaagttgccgcgactcaaaatagcttaacgcgcagattggcaagggcaacaaattaaaaatatgacataaattacaaaaactgcgtattccgttgcactttgtcggaatacgcagtttttgtgttaaattctggcagctaccgaggtttgtcgcacactcttttttgacgtccaccgaattcccccctatacttaaggtaaagcgcaacggacatttaagcagtttaatgaaagcgctttcctgaatatctattcggaggtgattttatgacattatatcagccatcaacagctggattgacccattatttattttttacgggtaagggcggtgttggcaaaactactatggcaacggctactgctgttcagttggcggatgctggcaagcgagtgatgatcgtttcgactgatccggcaagtaatttacaagacgtatttgaaactaaactcactaatcagccacagccgattcctggcgtgacggggttagatgccgccaattttgatccaatcgttgcggctaatgagtatcgtgaaagcgtggttggtccgtaccgtggtgtgttgccggacgcggccattcaaaatatgtcagaacaactatcgggttcgtgtacggtagagattgcgtcatttaacgagttcgccaaatttctgacagacccaacgatcgatcaaaaatacgactacattattttcgacacagcgcctactggacatgcgttgcggatgctgcagctgccttctgcttggagcaactacttggaccaaaatcacgaaggggcttcttgtctgggacagcttgctggcttaggtgatcaaaaagccacctatgaaaaagcagtggcaacactcaatgacggcatgttaaccacattattgttagtcaccagaccgcaacgagcttcgttagtagaaaccagacgtgctgcggatgagcttgctcaaatcgggatgacaaatcaaaaactgattattaacggtgtacttgaagaaccgaccgatgaaccttcacgaaacatttatgatcgtcagcaagcagacttggaaaacatgccggaaaaattaaagcagttacccgtagccgaagtcccgcttcgggcgtacaacatcatgggattagataatattcgaacgttgctgcaagatcagcagccagttatcaaggtgcagccggtcaatcaagctgattttccatcaattgatagcgtggtcgctgatttattgaaaacgaagaagaaaatcatcttcaccatgggtaagggcggtgtcggtaaaacaacggttgccgtccaattagctaaaaagttggctgctcaccagaaaacggttcatctcgcaaccactgacccagctgatcacctgtcactgtttcaaatcgatgatccggcgattactgtcagtcacatcgatgaacagcaggtattgaaggcttatcaaaacgaagtgctatcaaaggctaagcaaaccatgtcggcggatgacgttgactacattgctgaagacttgcgatcaccttgcacgcaggagattgcggtatttagggcatttgccgaagttgtcgcccaaaacgatagtgatgtggtcatcatcgatacggcacctactggtcacacgttattgttactgaactctactgaaaactacgccgaagaggtgaaacgaactaccggtgaagtgccgcaatctgtgctggatttgctgccacggttacaggatgccagccagactgaaattatcactgtgacgttgcccgaaacgacgccaatctacgagtcattgcgattaaacgacgacttagaccgtgccaagatgccgcataaatggtggatcattaatcaaagtttactcgcaacgcggaccactaatcccgttttacaggcgcgtgctaacagtgaaacgcagtggattgagaaagttaaatcagtttctaaggggcattacgccgttgaaaaatggcagccaaatttcgaaaagattaacttaacagtttaagcaaaggacgtgaataacatgaagaaaattgaaatttttgaacctgcaatgtgctgtcccactgggttatgcggtcctagtgtggatcagaatctcgtgcgtttaacggcaattacccggtcggtgaatcatagtcacaaggcaatgattgttcgccgtaatttagctcaaaacccaaacgcattcgtgcggaatcaacaagtggcgaaactgctgaaaacggatggtatgagttgtttaccaatcacaatggtcgatggcgtcgttcaaaagaagggcgtttatcctacagatgctgaaataaacgcgtatgtgggtgctgctgctaaagtcaatcaatgagtttgaactgattcaagttacggtatggattcgttgaattccgtccattttataaagtggcgtcagttgagaaaactcggtatttaaatgccgagatgaatcaacgtcttggacggccaccattgtattggtctagctgtgaatcgatatattgactgacaacttctttggaaacatgaccaagtgtactcataaagaaacttggtgaccagagatggccattccaaagtaattgtttagtttcgggaaactgaatgaaccactgtttagctgaaccacctttgaagactttcacaattgaagaaggcactagcttaggtggaaagctaatggccatctgcacatggtctggcatgatttgcatttcggtgatatcaattgaatgacgtttggcaatttctgccaagatagctttcatgcgatgatcagtttttcagtcgtaaaaatcgacttatggtacatagttacccatactaataaagaattaaaatcatacacatttgtccatgcgcgtttaatcatacaattacctcctaatgcctctatttcgggattttagccattcgtactagaacctatgataaaatattaggcgtaaagaggtgaatttaaatgacctatcaaggagttaaattgcggctgtatcctaatcaggatcagcagctgaaaatcaaacttaattttggctgtaaccggttcgtttggaatcaaatgctcaacatgctgatgacgcgtcaccagaataatcccgcagccaagtttttaaatgctttcgacttgaatagcttgttaccggcactaaagagcgaatatccatggttgaaggacgctgaaagcactagtttacaagtgactaatcatgatttaattgacgcttttaagcgttttttcgaaaaaacgcatggctttcccaagtttaagtcgcgtaaatatccaaagcagagctatcagtgcaaagcagttaatcagaatattaaggtagttgatagtcatcatatccagctacctaagctaggcagcctctcttttagagccagtagattaccagtcggaaaaatcaaggctgtaacgattcgactttcagcaactggtaagttttacgcaaacgtgctggtggataccaccattgaagaattacccaagacttccaaagctgttggtattgacatgggcgttgctgacctgatgatcacttctgctggtgttaaataccccacgattcggtttgataaacggctcagcaagaagaagcattactgggagaaacgcttagctcgccggagacgtcaagctgaaaaggagattgcttgggataagcacaatcaggtaccagaacccagagcattaaatgatttcaaaaactacttgaaagccaaacgtatggtagctaaatacagtgaaaagactgctaatcaacgggataactatctgcacaacatcaccaaagaactggttgaacagtatgatgtgattaagattgaagatttgaaaaccaagaaccttctaaaaaatcaccaactcgcccgagcaatcgccaatcaatcctggcgaaaactacgtctgatgctggaatacaagtgtgcttggtatgggaaacagctggtcactgtcaacccacgaaagacttctcagctctgttcagtatgtggttatgatgacggcaagcacactttagagattagacagtggacctgtcctaactgtggtagtaatcatgatcgtgatatcaatgccgcaacgaatattctaaaagcaacagcatcataaaagaccaactgggctggaacagcccttagtcaatagccgtaacctctgtgtaccattctttgaatgatacgtaagtcggcggtgttcctagaagatcgttactttagtgacgagtagttcacagataaactgaaagtgtagatatttgtttgatgaagttaaccgataaccactttgccatttaacaggaaggatgttaccgatgaaccttaaagttgcgcttgcagtctcattcgcttcattgatgctggtggggtgtagttctaatagtcgttcacagtctaatcaggatagtacgtcgtcttctagtgtatcaagcagtagttcgcaaagtgccagtcaagcagcgacgaatgataatgtgagtcaggttaaagtgccggtgaccaccgctattaaggcctatcagcaaacctttcctaaatctgagattaccgacctgtcagttgaacgtgagctggggcggtttcaatatgagatagagggtgtcgatgatagtcgtgaacatacccttaaattagatgcggatagcggcaaggtcatttctaagagaagtgagcggctagacgcagatgaagctaacggtgtaaaacggcaggatgcactggatctgaataacttgattggcttgactcgggcagtgacgattgctcagtcgaaagctaagggacaaacggcaaccgaggcttcactcgataaagaaagtgaacagacttactgggaagttcaatttgaaaagcaggggcaagaaacccaggttaagctggatgctcaatcgggcaaagtattgacggttgaaaatgatgattaaaacaagctgtgccaaaactcggtagattccagaatttaacgtgaataaggcctattccgcggttcttgcggaataggccttatttgcgttaaatggccggaatctgagttttggcacgtcattagacgatgctgacgtatagaaccaaagtacagtaaccactaattctggctaaaaattgattgaaatacttaccaatatagacttacgtcacagccactttagttagtttaacttaaatagtttttcgctgttctcatgaccaattttttcacgaacatcttgtgtgatgggtgcttgttccaagaagtcagccacttggttttcacgtctgagataaggaaagtcttctgcccaaaggacgtgatcgggccccatttcagctaaggctaaatccatttgcggctgggtaaacatgcctgacgcggtgacgtagacgttgttgcggtagtattcggagaatttacggtccaaatgagtttctgtcataccagtaaactcgtccagtcgttctagaaagtagggtacgaattcgccccagtgacccgacaccaatttcaggttaggcaatttatcaaaaatacctgagaggattaagtgcatcatctggatgccttgctccatgtgccagccccaaccggctagggcaatcatatcgccaacttggtctgaatatgagggactgtggtaaagcattttgcgctcggattctctgaccatgcctggatggaggtaaattggcacatctagtttggcagccgtttcaaaaatggggaagtactgcggttcatctaggaagtgatcatttgctaagccgccaatgatggcaccattgatacctaactgagtgacggcacgttccaattcttctgcggctgcttctggatagttaaccggcaacgttgctaaaccaccgaagcgggtcgggtgcttcttgatttcactgcctaataaatcgttgatttggcgggaactggtaacagcttgttccttagaacctgccagcattggtccaccagtattggagacgacctgcatgtcgataccatatttgtccatatattcaaggcgcttgtcaaagctatgtagatactgatctacaatgttagcttgtgggcctttagggtcgactttagattcctgtttggctttaggcgctgattgaccaggatcaatctcgaaatgttcttcaaccgtaattattttagtcatactaggttactccttcttttcaaaccagtcctgaacgccaccaagaaatttttgaacactggctggctgatccaggccaggtaaatcatcgctggttttagcaccgagatctttcaaaacgatggctagattcttataactgtcacgtgcgcctttaaccggtttaatatccttaggcgtaacgggtagcagcgtgtcgcgttcgtaaacgggtgtcatggaataaatcttccattcatcgtttactcgtttcagggagtaaaccaagcgaacgtaaattaaattatccatcgtttgtccctgaaccggtgtccggcctgtcatggtcgtgacaaccactgccacggccttatcaccattgagccagacaagagtttcatgcattttgtgtgccggcaaggagtctgtttgggcatctggaccaggtttggaagcctctaagaagcccttaattggtcctttataccaagaaatctcaatggtagcgtcatcggtatagcaggtggccataccatcccaaagaccgtagtcgcgggcgtatcgttcgtagtgaaccagttccgtgatttggtacttgtctagcatttcttgtgcgttatgggtttctggtcgcgtttcttcaaataacattaatgatgacttcctctcaaaaccaattgttcatattaattgcctatgacagtatagtatagtcaatgattgataattgtcaattaattttatttatcacttaatcgtgtattcctcattaaatcggtcattaccagctgttcgagtttgattgcaattgatttaatcactataattggatagttaaacttttaaaaataagacagtacgcaagtgttgccaagagaatggagaattggtatgagcaagacgaaacaagggtcgcagcacatggtcgtgccgctgatgattggggcttttttatcctctttgggtcagagcctgatgacggcaagtgtgccgcaaatttctcgggcatataatatcagtgaagcgacaggtgaatggttaacgatgggctatattctgattctgggtattgtctcagccttcactgcttttctgatcaaccgaattcctactagacgtttatttttgacaacgatgtctttgtttaccgtgggaatcgttgtttcattattagcacctaatttcccagtcctattatttggacgcctgattcagggcgttggcgcaggtgtgatgttgccgttgactcaggtagtcttgatgaatagttatcccaaaaatcggcaggggagtgcttttgcgatgattggtatcgtgttggcatttgcacccgccattggaccgactgtagctggtattcttaacgactcatttggctttgagtcgatttttattttgatgctagttatggccttggcagcgctactgattggtttaaagctggttcacaatgtgggagaaacaactaatgaaactttagatgtcatttcggcagtactatattcggtaggcttttcggttttaatgattggcgtgtctgccacaaatgtcggtgagatattagtagggttagctattctgattgttttcggttaccgacagttccatgtctcttcgccattcttacagttacgtgtctttaagagtcgacgcttttctgtgaccattaccctgattattcttgggtacgcggtgaatatgacggatgtgatgctggtgccattgatgctgcaaactgtattgggctattcggctacgattgccgggttagctatgttgccagcagctctttcacatctcatttccaacccaatcagtggctggctgctggatcacaaaggtccgagactgattggtatttgtggcacgataagcattgttttgggagctgccggtttgacctttttattacatgcgactagttcgatttggtttgctggtacgtgttatctcttgttaagttttggcatgtcgatgatcatgacaccgctgattccctttgccgaaagcgatttgtcagtggctgaggtgagtcatggtaatgccatcattgtttctggacgacagatgttgggcacaattattggaacagggttattagcggttgccgcacaaatttctggaggtaagcaggccactgcggctggaattaatgctgcgtatgcgattttgatgggaattgcgctggttggttttatcatcgccatcacgttacttaaaaaccgtaaacctaaagttgaggcttaatatcgttaaattgaatgatttgaatcattattgaagttaaaaatggtcgtgggattaattctcacgacttttttgatggtgtaaattttcttgccctgtaaaatgatggaaattcaattatggaagaaatccatgaattaattgaaaattaactaccacatttcttccatccatagtatgatttaagcacgataaaccaagctggtttcacaattttgcttaacgtgaaaatgcaagattttttacacttttgtgaattggaccgtatcaatttaaaaagttgttgacttttcggtgagaattggtattattaactaagcaaaagaccaaaacgatttatcgttagttgtcagaagtaaagctatttaatgaaggagtgtataatttcatggcagtagattatgattccaagtcatacttggaaaaagttgacgcctggtggcgcgctacaacctacctttcaggtggtatgattttcctgaagaacaacccattgttctcagttactgacacaccaatcaagaaggacgacatcaaagttaagccaatcggtcactggggtaccatttcaggacaaacgttcctgtatgctcacgccaaccgtttgattaacaagtacggtttgaacatgttctatattggtggcccaggtcatggtggccaagttatggttactaactcatacttggacggtacttacaccgacgcctaccctgaaattactcaggaccttgaaggtatgtcacgtctttacaagcggttctcattccctggtggaattggttcccacatgactgctcaaactcctggctcacttcatgaaggtggcgaacttggttactcactttcacacgcaactggtgccgttctggataacccagaccaaatcgcctttactgttgttggtgatggtgaagttgaaaccggtcctgctatgactgcttggaactcaatcaagttcttgaaccctaagaatgacggtgctgttttaccaattcttgacttaaacggcttcaagatttccaacccaactctcttcagtcggatgagtgatgaaagcatcactaagttcttcgaaggtcttggctggtcacctcgtttccttgaaaacgatgatatccatgattacatgacttaccacgagaaagctgctaagttatttgatcaagcaattgctgatatccaacaaatccaaaaagatgctcgcgaaaacggcaagtacgaagatggtactattccagcttggcctgttgttatcgctcgtttgccaaaaggttggggcggtcctaagaagaacccagccggcgaaccaattgaaaactcattccgtgctcaccaagttccacttggtttgagccaaaacaacctcgatgaattaccagaattcgaagcttggatgaactcatacaagccagaagaattattcaatactgatggttcattgaaggctgaagttgctgacttcgcacctaagggtgacaagcgtatggcagccaaccctgttactaacggtggccgtcgtcgtggcgaaaagcctgctatgcttgacttacctgactggaagagcttagctaacgacattaacgaaaacaaccgcggtactttattaccagatggtaaccgcaacatggatatgaacgttctgtcaacattctttgctggtgttgctactaagaacccaacttcattccgtgtcttcggtcctgacgaaaccatgtctaaccgtctctggagcatgttcgacatgactaaccgtcaatggatgagcaaggtcaaggaacctaatgaccaatacgaagccccagaaggccgtatcttagatgctcaattgtcagaacaccaagctgaaggttggcttgaaggttacactctgactggtcgtcaaggtatcttcgcttcttacgaatcattcttacgagtagttgactcaatgacgactcaacacttcaagtggatccgtcaagctgctgctgaaccatggcgcaatgattacccatcattgaacctgatctcaacttcaactgtattccaacaagaccataacggttacacccaccaagacccaggtatgcttacccacttggctgaaaagaagtctgactttatccgtcaataccttccagccgatggtaacaccttgttagctgtctttgaccgtgctttccgtgaccgtcaaaaggttaaccacatcgttgcttctaagcaacctcgtcaacaatggttctcaatcgacgaagctgaagaattagccactgaaggtatcaaggctattgattgggcttcaactgttgctgaaggtgaagatgctgatatcgtctttgcttcagccggtgttgaaccaactatcgaaactttggctgctatcgacatgatcaacgatgcattcccatcagttaagatgcgttatgtcaacgttgttgaactcggacgtcttcaaaagaagaacggccctctgaacgcagaacgttcattgtcagatgacaagttcgaatcattattcggtcaatcagggactccagttctctttggtttccacggttacgaagacttgatcgaatcaatcttctacgaacgtcaacacactggtgcacacgttcatggttaccgtgaagatggtgacatcactactgcatacgacatgcgtgtatactctaagcttgatcgtttcaaccaagctaaagatgctattaacaccttgattgctaacggtgctatcgacgaagctgccggtaaagcctttgacaagaagatggatgacatcttagcaaaacacttcaagattactcgtgacgaaggtcgcgacattgaagaattcactaaatggcaatggactccattgaagaagtaatttctttaacggataacgtgaacatttaaaaaagcaccaactcaattacgagttggtgcttttttgtgcaacgaatggggttaaagcagtttatcgttagcaaccggtacagttggcaccgttgaacgttctctagatgagaagaagccaaagatgacacaccatagaatccccattgtagcgggaagccagttactactatcaaagaacaaactgatatagatgacgatgaagaaaacaatcagcattggatcgaagactttgtaggctggcattaaaaatccgtctggcataaaatcggctgactggcgatatcggtaatgggcaattatggtgagtgaatagacgatcaggtacaagtcactagatgcggacgtaattaaactaaaggcgtttgatacgtagggaagagcgctaataacgggagccaacaagattaacgtcgcagaaatcaaaatgccctgagcaggaacaccgtgtgtagagatgcttttgaagtggctcatgaaacggccatgagattcgctggctagttgataaaagtgacgaccagacgaataaatcatgctgttcagtgatgatgccgctgaagtgagaaccacgaagttaatgatggcagctgctgcgcgaagcccaactaatgaaaagacttgtacgaatggactttgctttgctgataagctttgccatggataaatcaacatgataacaagtagggcaccaatgtagaaaatcagaatccggtaaatcacttcattgattgcttttggcaatacgtgacggggattcttcgtttcagcggtagtgataccgatgaattccatccctaaaaaggcgaagaacaccatcggaaaggcactgatgaagctgtgaataccgtttggaaatagcgatagatgagttgtaatgttgccaagactgacttgacctgttggcgtcttaaagtgtgtcagtaacatcatgattcctgtcgcaatcattgagagaatagcaataattttgatcatggcgaaccaaaactctgcttcaccgaagattcgtacggcgattaaattgacgctggttaatatgaccaagaaactaatttgaatcaaccaagcagggagatgcgggaaccaaaattgaacgtaactggcaatggcagttatttcggccatgcccacgcaaatcaacccaatccagtaggtccagccagcaaagtaccccgttcgttgacccagatagcgagtaataaacgcaatgaacgtatgttgagacggatcttgatacagcatttcaccaataccacgcatcattagaaagaaaaagataccaataatcatatataccaagataatcgaaggaccagttttagtaatagacgtactagcacccaagaagagaccggtaccaattgtgccaccgagtgcaatcatttgaacgtgccgattagatagagatcgtttcgtcccatcagcatttgtattttcttgtttgttcatagtctcactccttttcattgatgttaatttaatcacctaatgaaataaaattcaatagtaaaattaaaaataaatgagattttatgtagaaaatggatttaatagttgctataatgactgacatagaaacgattataaacgatttaattagttaaatcgttttctaataattaattatgcataattaaaatgaataaatacttacctaaaaacgctaaaaattgactgattatcacattgctgtggcagactgatcattcttctgtacatgagtagaaactaagcaaattatcagtttaaggtcaaaattgtgacgttcataagtttacttgtaaacggtagtaatacaaaattagttatgcatttttgataaaagaccattcagcacgtgaatattttaaggagaggagatggtaagctaacatcttggaatcttgtgagtagactagaaaagcaattttgctaagtatgtcatgaaacgataggcacttgaaggaggcgctggtgattagataccatatgtaatagattcaagtatttttaacgaacatatgtcatatttagtgacgtaggatctatttaaattcacaatctaaaaacgtgataaaccatgatttattggcatttagtttaattgattgaaattggtaaacctaacatagtcccgattttagcggtattctattgattaatttctaaataggtataggatgtattttgtgatgttagtatatctgacataaactatttaaattaaacgacaggagagattgccatgagaattgaacaggattgtattggtaagttagcgattgatgatgatgctttatatggtattcacagtaagcgtgcagagaacaactttcctatttcaagggaaaagatccatcccttaattatcgaaagctttctccaaattaaaaaagcggcagcacaggtcaaccaacaagctggtaccttgaaggccgccaaagctaacgccattatcgcggcgtgcaatcagctgctgcttggcagacatcaagacgcgtttattgtgcctgcaatccaaggcagtgctggtacttcagctaatatgaacgttaatgaagttgttactcacttggcagaagcattgacacctggcgttcatgttcatcctaacgatgacgttaaccagtcacagtcaactaacgacacttttccaacagctggtcaaatggcaatgttaaaaaagctcccatctcttctgaaagcaatcaacagtttactcgatgagcttgaaaacctcgcagagcagaataaggacgtactgaaaattggccgaacacagttggaagatgctgtgcctactacttatgggcgaacgtttacggcatatcggtcaatgtttaagcgtgatttagcacgtttatctgccgtgcgagatgatttagcggtggttaatttaggtggtaccgcgattgggactggacttaacgccactagttattatcaagcgcacattgtgggacaggtcaaccagctgacacagttaaatctcgtttcagctccagatttgattgatgctactcagaactgtgacactgcggtagtcttttccggtgcgctcaaagcactggcagttgacttatctaagttctgtaacgatttgcgactgctcggaagtggccctcaagctggattagcggaactacggttaccagcagtacaggcaggatcgtcaattatgccagctaaagtcaacccggttatcccagaagtggtgaaccaagttgcgtttgaagttatcggaaacgacactactgtcaccttagccgcgcaaggtggtcaacttgagttaaacgcctttgagccaattatgtttcgcgacatactggcgagtgagacttacctcgaaaagggcatccagactttagttgccaactgtctgcatggattgcaagttaaccgaacaaagacgcaacgttatgttgaacattcagcaattatagcgaccgcactttcaccaatcttgggttataccaagacaacggcggtgattaaacaagcactgagcgaagaccgctccgtgcgagaaattgttcttgatagtcacctgttatcagtagaacagctggatcagctgttatcacctgaaagtctgctacacggccaatctaccgtacaaacaaaacggcgtgaaggataaagtatggatttatttcgaactaatgattttaaaaaaattggatacagttgaaagtatgggtaatttcattaaaggaagtcttgtaaaatggtaattggcaaacatcgaccaagtcgaatcgtggttgaccaaaccgcaatttatcagaatattgcaaatgaaaaggccagattaactgataaaactgagctattcatggtagtgaaagctaatgcttatggacacggtctgcttcaagtggcagctacggcattgcgtgcgggtgctacgggcttttgtgtggcaatcctcgatgaggcactagcgttacgtgaggctgggtttaatcagccaattttagtattgggcattactgagcctcaatacgctgcactgttagccgtcaaccatatctccgctacagtgggatcgttaacttggctgaaaactgcacaaggctttttagaaaacgagcacgtgaccacgccattagccgttcatctaggccttgatactggaatgggtagaattgggtttcagacgcctgatcagttagcgacagctgtggcgtacctcaaaacggctaaacagtttgaatttgaaggcatttttacccatttctccaaagctgattcggctgatacggaatactttgaacaacagttaaagaagtggcgtgctttcatgacggcggtacccgatcgtccaaaatacgttcacgtctccaacactgccacaagtttgtggcatgatgcctgcaacggcaacctcattcgcttcggagttggcggttatggcttaaatccatcaggggtcgaactggaaccgccgtttgtcttgcacccagcgatgcgtctggagtcccgcacggttttcgtcaaagcattaaaagcgggtcaatcagtgagctatggtgctacctatacggcacaggaagacgagtgggtggcaacggttccgattggctatgctgacgggtatagacggcaactgcaaggctttcacgtgttggtggacggtcagtattgtgaaattattgggcggatatgtatggatcagttaatgattcggctgccgcatgaatacccagtagggacgcttgttacactggttggtgaagatcatggccaaacaatctcgcttcaaaacatcgctgactactgtggcacgatccattatgagattgcctgtgggtttagtgaacgattgccacggttttatcaaaattaacttctataatatatacattgggctacaagctgtcagtacgaaaatgatagcttgtagcctttttcctattgatcaatatttgatagtcacaataaaattccaccttgaatttctgcgttggtcaagcgatactcaatacaagagaacttaaacgaggtggaatgcatgagttacattgaagtacaaaacgaatcgaagaagtatcaaatgggcgaaactgaaatcatcgccaataacaaattaaatttcacgtgtgaacagggacagttaaccgtgattttaggtcctagtggtgcggggaaatcgacggtgctcaatattttgggtggtatggatacgccaacgagcggtgaagttttgatcgatggcgtggatattgcgaagtttaacgatcgtcagctaacggcgtaccgtcgcagcgacgtagggtttgtttttcaattctataacctgattccgaacttaacgactaaggaaaacgttgaactagctaattcaatcgtggatgatgcattggacgctgaagaaacgctacgtgaagttggactgggcaatcggttagataattttccgtcacaactctctggaggtgaacagcagcgggtcgccattgccagagctttagccaagaatcccaagttacttctgtgtgatgaaccaactggtgccttagattttgaaacggggaagcaagtgctgagcctgcttcagacggccagtcaacgcgacaataagacggtggtcattattacccataacgctgccattgccaagatggcggaccgcgtcatccgaatcaacgatgcccaggtgcggtcggtggaagataatccgacacccgttcccgttgaacagattgagtggtgatcaggatgaaacccatgactaaaaacatgtggcgtgagattgctgctaacaaggggcggtttatcgccattattatgattattttattgggaacactgatctttgtgggggttaaagctgctggtccgagtctcaatgattccatggataatacggttaaaactgagcacttaagcgatgtacaactgttttccacaactggattcacccaaaaagacgttcgaaccgctgaacaagttgctggtgcgcaagcggaaaccagtaaatttaagtatgtcactggcggcaaggatgaagacgtggtggcattatatggctatcaatctggtgcgaaacagaatcagttgaaactacggagcggtcatttaccccagtcagcgaatcaaatcgttttggatgaacgggccaaacgtgattatggctatcggctaggggacacgtatcggtttaaccgacaggctgatcttaagcaacgggcttatcaaattgtgggttttgcggattcgccacagtacattgattacagtacccgtggctccgcaaacgttggcgacggtacggttcgttattttgcgtatattaaaccgcagcaattaaacctgccaacagcaacggtattaacggtgaggtttaagtcattgcagtcaatgaactcgtttaacgatgactatcaaagtgctgtaaataaaaaagtgacagcattaaaggccgcctttaaaccgcgggctaaggaacgcaatcagcaactatcagcaggggtaaagcgttccttcgcaccgcaacagcaaaaattaacgcaagcatctaagcagttagcgcagttaaaacaggccactggcaactcagcagcgctccagcagcagacacaaacgttaaacgaaaatcaggcaaaactaaatgcagcgttgaaagaagctactgctaaagcacacacgacctatacttggcagactcgcgaagacttaccaggatttacatcatttggagatacctcggaccgaattgcggccattgccaatgtatttccagtcttcttctttctcattgcggcgttgatcacgttcactacgatcacacggatggtggaggaagcacgacggcaaattggcacgttcaaggcgcttggctataccaaatgggccattgctaaaaactatttgagctatgcgttaatggctggcttaatcggtgccattctaggtagtgccattggaaacgtgacccttcctcggcttgttatttcgatgtaccacatgagtattccgttgaccacctcagtgccggtgatgtggtcagtgattgctttagcggttgttttctcgctgttagcaacggtaggcgcggcagtgattgtaattcgtcgcgagttggctgaaaagcccgctgatctgatgttgccaagaacacctaaatcggcgaaacggatattaatggaacggattacaccgttgtggcgtcggatgagtttcaaccagaaagtgtcttaccgaaacctatttcggtacaagagccggatgtggatgacgattattggtattgctggtgggacggcgttgattttgaccggttttggtcttaatgactcaatcggttcaactgctagtcagcagtacggtcaaatcttccactattcagctaccgtatcattggcccatgatggtcagagtcaaaagacgatgcgggtgttgaatcagtcggatgcatataaaggcgcaacaaagattaacctgaccactggtaaggtgaaagctaataccaagcaaatcagtgacgtgaatctagttaccccgaacgataatcgacagttcaagaaatacgtcacgttaagtcattcactcactaaaagcgggttggtgatcagtaaaaaaattgcttctcagcttgacgttaaagcgggggacaatgtcagctttaccactgctaagggcaaaaaagcgcacttaaaagtagtggcagtgacgccaaattacatgggagtctttgcgtacatgagtccaactgcctaccacagtgcctttaatgccaaaccagcagtgaatacgctgtttgttaaattaaacaagcagtccagccagcagcaaaataagctggcaagacaattgctgaaacacggtggtgcactgggaaccagtttcgcgtcagatcaggaaaccacgatcaagaccatgagcagttccatgaacgtcattgtgttaatcatgatcctgttgtctggtgttctatcgttcgtggtgttgtataacctaactaatatcaatatttcggagcggattcgtgagctttcaacggtgaaagtgctgggtttctttgataatgaagtgaccatgtatgtttcacgggagaatattttactgaccatcttcggcatcattttgggatatggtgctggctggggattgcttagctttattctcaatcaagctacaacgtcccaagtagtcttccccgtaattattcgctggccaggatacgtggtagccacgttactgatggtggtgtttaccctaattgtgatgtgggtgacccatcagaagctgaagcatgttgatatggtggaagcgttgaaggaaaattaaatagatgttgttaaaaaagcctattccggcaattcctcggaataggctttttggaactatggaacctgttaatccttacgaaatttcctgttgacggtattctcttggggaaacgtggtattcctttttaaacactcgggaaaagtaataactgtcagtgtatcctaatcgggtggcaatttgttggatagggatattagtaaatcgtagataatggcttgctcggtctattttggcagaggtgataaattgattcacactgaccttggtaactttacgaaaggttcgactcagataactgattgaaattcccagtgttttagcgatatcgtctagtttaatggggttactgatgtttttgtagatgtattgaatggccatatctacataggtactgcctgtagtgacatcacttttattaacgcttaagccagagaggagcgcacctagtaattgagaagcatacaattctcggtttaacgaaaatcctggttgaaaggtcttgatcataaaccaaaacagctccataacggatttaatttggctaatgggaagttcttctaaatagaagacagacttggggtagacacagggatagctagttgctaagttaccacgaaagtgtacccagtagatgtcccaaggatcgttttcggcagtgaaatatttatgtctgatattaggtggcaagataatgaacgaatgttgtttcatcgcgtaagtagtatgatcaacaacaactgtgcctgatccgttggtacaaaaaatcacgatccaggtattggtaccgttttgacgagaaacgtagtgatagtcagcgttggggaaaaagccaagatcggtgacgtagaggttgttgaaaataggtgaggatgcatatgagcgtagtaaagctggcggtaacacaaataagtattcgttatcgaaatcttctaaacgacgcatggaacccctccattcaataaatataacgtattatataaagcgcttacattatataccgactgtatcgaataatccatctttgggtgaggatagtgcattttaagaaagcgttttctgtactatggtgtagataatcaaaggacagaaaggaacgattttaatgagtacaaataccggtgtttctatcacagaaacgacgatcacgttgccaacgtatcaaaccagtaaacccgaaaaaaacccgatgtttcttgagaagagggtttatcagggcagtagcggcaaagtctatccattccccgtcactgaaaagattcatgaagataaggttgatcaaagttatcgcgcaattattttagaaaaccagtatcttcaggtaacctttttacctgaattaggcggtcgaatttatcgtgccttagacaagacaaataactatgatttcgtctactataatcacgtcattaagccagcgttagttggtttaactggttcttggatatctggtgggattgaatttaactggccgcaacatcaccgtccagacacttttttacccgttgagacaaaaattgaagaacatgacaacgcaaaaacgttgtggattagcgatattgacaaaatgtatgggactaaaattttggttggttttacgatgtttgcagacaaagcctatttaaaactagatgaacattttagcaacccgactgatttaccgcaaacatttctctggtgggccaatccagctgtgccagtgaatgataatacgcaatcgattttcccacctgatgttaatgccgtctttgatcacggtaagcgggcagtttcaacgtttccaattgccaccggtgagtactacaaaatcgactattctgcaggtgttgatatttcacgctacaagaacgttcctgtaccgacctcttatatggctgctcattcagaatatgattttttaggtaactatgatcaccaaaagaatgcaggattactgcacgttgctgaccatcatacttcgcctggtaagaagcagtggacatggggtaacgccgactttggccagtcatgggacaatcagttaacggataatgatgggccgtatattgaactaatggttggaacctataccgataatcaacctgattttacgtggttgaaaccacacgagcaaaaaacttccactgaatatttcatgccgtataaggatgttggggcagttaaaaatgccactattgatgcagctgtgaacctagaagttactcaacaaggcgtagcagttaaggcctatgcaacctctgtttatcaaaacgcacacgtgaagttatatcagcaagataaacttgtagcagatgaaacggtgatgttaagtcctactcaaactttcgagaaaaagtacgatgtgaatggtgatcaatctgagttcaagttaatggtaacggatgctgaaggccagcagttggttgcttaccaaccagcagcagatcatattaagccgattcctgatcctgcaaaagcaatcgctgctccagaagaaattaagactaacgatgaactatattttgcagcacagcatctggaacaatatcgacacgcaacttatcggccggatgattactaccttgaaggacttaagcgtgatcaaaatgatgatcgaatcaacgatgcctatggccttttgctgtatcggcgcgggttatttgctgaaagtcaaacttattttgaacgggctatcgcacgtgaaactgaacacaacactaatccattttctggcgcagcacactatcatttaggccttagcttaatgatgcaaggccagcttaaagacgcatatgaccacttctttaaagcaacttggtcttatgaaacacaatcagttggcttcttagcattggcacaaataaagagctttgaaggtgatttagatgccgcactgattgatattgataaggggttgaataccaattatagtgatatgactttgcggacacttaaggtaaacgttttgcggcgggctcatgagagtgaagctgctaagcaattagtggaagagaatgctgcaattgatccactatgtcttggtaaccgttacgaagcctggaagctgaatccgagtgcggagaaccaaaaggcacttgaagctgccttaaaccacaaattaaataaccatctgagtttggcggagtcttatatcaaggcgggtcaatacgcagatgcattggaaatcattcagttatataccaccgaaaacccaatcaagagttactatgaagcctttctttctaataaattgggtgatacaaaggctgcaaagaaatttgctgatcagggtgctgctggtaatccggactatgtctttccaaaccgtttaatggatgtcgttgttttaagcgcgactattaagcaaaacccaagcgatggtctggcagcttattatcttggtaatttatattatgatcgaaaagtttatgaccgtgctactcagctatgggaacaatgtgtcaaagccaatccagattatccaatggcgcaccggaacctgtcaatcgcctattttaaccggcaacagcaacctcaaaaagcgttgcatgagttggaactagcctttaagctggatccgcaaaacagtcggttagtgtttgaactagatacgctatacgaaaagttaaatcggccattaacggaacgattagcctttcttcaagatcactttgacctcactcagcaacgtgatgatagctacatctcactggttacattattaaacgaaacgggtgattatcagcaagcttatacaagaattatggatcatgtcttccatccatgggaaggcggtgaaggtaaggtaagcacgcagtatgaatatgcgctggttgaattggccaaacaagacttggctgctaatcgggtccaagatgctatcaataaacttaaacaagcattggtttatccacgaagtttaggtgagggaaagctgccgattgcagtagacaacatcattaattactaccttggactagcttttaaagcaagtggtgatgatactcaggctaaagaacactttgaaaaggcaactgctggtttgagtgaaccaacggatatgatgtactacaacgatcagccagctgatactatcttttatcaaggactggcgtttgaacagctacaccaaaccagtcaagctgatgcccgctattataagttgatcagctttggtgagcgacatttattcgatcatttcaagatggattactttgccgtttcattaccagatgcactgctttttgatgaaaattatcaggaccgtaacgccgttcattgttactacttgatggcattaggtcatttaggattaggacatgtggaacaagctcaaaaactctttggacaggcgcttgctattagtaatcaccatcaaggtgttttacggcatcacaattttaaaaaggagaacgttaagtaaaacacggcagtattaaatgtcagcgcctctttggatgatcttggaatggttgtttgaaagagacgctgattgttgtcggtgaatatttagggggcaaacgtaatatgccaagttatattaaggatttgcgtgcattagtcggacatcgaccactgattttaaattctgcgtcaggtgctttgtttaatcaacaccagcaagtgttgctccaagaacgaacagatacaggtgattggggtttcccggggggatatttagcttttggagaggggtttaaagatgctttggtcagagagtttcaggaggatgcggggctggttgttcagccgttgcaattattacagctgtcggatcaaaatcactacacttatccgaatggggaccaggttcagccaatcaactgtttctatctggtaaagtatgtctctggaagattattacaacaggcgacagacgaaacgactcagttggcatactttgatttagatcagccaccgaccttttttaatgcgcaacatgcaacgatgttttcggtacttcaacagcattatttgtagaaaggaggtagtgacatgtcaattaaagtagtccggtatcaacgtgaaaaccaacatgattattgtgaaattacgatggaaaataatcagggaatgcaggtcaaattattaaattatggtgcaactctcgaaaaaatccttattccaaccgcacaaggattggaaaatatcattatgtcgcttgattcaccagcagactactcaaaggcacgtaattttttgggaggaacagtgggccgagttgttggcagaattcgtcatggtcagtggcaatatggtaaccatattgtgcagttaccgttaaacgatggtcaaaatcacatccatggtggaacaggtactgatacgcaagtgttcgacttttcaactcattttgatatgcatcaaagcacagtggcttttatcttatttgatgcagagggtaacaacggatacccgggtaatatgaagttgcaggtcagttatacgttggataatgataatcagttgacctaccgaattaaagccgttagcgataaactgaccatttttaatccgaccaatcacgtttatttccgcttgaatgggtccgaatccgatgtgttaggactcaaccttcaactcaatagtgatgtgtatttgcccctagatgcggatagtttaccctatcaaggcagaaagtcagtggagggaaccgtctttgatttccggaacgctaagccggttgggactgttatcaatagtcatgacccagagattgatgcagaacatggcttaaatcatccgtttttgctgcggggtgatgacccagcagctatcttaagctcccctgataaaaagagaagggtagtcatgacaacgaaatcaccgtcgatagtgatttatactgccaatcactttgaccatacggggattgcaaagcacattggtcagtacgatggtattactctcgaagcacaagtgccacctgcagagggtagcgatttaacagctatcacgttattcccaggggaacagttcaatacgtggactaaatggcagtttaagtattaaaaagttactgtgcgacaaagataaatggctttacttcacgataatccatctttgcaattgattagtacatttttatgtatgcgttttcattatatccttagattaagcataaatagaacgttcttttaacttaatatgtagtcatatttgggtggaggtatttaaacatggataagaaaaagcgtcttacaccgtatgtcattttgatttcatgtgcggctgcgctaggggggttactgtttggttatgatacagccgtaatttctggcgctattggctttttacaggtcaaatttagtcttgatagtgtggcagttggctgggtaacgtcttgtattctaattgggtgtgccatcggcgtttcgattgccggggtattaagtgatcgatttggccgcaaaaaaattctagtattatcagctattatttttgctgcatcatcggttggtgctgcattagctggcagttatatgacgttagtgatttggcggatgcttgctggtgttggtattggactcacatcacttatcacgccactgtatattgctgaaatggcaccggctgaagtacgtggcaagttagtttcagtgaatcaactcgctattacaattggaatttttgtagtgtactttattaacgctgccatcgcttctggttcgactcaggcttggaacgtctcaacaggctggcgcatgatgatggggattggtgttattccatccgccttgttcttgattgctttaattcctgctggtgaaagtccgcgttggctgacccagcatggtaaggctgatcgagcacttggtgttctaaagaaggtcgaaggaaactcagaggatgctcaatcagaactgactgaaatccaagaggctaataaaattatcgatgattctcgtttccgagatctgtttaataaaacctggtttccagtcgttgttatcggtgtgctattagccttattccagcaattttccggcagtaacgccattatgtattatgcaccagagatttttaagggtgcaggatttggtcaagacggtgccttcatggccactgtttctattggaatgatcaacatggtaatcacggtggtgtcacttggtttagttgatagagttggtcggaaacaactattaggctggggctcactagcaatgtcgatttgcctattgatcgttgcaatctgcttctttacgggcgcttcggcaaccttgactttgatctttgttttacttgcgattgcgtcatacgcgatttctttagcaccagtcacttggattctaatttcagaaattttcccatcacgtatccgtggtcgtgcaatgtcgatttgtaccgttgtgctttggttgagtgactttactttgagctataccttcccaattttgacgcaaaatattggtgagggttggacctttatgctgtatacagcagtaacgttgttatcggccatctttatttggcgagtactcccagaaactaagggtaaatctttggaacaaattgaacgcttctggaaagaccgtgctaatagctagaggtcgtgtgaattgtaattggaagtattcattcactgtttgttagggcttaaaagcagtggctaacataattagcagaacggcaggtgtaacaaataaaggacttcatttcagtattacttggaatggagtcctttttcatgttggacgtattaatcaaagatttgggtaaattcaacagtgttcattctccagtttgtggccaccgcgccttaacaatctccgaagccaccacactcaagaaaataatggccgcaccgaaatattgttgcagcgacaatacttcgccaagggtgaaaaaagcaaagatggcggagaaaatcggttcgagggaataaatcaaacttaccgtatctggcgctaaatagttttgaacctgagtttgagcgacaaaaccaaaagcgctgcaaatcaggccaagtgctaaaacagctccccattgagaagtggattggggcagggtgatgccgttcattaagccaccgaagattaagccttcaacgccagccacgcccagttgccaaatactgacgccaaaggttaccagatgttttttagctaaaatatcggaaacaataatgtagatggcgtagattgccgcacaaatgacacataatagcgcgttgaaatccaattttaaacctgctccattggccactaataagtataatcccagtacaacaatgatcgtggtgatgactgtgctaagacgtgggaaatgtttcttgagaatggcctcaaaaattgccacaaaaacagtggtggtactgagtaagaaaccagcagtggaggcagctgtatgctgcaagctgatcatgacaaatgtgaaggcacagaacagtaaggtgcccaatgtgaaactagcgaacacttcaccgcgagagggtcgtttcagtattcgcgcaaaaacgagaatggttgctagaaacgcaacggtgaaacgtaacccgactagaaagagtggtgccacgctgataagcgcaatcttcatccacatataggatgcgccccaagaagccgtgactaagaacattaaccaataagcacgttgacgattcatatgtaaacatcctttaatataagttttgtatcataataattttacactaattgaaaattcaatgtctcaggtagggctggggaaatcagcatcagttgaagctctatggcgaactaattgagaaagcaaactagatagtaacgaaactaaaaaagcatttctacaggaatttaacctgcaggaatgcttttaacgtttacgttcatttaattaaagtaagccaccgccatcaacagcgtaagtttgaccggtaatgaattcagcttctggactagctaagaaggtcaccatgttggcaatatcgtttggttcaacagtccggcctagtggaattgtaccaacgtagtctttcttgttttgtcccaaaggtttgccgttgatttcagacatcttagcgtcgatttcatcccacataccagtggtacccacaacaccaggtgcataggcattgacgttaatgtgtgctggtgcaaattctagtgcagcagcttgagtaatgctaataacggctgctttagttgaagaataagttgcccaaacagggaaagcgtgcatcccagcaattgatgaggcattaataatgcgacctggtacgtttaactctttgaacttcttagcagctgcttgaataccataaatcacaccgaagacgttgatcttataactaaattcaaggtcttcaggtttgatatcttcaaacttatcaactttagcaactccggcgttattaaccatgacatcaaagccatttaattggctagcagcttgatcaacagctttcgacacagctgcttgatccgtgacgtcaaccggaacgaagattgccttttgaccagcaccttcaacatccgaaataactgattttgctttttcttcttgtgctggcagatctgccacagcaatatcgaaacctgctttagctaagtgtaaactgacttctgcaccaataccttgtgcggcacctgtaaccattgcaacttttgtcataaataataagcctcctaaagaatttgaaatacaactctattagagtgtactttaatgaaagcgcatttacaaacaatatactccgggaatctaagagataatccaggtgttacaatgagaggtaaataatacagataggaaatgggtgaacgctatgattgatgataaatgcgtattctgcaataagccagccgttttagagaatgatttagctaagggattctttgatattcgtcccatggccccgggtcatttcttgatcgtgcctaaggaacattatgtgactttctttgatgctccgagagacgttcaaattgctatggtcgatttactggatcaggcgaaaacttacttggatgaacaatatcatccccgtggctatcaggtgtttagccatgttggcgaggcggcatatcaaaaagtctttcacgcccacattcatttggtaccagtagcttgaaagaagtagaacagataaattgtacacaaattaaataaaacacaagtatattttttaacactagtacttgggtatggtatattatccttgacgtgtgaatgacacgtactttgcttgcacttaaacaggttatccaaggaggatgtccaatgaaactacaaattaccgatgccgcaactaagtggtttgaagatgaaatgaacgttagcccaaatcaaaaagctgcgattcgtttttatggtaaattatatggccgcacgaaggttcacgacggcttttcaattgctttggcacgggaactggatccgcataactttggtgtcaaagtagaaaaagatggtgttaccttctatattgaaaaagatgacctttggttcttcaagggatacgatttagatgttgattatgattcgaaggaagatcccaataacgttcagtatgaatggacggataacggggaattgtaaaagttagagatagatagtgaaagcattcagccgaatgaaagctgagtgcttttttgaatttaggcaaggaaacacgttcttttaaggacgtgtttccttgcctttttctgacattgtttgttggcaaccggttgggaatatcgtataataagaacatacgtttgccaatgataaaatcaaaggatgttactgcttatgacgctaaaagccattaaaacccgtatctatcccactgtccaacagcaggaaaaaaatcacggccaacttcggttactgccgtttcgtttggaatcaattgctcgatatgcagaagcagcgctatgccaacggtggcagttatgtcaacgagtttggtatgaactacctcattaagtgtttgaagcaggaatatccgtttcttaaagcggcagaatcagcttcattgttacatgtgagtcgtgatttacaccacgcctatcaaaaactgttcaaagaacatcaaggctttccgaggttcaagtcccgtaagtttcccaagcaaagctatcaatgtaacgcggttaaccacaatatcaaactggttgatcagcattatcttaagttacctaagttgggatgtctaaggtttaaagctggccgacaaccggttggtcaaattaagaatgtgacgattcgactctccgctaccggtaagttctacgccattgtcttggttgatactgatattgagccattaaaccgcactggtaaggccatcggtattgatatgggtgttgcggatctcatgattacttcggatggtattaagtatcccactatccgatttgataaacggctcagtaaaaagaagcattactgggaaaagcgtttggctcggcgcagacgtcaagccgaaaaagagattgcctgggataagcacaatcaggtacccgaacccagagagctggctgattttaaaaactatcagaaggctagacagatggtagctaaatatcatgaaaagattgccaatcaacgggataactatctgcacaacatcaccaaagaactggttgaacaatacgacgtgattaagattgaagatttgaaagccaaaaatctgatgaaaaatcacaagctatctaaggcgattgccaaccagtcatggcgagaattacgattaatgctggaatataaatgtgcctggtatggaaaacagctgttcatcgtcaacccacggaaaacttcccagctctgttctgcctgtggctatgatgatggcaagcacaccttagacattcgccagtggacgtgtcccaactgcgggattaaccatgatcgcgatatcaatgccgcaatgaatattctaaaagcaacagcataataaaagaccaactgggctggaacagcccttagtcaatagccgtaacctctgtgtaccattctttgaatgatacgtaagtcagcggtgttcctagaagctcgttactttagtgacgagtagttcactgctgataaccgtgcagtattaaaagagatggttgttgatcaggatatcgacactttgagcgatttaattcgtcattatcagtctaagaatagtgactagtacttacctgacatcctcggtataatttatagtgagacaaaatagtggggtggaatgatgaagcaagtttactttctttgtaccggtaattcctgtcgcagtcagatggcggagggatttgcgcgaacattgcttgattcaaaatgggaagttcagagtgcgggtgttgaaacgcacggactaaatccagtggcggttcaagtgatgggtgaagtcggcatcgatatttcacagcaatattccaagctcattgaccgtgattatttgaatacttgtgatgtggttgttacactttgcggcgatgcgcgcgatcgctgtccagtcacgccagcgagtgttcaacgcgttcattggccgttaccggatccagcgcaagctattggcactgatgatgataagctgcgcgcctttcgtgaggtgcgggatgagattcgacaacgcattgagactagtgaattattcaaataagaaatagcgaggctgtgatataagtctatattgataagaatttaatctagtttcttgactgaaagacaacttaaaatttgttttttgctcaatactttaatctagtctaaaatggctccacaactcagattccggccatttaacacccaaaaagcgtattccgacaaagttcgacggaatacgctttttgggtgttaaattctggaatctaccgagttgtgtcacactctcattagataaaccaattattcttcaccagaaccgataatggtaaagtagttgctgccacctacggaatagatactggctatcgttttaccgcttgaataagctgagtcactatattggtagggcgtgtgccgattaacaattgtcagctggtactgctggttgccagattgatggacacgtttgtcgttgacgccagctaaatggtgagcgtagtacagatgaaccgtatcgttagttttctcagaaagaatgattcgctgtgaatcattaggcttggattgataatggctctctagtgtcccgaggaatgaagggtacttcttggggtcgttgcggtaagtttcaatgtagccgtcagatgatattttaatggcgtcgacgttgcggttgaggctcttgatggcacctacaccgccagaatataaggtgccgctcccgtaaggcagtccataagcaggacgaacaatttgctgtacttttttagcgggtaatttaaacgaaaccgctccgaaaccatagacttttgaattaactaaatgtgattttaaatgatagctgatattaggtgtcatatagccggaggtgtaggcaacgtttttggaagctacttgttgatggtagcgttgtgcgccgatgatggtgccctttggcagctccaagcgttttctcaccgcgtttgaattagcagtagacgaataggtcacggttacatcagtagcactttttagccggtaccagttagtcgcaaaaccaccgtcattatcaccgtatgtatctgggttgaccaccgttcgatgcggatgactgatcgtctttccttgcacgcattggcttgtaccgaagacaccaagcgctgtaattgcaagtataatggttgctttggatatggacaatgtaattcacctccttggggttaattatatcatgtgaaatctttgataattttacactttgcgaacagttattgatagtcatgaactaaaaacgcctagtaccagttttgactgataccagacgttattttagttgatccgtttttagtttaaatgcagcattttagcagcattaccgtacgcaatcttgtcttggtcttcctgacttaagccagattcagttaagaatttagcagcaccttctggatgattgtatggataatccaatgaatacatcaaatgatcagcaccaacttcagtcatatctaactgtaattgagctgggaagaacatgccgcttggcgtgatgtagaagttatcccggtaagtttcactgatgctgcggtcaaggttaacggttagaccaatggtttgatccatgcgttccaagaagttaggcaccatttcgccccagtggccagtgatgatttttagctttgggtggcgatcaaagacacccgctagaatcaaacgcaccatttgaacacccaggtcttcatgccagccccagccagcgcccgcaaaggtaaaggccgttaattctgaccagcccttgccttcataatagtgttcgctgattgattgcggaatgaaaacggggtggaagtacagtggtacatccagttcttcggctttggcgaagatgggttcgtacattgggtcatcaaagaatttgccatcatagtaaccatggatcatggcaccttgtaggcctttttctttaacagcacgttccaattcgtcggccgctgcttcggggtcacccactggtaaggcagcccagccaccgaagcggttggggttagtactgatagcatccgctaagtcatcattagccattttgcataaatcaacggcaactttaggatctaagttctgtggtgaatcatcaccgtaacccataacttgcatttgaatatcattatcgtccatgaactttaggcgtttttcgccaacgctagtgagttcagtattatcctttttagtttttgccataaagcgttcaatactgtggtcgtctggattcttgtgagggttgaccggtgctggcatataaggttttgctgcatcattgacccgttgtgactcccagtgttcttcaagtgtaataaatttcatatttaagtgcctcccataattgaatggttcttattctagacggagagcataaaaaacaacaccccagtttgttgtcaaaaggaggtgttttgtaacagataaattatttttggtggaaaatggtttccggagtgggcatgagcttttgataaagttctattagggtggcttggtcaaggccgggttgctcaatcatcaactgggcaaaactcattaccattcgggcgtacagttcaatagtaaaggcatcctcagagttattagtcgtgtaaatggcattaacgcgtcgcatatcgttgacgagatactgagtcacattttgttcttcgtgtgcccaaaatatcattgcaagagaagttcggttttcttccattaaattcaccattaagtgcggagcaaagcgagttgagtcattcttttggtcggtttgctgcaaaaagctgttaatgatccaagccatgtttaattggatgatttcaccaaggttggcgtaatgacgataaaaggtttggcgggcaatttgggctgacttgcaaagggcactgacggttatggtattgaagttttgtttcacttcaaaagccttgcgcagagccgcaaataagcgatgctgtgtttcttgaagacgtttatctggtgtgtgataagacgctgcttgaagtttgatttggctcatagggaatgacctcgctggtgaatagtttcttctattatagtctagtttgagcgtgagaagatatgggttggtggaactgaaacgaaaagaccaaagtcgacattaactgcgactttggtccctttgttttatattgttgaaacgtgctgcagcaggcagagagctgcatgtaagtcaggaaagacataaatccaagttcgggatttttgcctttcccgccttacactccgctctctaagcgcctgctttcgcactctactgttacatagcctaaacgtgctccagcaagcagagacttgcacctaagccaattacggtataaatccaaacccgggatttttaccgtaatcagcttaggctccgctctctaaccgcttacttccgcactctacagtaaatgaatccccgcttcttcacacttatcaatcatatcttgtggccacaatgctgcttggacttcaccaacgtgaactttacccaacagcaacatgcacaaacgtgattgaccaatcccgccaccaatcgtgtatgggacttcttcgttcaaaaccatcttgtgatatggtaagctcaaacgatcttctgctccggcaatctttaattgcttcttcatggattcggcatcaacccggatacccatgctggagatttcaatcttttgatccaatggttcgtaccagaagatgatatcgccgtttaattcccagtcatcatagtcaggtgcccgaccatcatgctttttgccgctctttaaagcaccgccgaccttcataatgaagacacagcgaagttctttagcaattaaatcttcacgttccataggggtcttgtctggccaacggtcttccaattcctgcgtggtaacgaagtgaatttcgtcaggtaagtgatagacagattctgggaacttgtaccaaacttcgtgttccatgtgcttgatgactttgaagatctgacggacagtgctcttcaaagtttccacgttacgttcgtctttgctgatgaccttttcccagtcccattgatcaacgtaagctgagtggaagttatccaaatcttcgtctttacggatggcgttcatgttggtgtaaaggccttcatgaagcttgaaaccgtaacgcttcaaagcaactcgcttccatttggccaatgagtggacgatttcgatttgttcgtcgcccatgtccttcatggtaaatgaaacaggtgtttcaacaccgtttaagttatcgtttaaaccagtcttcttttcaacaaacattggggttgaaacccgtgacaggttcaattctttacggaattcatcctggaatgtttcccgaatgtaacgaatggcgtcttgtgtttcgcgaacgcttaatttaggttcgtatgactttggaataattaaatgcaaggtactcgctcctctaaaatagatttggaataaaaaaagaagccttttatcccttaaccaagggacgaaagacttcatttcgcggtaccacccaagttgcctatccatagataagccacctcaatacgcgtactaacatacgctccaatggtaacgtttcggtaacggcgaagcttactgctaagtggttcagcccgcaactaagaaagtgttattcggtaaagccgattactgattgggttcacaccatttcccaactcactgacagttcgactagacttactcgtctttcctacgtcttttaatctctaatcagtatcttatcatcttttcataatttgtaaacaggcattttaatttttttcggaacgttggtgcatcagctttagcgcataagtagaagaaaaaatgtttaaaaataatattaaagattggtagaatttaagaatttaggggaaatgatgttggctttatcgctgcttgtaattaaggccgtttcggcttaaagttgccttaacgataagttgattgacgcttaaaaaggggaccttaaaatgacaaaacgagtgattttgattacgggtgcatcaagcggtatgggttacgcctcaacgcagttatttgcgaaacatggctgggaggtttatgctggggctcgccgagttgagaaaatccctacaggtgagggtatccatccactttatttagacgtgactgatgccgattcacggctgcaatttgtgaaagatgctttggctgatggtttgcgtgcggatgtgttgttgaataacgctgggtatggcgaattgggtccactggaagaagttggcgttgagaaagttcacaagcagttggaaactaatctggttggcgcgtctgaactgactaaattagttttgccacaaatgcgccagcaaggtttcggtcgaattgtcaataactcttcgattggcggggatgtttactcaccgcttggtggctggtactacgtcacaaagcgtgggctaaatgtctggtctgacgtgctggatactgagattcgccagtttggtctacgttcagtgattgttgcacctggtgggacggaatcttcctggttagatatcgctatgaataatgcgttaagtaatttaaagccagattcaccctacacaccgctaactgaaggcaccaaaaaactgttgggtggtatgctgaacacctctgaagcaacttcggctgatctggcaaaagtcttctatcgggcagctacggaacggcacccaaagcgtcggtattactttggtttagcagaccgaatgctgtcacgactcgcccgaaatcatcccggggtttatcatgaaggaatgagtttgattgtgagtcggttgacgcggaataaataataatgaacttggatctcataactattaattaatagttatgaggtttttatgatgccttaagtccaaaataaaacactatataaaaagcgtcataataggaacgaaagcgctaacattgtctattgtatttccataaatttgcttgtatgattaaattgtataaaagttaaatagttgttactgtcaattgttcaaggaggccacaggcatgaaagcagttcggatttatggcgagaaagatattcgcgttgaagatgttgcgattgcagacccaaaggatgacgaagttcaagttaaggtagcatactgtggaatttgcggaagtgatttacacgcttatttggaaggctgggggttaccaacggtgcctcatccgctgactggtaagacggtgccaatcactttaggacatgaattttctggtgaagttgtcaaagttggtcaagacgtttcgaatctgcaagttggcgataaggtcgctattgagccgttaattgcctgtggtaagtgtgaaaactgtcgtaaaggggactacaatttctgtaataacgcagttggtcctgatggttcaggaaacttcttaggtttctcacaagatggtggttttgctgaatttgctaatgttcagggtgtttttgcacacaaactacctaaagggatggataccaaattaggcgccgtagctgaaccaacagcagtggtgtatgaagccgtaaaacgcagtcaccttcaagaaggtcaaaacgtggctatcatgggtgccggtcccattggtttattgatggcattattagctaagattagcggtgcaaataatatttacattgtggacgtttctgaagtccgacttaagaaagcacatgaattaggtattgagaagacgctcaatcctaatgaagttgacgttaacgaggccattcgtaaggaattgcctaacggggtcgatattgcttatgaatgtgctggggcacaagctacctttgatactgctttgaaagttactaaacgaacgggtaccctgcaagtggttgccttattcggcaatgacgtttcaatgaacatgacggatgacgtgatcatgcaaggtatcaatatcgttaccactttgtgctacaacaacagtttcccagcagtattaggcattattaataataatcaagacgatttcagaaagattatcactaaagaaattggtttggatcaagccgttgatgaaggtatcaagactttatctgaagataagtcacaagttaagattttagtttctccagatctgtaatgtggcactaatatgtaagttaaagaaatcaattcatcgtgaattggtttcttttttaacctcaattttaacctcaattttaacctcaagatgtaatcgtaataatgccaaaataaaaaaatttaatttgcacttgccttcgagtcgctttaaggttgtatgatataaaatatcactatttgaatattatccagtgacaaatgttagacagtgtaaagtattaaaactaaaatatatctataacgacatgaattgagaaggtaacgattgtgaaagaaattaatcaagaagtttttgaaggcgaacgagcgctgtttaaagctcacgacctcaacataaaaaacagtacgtttcaaaacggtgaatcgccattaaagcacagcaagcatttaaatattgagcataatattttcaaatggaagtatccgttatggtatgccgatgatattaacgtttctcagagcactttgaaggtggaagctcatgctggtatctggtataccaaaaacctaaaaatggataatgtcatgattgaagcaaccaaaacgttccgacatattgatcacgcagagttgtctaatcttaccatgagcgatgctgccgaaacgctgtggtggtgcaatgatgttaagttggatcacattacagccaaaggtgattattttggtaaaaactgtgagaacattgtggtcgatcacttgaagctaagtggtaactatgcgtttgatggcagtaagaacatcgaagttcataactctacgtttgaaactcatgatgctttctggaattgcgacaacgtaacggtttatgattcaacgctagtgggcgaatacttggcttggaattcgaaacatattcgctttgtgaactgttggattgaaagcgaccaaggactttgctacgtggatgatttaacgttggagaactgttcactagtgaacaccgatttggcattcgaatattgtacggacgtcaatgccgatgtgatcaccagaattgatagcgtgaagaatccagtgaacggtgtgatcaacgcaccagccattggcgaagtgatccttgatgatccggacatcgataagtcagcaatcaaaattaacgtcaggaggaaaacggcatgacggatttttcagagttaattgaccggcggcatactaactcagtcaagtgggatgttaaagataacgagctgccgatgtgggtagcagacatggatttccggactttaccggcaattgttgaagccattcaagaacggtctaaaaacggtatttttggttacgaagaagtaccacaggaatactttgatgccgttcaaagctggtatgaaaaggaacacaactggcggcctgaaacggattggatgattttctcaactggggtcgtgcctacgatttcctcctcagtcagacggttgaccaatgttggggacaacgtgttggttcaagcgccagtatataatatcttctacaactcaattctaaataacggtcggcacgtgctttctagtgatttggttttggatgatcaagacacttaccacattgactgggaagacttagaagccaagatggctgagccgctcacaacgctgatgattttatgtaatccgcataacccagttggcatgatttggtcggtggatactttggcgcgcatcggcgaactggctgctaagcatcatgtggttgtgctgtccgatgaaattcacggtgatatcaccgcaccggacaagggctatacgccatttgcatcagtgaataaagttaacgaacagaactgtgttgttgcggtatcaccaagtaagactttcaacgtggctgcactgcacgctgcaacggtcattgtgcctaacgaagcgttacgagcagtcgttaaccgcgggctcaacacggatgaactggccgaacctaattcattcgcaatcccggcaacgattgcagcctataccaagggccatcagtgggttcatgatctgcgagcctacatcgaggacaacaaacagaccgttgctaagtttgtggcagaaaatgttcctggagtgaaagccgtggcgggagacgcaacgtatctggtttggctagataccagcaagattggcatgccttccgacaagctggaacagtttatccgccaagaaaccggcctgtacctttccgatggtacggtttacggcggtgacggccgtgaatttctacggatgaacgtggcctgcccgaaagaacggctgatggacgggttgaaccgtttgaagcaaggaattgcagcggttaaataaatggctgtgacattaggtgatattgataaaagtttcagctggtttcttgactgaccagctaacgttggggtacacgcttcttaaacgtgctcaaacaagcagagagttgcaaataaggcaggggtaacagaaatccaaaaccaggatttccgttacccctgccttattctccactctctaaacgcctgttttcacactctttaaattaacaattaccaatattagcaaaaataccctgcttaaaggcggctaaaatatcttttccatcagcaatcaggacgttgttgtccaacagctgaccgttattggtcaggttaatcatgtttttctgataatcgagttttaatccctgaccgagaaagtagacgtcgtaatcagaggtgtacagtgataaaccagcgttattcttgagttgcacgttgtattcatcatcaggctgatctaaaaccacgatggtgaacttggtgccaatactgcaggcgccaccttgaagcgaatacttgccacccgcatcatcggtgatcaataacaacgttttgtcggcgacgtgtttttgcttcaacaagtcaacgactgcgggtgtaaccgtaattgtattcattttaagcacttcctttttaatagcagtgtacgctggtaatggtacaaaatcaattgtgcacagtctaattttatcagaatcaaccgctagcttgtgagtccaaagtacaccattacggcaattcccagaataattcggtaccagccaaaggccttgaagtcgttatgctgaatgtagttcaagagaaatttaatagcgagataggccaccacaaaggacacgaacacgccggtaaatagcaccactaattgcgtacccgtaaaggtgttgccgtgaaccagatactttgtcatttttaaaagtgaagcgccaaacatggttggaatagcaagaaagaacgagaattcagttgcaacgtatctagaagcgccaatcataatggcaccaagaatggtggcgcctgagcgagaagttccggggactagcgaaaggacctgaaaaaggccaatcagaatagcaagtttaatcgggagttggttcaggttggaaaaggtggctgttcggtgacgattaaagttttcaatcaggataaataaaatcccgtagataatcaaagtagccgaaatgacttgccaactggttaagtgggcgtccatccagtcgtttagtggtagaccgataatgacagagggtaaaactgccagaataacttttccccacaacgtccatgtttgccgctgttccagtttgcctttattacgtgcccacggatttaatttattgaaatataggaaaattactgccataatggcaccgaattgtataacaaccataaacatgttaataaacgctgttggttccttgagcttgacaaattcattcgctaaatagaggtgacccgtagaacttattggtagaaattctgtgacgccttcaatgattcctaatataatagctttaataatttcaatcacgatggtgaacatcctccgttatgactttctgtttagactaagcgtacgggattgttgtaaagtaatcgcgtgaaatgtgtaaaaattgtgtaaaagatgccataaactgtttttaaccttgtttatattttttaataaaaggaacataactaatttgatgtgcgttttgacggcatatgacggtatatgttccaagataatggtgatttaaggagcatttgcgtttacagcagcacgtcgcttgttataaaatttacataatagagtaagagtatattttttacctacccaaggggggttcaatatggtctcatatgcacgcttgcgtacgcgtaatcaaattacgatggcaatgctgaccttattaaaaactcaccggattgaaaacattgaagttactcagatttgcgaagcagcatttatcaagcgcagtactttttatcggtattttcatgataaaattgacttgtctgaagccgttcttgataagttattagaaaactggcagaatgacggtcaagaagaacatacggcagccgaaattgctgactttttcatggataattatgatgtgttatctcatttgagagtcgatccgaacagtcgccactatgcagaaactcagcggattttgcagaattggctgatgacccatatcacggcggaaaccgagtctgcgccggcggtcatttacaaaattagaagagcccacgatcccatgctgttgagtacgtttttacttgaaggcgtatttggcgtactggcacaggctaacttgtctaatcagcgagaccgcttgcgagttaaggcatttctagttgaagttgttgaacgtattgatcagtctagtagatgattggtcgttgaattgacgagtttttcaataattgtttaagcaaaaagaaacctgacgttcagtcattaactgttcgtcaggtttctttttagttacagcgtcacgactttggtgctgattgcctcaatgaagtcgcggtcgtgttctgtgaccagcatcgttggttggacactttgaattagcttggtgagctgttcttgattgaatatgtctaggtaatttaagggttcatcccagaggtaaagactggttggggtagctaaactggcggccaattcaacctttttttgctgacccgctgatagttgctgaatcggtgttttaaaagcagttcgtggcatacccagctttttcagattgtttaataaatcttgatagcttagctgccgtttttccgcaaaggtattgagattgcctagattatccggataatgttgacgaactagactgcgtgaggcagtttcagtgagttgaatttcaccagtaatatcgcccttgaactgacctaaaatagcggcaatcaatgatgatttgccactgccgttagggccaattagagccaggcggtcaccacggtttaattcgaagctaacgggtttactcaatagcgaatggtcaccataactgagttgaacatttcttacccaaagcaacgtttcgtgatggtcgagctggtaattcatcgttaacgaatcgatgaattctacattttttagcagtgattccttatccgtaacggctttatccatgcggtgttccaaattcttagctttttgcatcactcgtgcagaacgggcaccgataaaaccagtgtcatagactgcgccgctgcctttttgatgcggattaccgtatttatcaccttcgcgggactggctccactggcgtttattggctgcggtctgttttaaccggtcaatgtcgtggcgcaacttagcttgttcagcatattccgactggtcttttagctgcttagcgtgagcgtaagccgaataattcccctgagtcaaaaccagctgctgtttttcaattgttaaggtgtgatccgtggccgcgtctaaaaagtgacggtcgtgggaaatgacgataaagccttgtgaaacgtgtcttaaatagtcagcaatctggtctcgtcctttgatatccaagtgattagtcggttcatccagcaacggaaagccggtgtgactggcaaaggtcgctgccagcaagaccttggtttgttcgccaccggagagactttcgtaggggcggtaaagcaggtcgtcatcggtgtgcatgagggaaagctcacgttggatttcccataactcaccggtactagcttctgtagcaacgacccaagccgcttgagccgtatctttgactggttgcggaaaatacagcggtgtcagtggcacggtgatggtgcctcgaccctttagttttccgcggatgaggttcagcagggtggttttaccacgcccgtttctgccggttagtcccagcttccagctactgtcaaagtttaaattttggttggtgaataggttagcttgcccaggataggcaaaggttaaatgagtgatttgaatcgtcgacatagatgtcctccagtttctttggcgggcaccgtggcagtttttgacatcaaaaaagcacctgagaacaattctccaggtgctttgcgcaaagtaatcatgcgtttaggctcgctagagaaggtctaggtcagtgccagaactgcgcagtattcccctgtattgggaatcacggtgctaggttctaacgattgacttagatcttcaatgggcgaggcctccttttttgtttgtgttattaaactaacatgattgggtggagattgtcaactgacgaaaaacgtggaaaatagggcagaagatgcatttcgtcttaattttaaaatggtacagaccaaatgaaaaatacatgataaaatcaattaagtaggaaagttagtggcggttggcaattcaagtgaagaggtgatgtgaatgatagttcatcgcattaatcttcttttaaaaggagtgccttgatgacaaccattatttggttgttttctgtgctaatcagcttattagttggtctgacactgacagttcattatgtggacttattagtcgaagaattatccaatctagtaagggttgctcggaaatttattgaagacatcaaaaaagaccgctaacacaactttcggcaaagttaagcggttttttttttgactaaataatcagctggccgtcattaacggctctacagtgagaggtgttgcaacgcctttcacttacataattagtttatcatcaattagacgacatcgtcaattaagttaatgattcaaaataagggggttagttctctggttcaccgaatttctgccaatgctttgctaagtactgtacagttaagctgttaggggatttgaccaacgttaacggttcaccagcagcaacaatcttcccacctgcggcaccaccacgaggccccatatcgatgagataatcagcgtttagcatcaagtcaacatcgtgggtgatgatgagaatcgtagcaccgttgatgcgcaaacggtcaataatttgcaggagcgtttgaacgtctaagggatgcaaaccaattgagggttcatcaaagacaaacagagttcctgcttgtttctttgtcaggtggctaacaagtttaagccgctgtgcttcaccaccagataaggttggtgtgctttcacctaagtgaaggtaagccagaccaacttctttgagttgtttaagctggtgctcgatctttggcacatctttgaatacggggattgcttcttcaacggagaggtttagtaaatccacgatggaataaccgtgccacttaattttctggatttcgtccttatatcgcgtaccatgacaaactgggcaaacttcttccatatcaggcaggtattgaatatccagggtgatgtttccaagaccaccgcagttggggcacgcaccctgcttattgttgtaagaaaagtaagcaataccgtatcccttggctttagactcgggtaaattagcgaacatgtgtcgcagggcattcatgatgttggtgtaggtcgctaacgttgagcgggcgttcttacccactgggctggcatccacactgactacatcctgcaaatcagtagtgagttcagctacttgttttggcaatttttgctgtttcttacgggcttggatagcgggtaccagtgaatcaataatcagactggtcttgccagcaccagaaaagccggtaatggccgtgacctggttgtctgggaaagtagcatcaacgtggtgtaagttgaaatgatcattgattttaacgcgggtagtctgaccggtaggattcttagcggcatgtttagtttgcagaatagcagaatgcccggagataaacggaccaatcagtgattggggattattgaccagttgttttggcgttccttgtgcaattacttggccaccttcatcaccagaaccaggtccaatttcgataacccagtccgcagctgagatgatatcaacctcatgatccacgaccaccaatgagttgccttgcgcaattagctgccggaaaacgttgatcagccccttaatattatccggatgcaggccaatcgacggttcatctaatacatagagcacaccggtggtttcagttctcagtgttcgagccagctgaatccgttgcagttcacccgttgatagcgtattaccgctacgagaaagactgaggtattctagtcccagttctagtaatgggcgcaaattatcatctagttcagtaaagagaattttagccagcgaagccatatcatcgggtaatgtcgctttagtatcgttctcccactttgctaaatcattaagttgcatatcagcaacttcagcaatgtttttaccgccaactaactgcttcaaacgctccggattcaggcgggaaccatggcaagtcgggcaggttgaaaaatggtaaaactgattgatcctcgcaatcgaccgttcgctggtcactgagtccagtgaatcttcaaccgctgcataagcattttcgtacagtgcgttgtccatgtgaaagactcggccagtaccagagctaatattaacgggatgagtttcctttttaccgtggagcacgatgtctttttctttgtccgtgagatccttgtaaggaacatcggtgcgaacgcccaaagtagcgaccacttttggcatgaagttacgaccgggcaggtgccatgaacccaccaccccttggtcaatggtcagattttcgtcaccaatcaacttggattcatccaactcccggacgacacctagaccgtgacaggtgggacaggcaccagtggaattgaaggagaaatcttcagcaccgttagccatgaagcgtatgccacaggtgggacaggtaatcatacccatatcgtcgccagaaaggtccatcttctgagcaatttcaatggttggtggaattcggtgaccattggggcagacaactgatcctaaccgtgaaaaaatcagccggataacgttgaaggcttcagtgagtgagccaaccgtagaccgttctgaaggaatatttggtcgttgacgcagtgccaatgctgacggaatgtgttttactgactgtacttgagacttcttgttttgcgcgattcgccgccgggtataagttgagagcgcatctaagtatcgtctagagccctcagcgtaaaggatgcccattgccagagagcttttacccgatccagaagggccggaaatagccacaaatttatttagtggaatgtcaacgtcgatatttttcagattattgacgttaccaccacgaacttcaatatgatcaattggttgagtcacatgagcacctgactttcttttaattgaatgattccattctaacttaatttcactctcgattaaaatatctggcacaattcaattggatataaattagtgataatagttaatataaaaaaatcattatcatatttatggtgtttacccgttgaaatttgctattctgggattatagaaaaatgatggttacttcagtcgataaggaggaattactatgggtttattatggtcactcattgttggcgctattattggcgcaattgcaggagcaatcactaaccacggtgccgccatgggctggatctttaacattgttgccgggttaatcggtgcatggttaggtcaggcattactgggtacctggggtccaagcttagcaggaatggcgctgattccttcgattattggcgctgttatcctagtcgtaattgtttccgtaatctttgggatgcgtaaagatgacgcttaagaaaggtggctgatataatggatgccatacaatcagtatttaaattcatggttgccagtacgttgatcgtgggtggtgttttagtcggcggtacagtattcgcggctaaaaaggttgattccatcggtgatttggtgcagaagaagctgcatcggtaatggctgctaaaaaaccgtacatgatgagtgcggttttttattttggaaaaattcggtgttagaattagaacgaagtcaggacgcttgataaagctagtaaagttaaaaatgcaactttatcagtgttttgtattaaaacttagaaaaattctaaattaccctttaaattagaatgattacattgtacaatgaacttgtagcaaattctaaggaggttttcacatgagtttagtaggaaaacagattgaggaatttaaggcaaaagcttacaaaaagggcgatttcatcgatattaccgatgcagatttaaagggacactggagcgttgtgatgttttatccagctgacttttcatttgtctgcccaaccgaattggaagatttacaagaccaatacgaaactttacaaagtttaggcgttgaagtttactcagtgtctgaagatactcactatgttcacaaggcatggcatgacgaatcagacgctgttggtaaactgcaatacgccatgattggtgatccttctcaccaattagctaagatgttcgatgttttcgatgaagaagccggcttggcacaacgtgggacattcatcttagataaggatggtgtggttcaatcacttgaaatcaacgctgacggcatcggccggaacgcttctgaatacatcgaccgcatcaaagctggtcaatacgttgaatcccacccaggcgaagtatgtcctgctaagtggaaggaaggttccgaaaccttaacaccaggcctcgatcttgtaggtaagatttaatgttagatgatcaattaaaacaacagctgagcagttacttacagttgcttcggcagccagtggtcttcacgttagacgctggtgattcggcaaatggcacaaaggtccgcgacttcttgaacgaagtggcggccttgtcgcctaagctgtcgattgctgaaggtcacttgaaacgacagcccagtttcacgttggatgctcagggcgcggcaccttccgggattaccttcgcggggattccactgggccacgaatttgagtccttcgtattggcactcctgcaggtttccggtcatgcaccgaaggtttcagagaaagtccgtcaacaaatcgaggcgattgatcaggacctccactttgaaacctttgctagcttgagttgtcataactgtccagacgtggttcaagcattggatattatgagtctgctgaatccgcatatcacccacaccatgatcgaaggcgggatgttccaggatgaagcagaagctaacgatattatggccgtgccaaccgtctttttaaacggtgaagaatggcataacggtcgcgcaaccttggaacaactggttaataaagcacaggggaaagccgctgtggcagcagttaacgatgatgtttctgacaaactctatgatgtattgattgttggcggtggtccggctgccggttctgctgcggtttatgctgccagaaaaggcttatccactgctgtagtagccgaccatattggtggtcagccccttgaaacggtggggattgagaacttgattggcaccgactatatcgaaggtgaacagctgatgcaaaatattcgggctcagatgactaagtaccatgtcactttgattgacggtcaaacggttaccggccttactgaaggatcacccgttcaagttcaattaaagggtgataccacgttgcaaggtcggactgtgatcatcgccactggtgcacattggaagaatattggtgtgcctggtgaaaaagaattccgtaacaagggtgtagcctactgcccacactgtgacggtccgctgtataagggcaagaacgttgccgttattggtggcggtaattctgggattgaagctgccatcgacttagctggcattgctaaacacgtttcggtactggaatttggacctaaaattggtgctgatgctgtattggttgagaaggcaaagtccttatctgatgtggatctcatcactaatgcccaaactaccagtattgaaggtgatggtcgggttaacggtttagtctacactgatcgttcgaatggtgactctaagtcattagccgttgacggtattttcgttcagattggattagttccaaataccagttggctatctgaatgccttgatatggataaacagggtgaaattatcgttaatgaaaagggcgcaaccagtttagcaaatgtttttgctgctggtgactgcaccaactctgcttataagcaaatcatcatttccatgggctcaggtgccaccgctgcccttggtgctttcgatgcgttagcgcgtgaggttacggttaaggcataatacggatctttaaaatttgaatctttaaaattaaaaccgcggtttacttcgtttaggagtaggccgtggctttttgttgccatcttcggcgcccgcgttttggtctgctgtggggaccggcaaaagccactgtcttttgcctcgcattcaagccacgcccaacccgcgcgtcttgaatgtcgtcccgtgctgtaagggctaaagccctaacaccactgtcacagctgaccaaaacacgggcgcctacggttactgagtggtcagaatagcaaaaaaccggctgtggattatccacaaccgtttttttgcacatattcatttttattattttacaacgatttaatttctgacatgacgttttgtggcaactttaattcagctgctttgatggcgtcatcaacgtattcgaccttgcttgcgcccagtaatgcggtagtgatacctggaaccgacaaaacgccagcgaaagctagttgtgacattgaggtacctgattcatctgaaatagtcttcaacttttcaacagccttttggtcggcatcattgaagtactccttaatgagtggttcgccttgagcagcgcggctattgcttggcatggcaccgttgagatacttacctgtaagaacaccgcgagccagcggactataggctagaaagccaacgtgcgagcgctgggctaactttaagaccgcttgatcgtcgtgcttactgaggatgttatagcggttctgcaatgacgttagcgggttcaaccggcgatccttgatgatttccagtgcctgagtcaattggtattcggtatagttagagaccccgtaataacgaatcttgccttcgtcaaccaaatcactaagagtggtcagagtttcagccaacggagtgttattgtcgaacagatgagcctgatacaaatcaatatagtcggtttgcagacgttccaatgaagaatcaatctgctggaggatatgttcccgcgacagcgacgggttactcatgacaggattggtatttgagccaaccttcgttgctaaaacgaggtgagaacgcgcacctgagttacggttgagccatttgccgataatggtttcggatgtgccatcaccataagcaggtttttcgtcttgaccgggaccgtagtaatcagcagtatcaattagattaataccgctgtttacggcgtggtctagaatggcgtccgaatctgcttctgagatccagcggccaaacgccatggtacctaagccaatttgagagacctttaagttactattgcctaattttactgttttcatgtatttccccctatttttcaggttgatcggctgagatggaagtatcacggacctgcttgaagtcagctaaggactttgtatacttgtcaattgccatatcagatgcgaacttacccagtggcaagcgcaatggcaggtgatcaaagttattcgtgacttgattgtaaatgatttcggctgcagcgttaggatcgccagcttcatgatgagcggaagcactggattgttcaatggattcggcaaactgttgatagtctggggtggttggtagtgtcttttgtgaagaccgaccagcccaatcggtacggaagccactaggttcaatgagtaagactttaatatttaagtctttaacttcttgagctagtgattcgctcatgccttcaacggcatatttggtaccgtgatagaacgaaagtgttgggaatgaacgaagaccggcaatggatgaaaagttgacgataacgccgctacgctgtttgcgcatggtaggtaataccgcccgagtcatgtcgactaggccccaaacgttcacgttaaacatgtactgaacggcgttgcggtcactttcttcaaaggtaccgaagtaaccgagaccagcgttattgaccagcacatcaatgccaccaaaacgatcgttgacctgcttaaccacttggtcgatttcatcttgtttagtgacgtctagtgtcagtttttgaatttgaccgtgatcgtattgatcgaggtagtccagttggtcggtatgacgagctgtagccaccaagtttaaatcagatttttgcgctagcaaggttgccagtgagcgaccaaagccagttgaagttccagtaatgagccatgttttgtttgccatattaaaaactccttattcatctattttattcattatataatactatcttagttctttttggctgattgtgaatcatttgctatttaattttgataattcagtgagtaatgtctgcttgattggcggaatcacggatggattgtagacgtcgtaaaaaacgcaattatgaaactggctggcaggttcgatgcccacgtaacggaacgtaatctccagcggtttcagcaaatcagccaccgtgagtcccttggtcagtgggttccctggggcataggtttcctggaccgcagccagggtcgtcacgtagccgaacttttttccgggcattaaggccaccggttgaccgttttcgtcagaatcataaaaacggtgtagcgcaaatacgtcatcaatatagcgttttagtctccacggtaccgcataccagtagagtggaaaatagaggagaactagatctgcccagtggaacttggtgtattcttcatcggcatcataattggttacttcggtgagcttaacctcattatgtttggacagctgttctcgactgatttcaaccagggtttcggttagtttgccacctgcatcgggatgcggagtatatccgttaattaataaaatatgcatcaaaaactcgcccctttctagaatgatcatatcatggcatgtcacagattcgcagtgaaaagtgtgctttcagagaaactatcactgatttaagtttaatggataacttgcattttacaaaaattcagttataattctaattaatatttaatgtcggacttacaaacaagtagcactttatctgggtgtcaggaagttggcggttgctgcgagccaatcagggtaaagttgacgaaatacgtagacgtcgacaatggttaccgctagaatccattatcttctggtgagtggtgtacagtgatgtgcacaatttgggtggtaccacggtagaagtctgatcgtccctgttgcaatgaatgcaatgggggcgatttttttatggagaggcgattgtgatgaggacaagcagtggcggtatggcacgatattgatccagtaagcgattagcggtaaagagagaatataaaagggagatcaatacgatgttaaaaatcaaattgagtttaagagaagccattattatgttagtgattattttagccattatggggttaggtgtgattggtttgggcctatcaccacaagtcccggttttactagccatcaccgtgaccattttctgggccaaattcaaagggctgtcttgggatgatatcaatcacggtattaaggacggtattgataagggaattattcctatcgtgatttttattctaattggcgctatgatcagtacctggatcgccgcaggtaccattccgacgttaatggtgattgggttcaaggccatcagcgcacagtggttcttaccaacggtttttctggtttgttcattggttggcgccgcggtagggagctgtttcacggtggtttccactgtgggaattgccttctttggcattggggtcaccatgaactttagcccagctttggttgctggtgccgttatctcaggtggaatctttggtgataaatgttcaccattatccgaaaccaataacttagccgccgctgtcgtggatacagatttgtttgatcacatgaagaccatcttatggtcgacggtacccgcagcagctatttctactgttgcgtttgcctttcttggttttggtcataaccatgccgattttgcgaaaattaataccactgtcgccgcactttcacaggacttccatatttcgtgggttgcgcttattccaatcgtcctggtgttcgtctgcgccggtttcaaaatggcggccattccaacgatgttattaaacgtcttggtgtcagccattatgatgttcattaacaatccatcattgggtgtgactaaagccagcaacattattaccaacgggttcgttgctaaaacttctaatgccgaagttaacctgctgttatcacggggtggcatcgttagcatgatgcccactgtggccctgattgtcttgacgctttcactaggtgggctgttagttaattttggtttagtcagtgcggtgatgacaccattggctgctcatctgaattcacacgctaagctagttaccgctgctttagccacttgcattggtatcaacatctttgttggcgaacaattcttatccatcattttacctggacgttcatttaaggagaccttcaataatggcgggcttgaaagttcagcgcttggccggacgctggaagatggcggcaccgtgctaaactacttggttccttggggcgtcggtggggttttccttgctaacacactgggcgtgccaaccatgacctacctgccattcgttttcttcagtttactgtgtccagtaatgtcattgatcagcggttttacgggaattggtttacacacggagtcacaacgtgccgaagccaatatttagggcaaatgactatcactttaactgacttttcgagcgataaatgatacactaaccgtgtgaaataagaaaggatggatgacaacatggcagtgaacttaactaaagaagaattaaaacaatacgatggtaaggatggccacaaagcgtacgttgcagtcgacggtaccgtctatgatgtaacaggcgttgaggcttggcagaatggcgaacatcatggcaaccttgctggtcaggatttgtcagcagtcatcatgaacgcacctcataagaagtcggtactggataatttaccagttgttggaaaattagtttaacgcagagtgcttagaaacttagattgaatttaaataaaaagaagcgcgtctcccgtttttggggaactgcgcttcttttcattacgtagcaggaatcagagttactaaacccgtttccggcatattgcagttttaattcaattcgatcaaccccaattgcaaagccttagccactgcctcagcccgtgaaaagaccccaagcttattataaatactggtcaggtgtgatttaacggttcgttcgctgaccccaatatcagcggcgatttctttactgtgataaccctctgcaacttctgtgaggatctgatgttctctaggtgagaggtcaatctcggattctggtgaagaggcagcaaatgccttgccagcgatgcgtggttcaataaaggtttcacctttgatagcgccacgaatgacgtttagaatggtatccttatcggcgtctttcagtagaaagcctttggctcccagctgcatggcttgctgaatcggtttttgatcatcaaaagtcgttaataccaccactgggagattgggcgtttctatatggagctgtttgatgagcgcgataccatctaacttgggcattcgaatgtcggttaaaacaaggttgggtttgagtgcacgtgctttttctaaaccatcctgtccatcagcagcagtaccaaccacttcgatatcagcggccgtttcaaaaatcagttctaatcctgcgcgcagcagttcatggtcgtctacgattaatactttgatcatcagtccaactcctttcttttagcagacatggtcagcgtcacggtggtgccctcacctggggtactgatgactgtgaccacaccatctagccgcgtggcacgttcctgcagtccgtcgaggccatagtgaccatttttttctttgttttgaggtttaaaacccactccaaaatcaatgactttaagtttaaaaatattgttattaagctgactgctgattagcgcctgattggtttgggcgtgtttagcaacgttggtcagcgcttcggtgacgattcggatgatttccgttagctgactgggtgagtaatctggaatgtcccccagcttaacggtagtgttaatttgataattcttctcaatggcttccgtggccaattgcagtcgggcagggagactttcttccgtcgtctcacgtagatcggtcagggtgattcgcgactgccggagtgttttacgcgcttccacggtactgctgttaataatttgttttgcccgtttgacgttaccttgatccagaaaactgtcggctgcctccaactgcatgacgatggcggcgagcccctgagtcaaggtatcgtgcagttcacgggcgactcgctggcgttctgaacggattgcggagacttccacctgcttataggcgagccgcaattcactgtaaaggtcttcaactctttgacgctcacttaattgctgtcgataaagatgccagtaatagatgacgattagaacgacaaaaataaacgactgaagggtaatcagtgccagccgccagccgataatgaaggagtagactagccataaggcgatgtagataatggtcactccggtaaggatgatttggggcctacgataggcaatcaatgattcaatcatcaagaccggataagtacccaccatgatgatgggagcgctaatcggtaaaatggcaactaaaacgatcagtaacacaataggaacacaaatcatttcccatggtcgtttttgataaagccagggaccaatccaaattgagaaaatcagacaagctgttcccaacagtacaactgtcaaaatggccgcgtggttgaactgatttggcctgactagaatttggttgctggtgatctcgcgtacgtgttcaccaacagcaaaggcgctagttgataacacgtagagagcaacgaagccaatcatgaccatccaaataattaatggcatgcggacttgttttaatgtcagaattttctgttcttcagtttgttttggcatgggggactcctttttaaataatcacttgtattttacactaaaaaaccacttcgaaacgatttcggagtggtcttttaggctgaatggccgttacgattttagaaattggccgggtgttacgatgaaaaatcgtctgcaggacattaacgctaattgagttagtcggcagagagggcgtcgattggattcaagcgtgaggcacttcgagctggtagcagcgatgctaacagtgaaatgaccagcgcaatgataaagactaggacaacgttgcccatcgaaatttggacaaacgcgtagttagcgattttccccaaagcgctgttggctagagcgctaccagcaaaggcagccacggtagccagagcggcgctgaggacaccgataatcagtgattcgctgataaataggcggcgaatatcgcgcttggattcacccaacgcacgcagaatgccaatttcctttgtccgtgcgctgacagacatatacatggtgacaatgatcatcagggcggatacgagtaatgaaattccggcaattgctgcgaggatgtttgatgccaagctgacgtaggtctgaaccgtgctgatcattgaactgacagaagttgctgagaattgacgcttattattactcttcaatttattcatttgtgaagtcgtagcgttgacgttgtccaacttatccacgttgactgcaaccgtggttgcatcggttgggacgttagcagttttcatggcgttagtcatggtcttggtattaacgtagttattagaacgggcactgcccatattgcttgagctggaagcaatcccagagaccttggctttaatattaacggtgacgtttttattgttcttgttttgggcttgatactttaacgtcacggttttgccaatcatagacttgtagttcttattgaacttcttagccacggagtccttatcgatgacgacttcacctgcatttggtgtatggccgtattcaatgttgttcttagttccactggcgttccagttttgcaacgatgcaatggttgctgacttaccactgtatttggccgttgcgttacttgccaggtaaaccttatcgacttgggtcacgtgtttcaatgatttcagttgtttaatgttggcatcggtaaaggttggctgtttcgtggcgggtgatgctgccgaagatcccatcgctgcagtttgaccaccactgggagcactgccaccctgtggaccagctgtttgagcggatgaacctgattgaccgccacgtctgctgccagattgtgctgactgtccgtttgaacgattagatttagccggtttttgataacggctaactaccacgacttgcggattgaccatgtttttgacttgttggctgatataaccgctgataccgttgccaagtcctgaaaagagcatgacggcaaataggccaatggcagtgcccagaacaatcagcgaattacgccagaaatggtatttaaaatgtttgtatgctgttcgataagccacgctggcagggagcagtttagatttcaaacgggggctgtcgtttagtggataaggcttatgtaacgtagaatcagcgttaattttgccgtcttccaaatgaacgattcgactgccagcatttgcaactgactgcgagtgggttacagcaataactaagcggccttcacgagcgatgctatccagtatttccagcacttccttggtattttgcgaatccaaagcacccgtgggttcatcggcaataatgacctttggatcactggccagtgcccgtgcaatggccacccgttgcttttgaccgccagaaagttgattggggtactttttggcttggtctgccaaaccgacccgtttcagtagggatagtgctcgtttttcgcgttcagcatggtttaaagtcgtcatatctaacgggattagcacattatctaaaacggacaggtggctgataaggttataggcttgataaatatagccgatggtatcccgacggtaggtatccatcgccttttcatttttatggtccagccgtttaccagccacggtcacgctgccctgaaattcgcggtccaagccaccgatgatgttcatcagcgttgacttaccgccaccagattcacctaagatggaaacaaattcgccaagattgaagtctaaatcgattccttttaagactgggaattcttcttttcccagataataggacttatgaatgtcccttaattctaaataactcacgttgtggttgtcctcctgtaataatttaagtgtctctaccataaaggaaatgtaagattggcacatcgttcgaagggacagtgaatttttgcccaaaagggaagacgtggtataacagatgttatgcaaaaatttgaaaatagattatttcacagtattaaaaggaatttagtaatttttgcacaaataaggtaaactaaaagtaatgaatttaacaagtgggggtgttcaaatgtcgatctcaaaaaaatcaatgatctggactagtattgtgattgctcttttcctggtctgcctcgtttatcctggacaagtttttggtgcgatcggtaagttgatttcagtgcttaatccgctgattttaggtggtgtgatggcctatgccgttaatttgctgtcgcgtcaattggaaaagtggctgtggccgcatgccggtcaaaagtgggctcagggttcacgacggccgttggctattttatttgcactactcattattgtgctggtaattgctggggtcatgcgattagtcattccccaattcgttgatgccatcaatagtttttttaagaccttaccaagtaccttgaacgatgtcacccactggctgaatcaaatcgatcaggaccatacgatcagcaaacgcattacagcagctactgccgactttaactggcagtcggttgaaacgaaagcgacaaaatacctcactgctggtgcatccggtctttttagttccaccgtatcaatcttcagcaatatcttcgctggcctgattaattttgtgttatcctttgttttctcgatttatttaatcagcggtaaggagaaaattggcgggtggttaaaccggctaatggatgatttcttgcccgctaagtttgtggcaaagacccgttatgttgtaaaagttacggataaaatgttttctagttttattgctggacaagtattggaaggtttcattcttggcgcgctatgtacccttggcatgatgttattccgattcccggatgccgtttcaattggcgcgttggttggtgtgagtgccttaatcccaatgattggtgcttggatcggtggggtagtcggttttgttctcatcgcagtgacttcgccaattaaggcgattttgtttgtcgtgttcattatcgttttgcagcaggttgaaggtaacctcatttacccaagagtggtgggcgggaccattggcctacctggtattctcgttttaggtgctattactgttggtagtgggctagcaggtatcgttggcatgatgttggcggtaccagttacagcaacgctatatcggctgatgcgaaatgcgacgtttaaaaaagaaggtattttgaaagaataatcgtgatttaaaaatagcgctggagtagtcgaaaagattgctctagcgctatttttatatttcactgcttttatatagccaaatcgcgctacacaactcagatgccggcagtgtaagcaaagtaaaacggtacagtcccacagttcaggactgtaccgttttactttgcttacactctggcatctacccgagttgtttcgcgcactgatttaatcaaagtgtctccaatccttatccaacaggtatctagcaacaaacagacccagtggtaagaaaaggataatcaatgccgctcttgtcagccacaatgcgccattaccaatttcatttaagccaatatagaagataccacgatagatataaaggccaggaatcatgattacgattgaaggaaccgttaaggaaatccgtggataaccattatgccggttaataattgaagccaatagtcccgctaccagcgcaccacaaaaggctgctgctggtgccggaatcgtattgaagtcaaccaattccagtcgtaaggtatttgctacggcaccaatcagtcccgaagtaatcgccattctctgtgagctattaaacatcatggagaaaccatataccccgaagaaactagcggggagccgtaatagtaagatcattagcgggcttaaacccagtgaagcgaaattttctggttggaaattaatgatcagagctaccagccagccgaccagcgttgcaacactggtaatcataatggcgtaactcagtcgttcaagacccgaacgcatatccagttttgataaatccaagaaactagtgatgaacggaaagccaggaatgacaaacagcatggcaccgatatagccagcttcgtggttgccggaaatgggatacatgaattgaagtcctttaaaagctaaaaagtatgtcagttcagcaacaccgacactgacggcgatgccggaaattgtcgttagtttatgtttacccatctcaccgcgaagccagttcccaatgccggcaccaacgaaggtacaaaacatttcaatccagccgccacccagtaaaaaaataaatgatgcacaggcgatggctgctgccagacccttcacgattggtgaatagtgtcctggcgtttgttgaatatcatctaatgtatggtgtaattgacgaatagtaagatgcgagtacttttcctcaaattgtttgacaaaagtttctaagacgtaaagccggtcggtattgacaccggtatttggtaacgccaaaatttgtgagtagctgtgacctgcatcaaagcaggtgtaattaatagaagttaatccaatatctgcagagcaggttaaattcagtacgcgcgcaacggtattcattgcgtcacgaacacgccaagctccagttccacaagagagcatcatgatgccaattcgaccaacaacggatgcccgagccttgacccgcgcatctttgattggcaagttttggtttggagcgaattctttccacggaattgccatatgatgttgttctgatggaacaaaattttctggttgttcttcctcttcagtcacttgattttccctccaaataaatttgcttcccccattatagccttgaatcgttaattttcacaaggctacattcttatggtatcgtagtgataagttaagtttgaaggagcgaatggcatgagtacgacagcaaaagcaaaaattatggcagcaaccaaacagttggtcgtttcacagccatttgataaaataacagtcacaacgatcatggctgtcactggtatgcgccggcagtccttttatgatcattttcgtgataaatacgatgtgctggctgagatttattccactgaggtcaaagcagcggtaaggtattgtggcaattatcaattctggccgcagaccttattggcaatgctgacctacttcgataataaccgtgtcttttatcagcacgtattaaagcttgatgtccaaaacgcgccagaagcggtcattattgagcatttgaaaacgatggtgggacagatttttaccagtcttggcaaaattgaaaaaattagtattgataccagctactgcgaatttcttcaaaaaacgctgggtggtacgctgtttctttcgttaagagactggctctatcatcaagataatattgatttgcaaacagaataccaatatttaaaggcttatttggaagatggtatcaatggctttctgttacgcaccaaacgaatcagtagctatcagaaacggacggagattgcttagtgttggcgttcgttgttgatgaagacaagttcgctatcggttgatcgagcggcgtcatagtgccagtctggatggtcaaatcgagtgatagctgccacatcgtggatattgttttcagctaaataccgtaccatctcgccacgggccattttggctaacgtggcttttacttttagctgaccgttgacttttgagccaaagatgacattgatcattcggtcgtctggttgcagatagggcgtgattgccttggcatattcctgagaggccagatttaaaacgggaccttgctcgaaatgaagcgtctgatacagtttattactccagaattcgtataggtcgtgtgcgtcagcaacttgaattgcagactgcatttcaagtcggtagggaatcacaccgtcaaatgggcgtaagataccgtagaaacctgatagaatacggagatttctttgaacgtaatccagggcgggtgcagtgaagagatctggtgccatgtattgatactgaattccggtgtaagctaaaatggcgggtgtgagctgagcgtccaagttcatttgttgtaaccaattataattttggcgagcaagtttatcgctgcaacgccacatagtatgggcatcttcgtagctcaaagtttgcattttttgaagaacttgacgagtttcttctatatattgtggcaatccttgaacgtcaaagtcgttggtgttaatgaccatttttttagttggggcaataatgattttcatctttatctcctattgaaagatttaaaaggcagcgtgaatggcgctgcttaaagcttaatcgagttataggagagatgcaatattaaataggcttatcaattttttgataaaaaatgaaaaaattggagaaaagccttgcacaatctaattatatgttgtatattgttagacatagaaatttagagataactaattaaataaatttgctcagcactaagaactttttcttagtgacacgacccggacaggagagagacctgactgggtcgttgtttttttggagttttttaattagttgtttcaccttaattgttccttttgatttgaatgttttcgaatccctatggagttgattccccccaatcaactcattctgatgataagtcagagacccccagtaatctgaacgattgctcgtaaagttataccgtttgtataacagataagtttcaggcagtgcagttattagtaaaccagtagttgaactttgttgatgtctccttcaaagtttatatgaacgttaagtcgtgataaagcattgaagaggtaaggatatttcatttctaatttaaaaaagtctactaagtgattagtaggcttttttgttgccattttttagatttcaacgatgttattaaatagaacagataatcatatgtgtctattaaacgaacaaaaaattggtaattatcaaaaaaattcgttttttttgaaattttttatttgtaattgaaactgtttacatttttaaatgtgcaagaaaatgtatccgttttaaagactatcaagctaggctttaactgtcaaaaagtaagcgttataacgttttcacaatatcgttttcataatttttttgtaatatacctgtaatggtatttcggaatccttgatgttatagtctttcagttgcgttagttattgggggtcaataattaacaaacggggacaacaattttattttcataaataatcatttttcatcgtttttatttgttacacgcacgactctctctcgtgtgtacttttggagaatttctaagaaaaagctgatagccgagacactttagaatttaaggagactttcagtttatatgaataatcgtttaatgggtacgttgttaacatttgttgccgtcgttgcaggtttgagttttgctacaccaagtcatgccagtgctaaaatcgttactgacgctgatgccactgaaggcattaagaccgctcaatcgtttggttcagcagccgatggaggcatcgctactggtaaagctagtttgacaccagctgccaagcgttggcaatcaaagaccattacttacaaggtttctagcaaaacaagttattacaaatccgtttggaaatcagccgttaaagtttggaaccgtagcggcgctgtccatttagttgccacttccggtaaggcagatattactttgtctaacagcaattcaccaatgggtaaaaacgattcaaccgttgggatcacttactcttcatactataataataagtctttaaacggtttagctgtgatggctagtgccaagtcttacgtgttcaccaatgtcgctaatcgttttcactattctaaggcggaacggactaatgttgccgaacatgagcttggtcatgctttaggcttagaacataacgttggtaagaagagtgtgatgtattacgccacacgggatcaatcagtagctaaaccagatgttaatggtttacaacatagttatcgataaaatcaacaattaaattagaaatgaaatatccattccggggggaatggatatttttgattttacaaataaccgaagtttacgagtggacttttaaaaagaacacataatgatatatgtcttataagtacacgattttttgactttttttaaaaaaggctaactttttttaaaaaaattatgtgtaaatgaaactgtttccatttttaaatttaaaagggaaggtatccgctctaaaacctatcaagctaggcttcggagccaatcactgaacgttataacattttcacaatctgctttttgagcttctttttgtaacatgactgtaatggtattgtttaaaaataggtgctatagtccatttcgttgcgttggttattgggggtcaataattaacaaacggggacaatgattcaagcttcataagcattatggtttagtaattttatttatgacgtcaacacgactctctctcgtgtgttatatatttggagaatttcttagaaaaagctgattgtcgagacactttagaatttaaggagactttcagtttatatgaataatcgtttaatgggtacattgttgacttttgtcgctgttgttgcaggtttgagttttgctacacctagtcatgccagtgccaaggtggtcactgacgcggatgctacagaagctgttaaaacagcaacatcatttggcactgcaaaagccgatggcggcgcagctactggtaaagcaagtttgacaccagctgctaagcgttggcaatcaaagacaattacctacaaaatcgccagcggatcaagttattacaaatccgtttggaaatcagccgttaaagtttggaaccgtagcggtgtggttaaattagttgcaactactggtaaagcaaatattactttgtcaaacagtaattcaccaatgggtaataatgattcaaccgttgggattacttattcttcatactataacaacaagagtttgaatggcttggctgttatggctagtgctaaatcatacgttttcactaacgttgccaaccgttatcactattcaaagggtgaacggacgaacgttgctgaacatgaacttggccacgctttaggcttagaacataacgttggtaagcacagtgtgatgtattacgctaccagagatcaatccgtatcaaaacctgatgttaatggcttggtacacagttaccgttaagataaaaaaattaaattagaaatgaaatatccattccggggggaatggatattttttatgctttggttcacctaatttcgttcagctgttaaccaggcaaaaattgtgctaagactgtccacaatattagcaagtaactcttctgcttcaaaatcgtttgagacccaggctgacacggatagcgcgatttgattctttaaagggctgtagccaatagtataaccattagggctagctggtgacgaaacaaaagtatcaattagatcagttggtagtctgactgttgagaagaaatcgttaactagttggtttaaaaagggcgaatgaaagaattcgtcagcgtcagggaatgctgctttaccaccatgttgagacatcattgttgccaatccaagcaggtgagaatcaataccgaaaccttgctgaataagattcattcgagcagccaaggcagtcactgcctgattaaataattgtcgcgttgcggcatctcgcgctcctgcagcaaaggcttcgatgaattgtttctcttcgagggtgactgtgctgaccgtttcagctcgtccttgatagaattgacgcatggaagttgattctgaaatatttcgccaactaccagtgatacggtattcggcaagcgcaaggctaatttgagcgaacgcatccgaatctaccttcagatcctgtagttgttcaacgccgaatgcttggacgatttttgaagcaaattctagtccttgagcaacttcagcatttcgacgatcagcttcacttaatgcttctttagtatagtggtccagttgccattcaagtcgctgaaagtggggattacccttactatcccattgatctgccggttggtctaattttgtaacgactgaatttacgagctgtagtgcggtttggacgtcaatctgactgtgttcaaaggcaaaaccgatttgagcgtcagaacttacaataacttgggtagttttatcgaataatcgattttgagagcccagaaggaccgactgtggcgttaaagactgagaggggtctagtaatgtcacagtcagtagactgtcactgatgcgtgttaaattggcttgattgagctcgctgctacttaagcgttgtcgtaattttgctgcatcattacgtggtaatccggtgtaggccccaataaaaaatgtatctggatcggggttattcatcatttgtgtcagagcctcggtaagcgaatgtaaggttgatactcggcctgcatggtcgatcaaccgtatctggtaaacggtttgatgataaataaccgtagcttcaacgttatttacggtatgacgggttttctgcaagtaatcatgcccaacgccaggttgccgttgtgttcgaaagaaggacagataactgctcatatcgattggcttgtcatctgagcctttttcaacgggggccgttccagtgacgtagcttaaatattgatcagcaaagttctgaagcagtttagcagttatggtgagttgatcttgatgaggtagtttgtcgtgagaaatcgtgaagccaaaattagtttttgtttgaacgggttgccgattgctcagataatggcgacgcaagatgggtgataaccaattggcgttagtttcaacccagcgctgatttaaataagactgtaattcaaccgcgtcacttttttgaaaggcatcaatttgctcagctagcttgttttgctctgatactcccagcaatggggtacgccattttttaagactggcaaatgtctgatcaagctttggcaatggcagtttaggcaaaagggttaatctttcagtgatatatttttcggtcatttgggggctccttttttgtgagggcgtgcactgactcttactataggtagaaactatttctaattttgatgcttttggggcatattatgtcatatcagtgcgatttcgtcatggaattaaacttacttcatagccgttaggagatatgggtgttatgctattttcgaggagtgattagaagtggtattaacaactgcagaaaaatatttattattgacggaacgaattgggaaaaagccaatgttacgaacgcgatttaccagccaatcttactttgtgttggctgcatttttagatttggtggctaaacataccattcaattaaaagatggtaatcaggttatatttgataaaacagctaaattaccggattatttatcgatattcgttaagcagttaactgaggctttaactcaagatcgcgatttggagtctgcattaaagccactgactagttgggatattgctaatcagatatatgatggtattggtaacggcttattggcgagtggtcaggtcgaacgggtgatttttcaaaacaacttaaaaccacacgtgatttacgaaccaacagaacaagcacgagtagcaactcggacctggctagttgatagtataagtactaactcaaacgtggctgctctgaatttatttgccatcttacgacaaatggatggtcttaaatgggtagtcactgatgaacagacacgtaccgacctagataagaaagttactcggaactcagattttagattaattcagaaaattacggaagcagccgcggaagtcattacacaaaaacgtttttggctggattcttggttaagttaattattgtaataatatgaaattactatttggtatttttaccatataaaaatgctattttttataaatgtttcaaaaaataaggccttttttgaaaattgttctgtcttaaaagcttgctatacaagcattattctgataaataaaaaaatacttgattggctttttttataagccaccaagtcaaaacacttgactgagacaatcattatcgttatatttatgcgtaagctagacgattccaatacatggatctggtaagggggattactgggtcaaatcagcctggctatggaggagggataaaatttaggctagggaatctagtgaacgttttaatttggcatagttggtatgtatctaggaatttattcgggaagttttgattgattttggaggaagcagttttgaaaaagcagggtggaccccgacacgtgatggttgaacgtgaaggcggcttgatccggtttcacccttacaaaataggagaggattgggttaagtatcagtagtttgttcatgttttaactattgcgacacctaaagctaatttagcggcataagcatcatgaacagttgaattgatggaggcagttgcctaatggggtggctgctttttaatccttttattgcttatagttagcatgacaagtgcatttgtagcggtaagttaatcgttttaccagatggctttggaattcttaaatcgttaatttaaggttagaaattatgccataatcttacttgttaatcataataatgtcgctaaaagcttgttattatcaaaattatgtgatatattatatttgttgttaagaacgaaaaaagttaatttaaatgctcagttctaatattagttaggacacgacccgttctcggaagcttaaggcttgccgaatgaatgggtcttttttgttcttaagattgattctttaattccgggggatttatgaaccagtaggtctggtgagaaaaatgaaaaagcttactacaagtgttgcagatactactccatatttgatgattgcgttgaaatgtcacgaagcattagataaagcatagctggggagctattacgaagtagtatcagcctaaaggtggttggaggccacagttaggtaagaggcggtgtgcgtctggggtgattcatatcgtttatgggtttcttattcttagaacgtatttaaagtacagttgattgtacactctcattaggtgcgtcagtgaataggattcagttgttgtgataactaggttttgacaaaataaaagattcgctttggtatctagcaagatgaccaaagcgaatcttttattttgtcgtaaaaaaaagaccacccgggggagggtgatcttataggagtaggcattttcgtgatggggttcacggaaatataaattttactttggaggagtaaaatgaaaaagctcacttaatatctttactaagatattaggctatggtcataatataatctctaaatgtgaagaaagtgtgaagatgacataacaattatcaaaatgttacgaaaagattaatggttaacaacactaactacatgagattgtgattagtattttacgttaaaagtaattgctacatcaaaatggaaatcaccgtcattgctgatatgtaagcgttcatagtcagctgaattcaacacttgcattatcattaaattcacatttagctatctttgttttttaatcataaaattaattgttacagttatgttacaaggacttttttatgtaatttgaataaatttgattgaaattatgtgtaatagtgatatagtgtaatagaaagatagtacactaataagggagggtccatcatggagtttgacgataaggtgcccatttactaccagattaaaacggttatttatgatcaaattattgctggtcaactagcacctggtgataagttgcctgcaatccgtcaacttgcagtttcattgaccgtcaacgttaataccgttcagcgagctttgcgtgaaatgattgatgaaggtgttgttatttcgcaacgcgggcgaggtaattttgtgacttcgaacgctgaaattgttgaacagctaaaacaagaactgattgaccgctacttgaagcaactctatgatcaacttcatcggttaaatatcagtgatgaacagattgttaatgaagtaacggcatatattgaaaggcagggggatttaaatgacgacaacactgaaagttgaaaatttgaactaccgcaggaatttaaaacggattttagccgatgtttcattgtcattaacgggcaacaaaattgtcggtctactgggtgaaaatggtgctggtaaaaccacgcttatgcgtttgattgctggtgtagctaagaatgccaagggaatcatttctgttaatgataaaactgatctggcaacgcgtaaaagtttaattagctacagtaatccactaggtgggatggccactaacaaacggatcagtgaggtcaaagatttttaccagcaggtttatccggattttgatgaacagaaatataatcaaatgattacatttttgaaactggatgaatcacaacggttatcggctttatcaaaaggcaccggggaaaaattggtaatcagcttaaccttagctcgtcaggcaagtgtttatttacttgatgaaccgtttagcggtatcgacagcatgagtcggaagaagattattaatagcatcattcagtggaagccggccgactcattaatggtgattagcgatcattacgtttctgaaattgcaccgattcttgatgaaatcgtagtggtaaaagataacaccatcgttgttcacaaagctgccgatacaattcgtgaagaaagcggacagagtatcgaagactactacgaaagtttgtacggggaggctgactcgaatgactaagtttacttcattaattcctgcatttctgcgggaccgatttaaatcattgaaccgcattattttattaatgttgattgcaattgttatgactgaagtctatgtgttctttcaagagggcactggtaaccttggtgctagcttgatgagttacaccgttttgtggagttcagtggcatctttcgttgttttcatcagattgtcaatgtttaacgaaaacgtttatcaaaacgattctatccgtttgataccggctagcgatactaaagtttatttgggcagcttatgcacgactgtgattagttttctgtactttatggttgtccaattagttctgcgaatagttacgactttgctagctggtaataatttcaccgatattatgggacaaattttctcagaatccggcttaaactctggtcaaggcattgccattgtcttagtatcgcttggaattgcgatagttgcgatcatgatggtctggacgacaatctccttaattcatttgattatgctgagtattgacgcgtttctacccattggccgtcaaagaatcattcgcggcattttatacatcgtcattagtttagcgattattcgtttgggagccgcgttctttaatatttatggcacactgatgaacggcctttcattaggctggggagctgctttttctatactgggagttttggctttagtggtagtggtagaatccgtagttaacattttactcatgaataagtttgttgaaacagcacaatagttgttcataaacgaaaccggtttatcagttcacttggactggtaagccggtttttacgtgtaggtcgatattaaggtaaatttttccatattcccatatccctttcatgattgtttagtattcttttagaatgaatttttaaatttggggagaaacgctttatgatgactaaaagtcacgttacacgaggaattttgttagccctgcttgcttcaatgatgtggggaatttcgggtactgttctgcagtatatctcacaaaaccagcacatcccagcagcttggtttttgtcggcacgaacgttaggagcgggtatcctgctcatgattattggtacctttacctcgcatggacatatttttaaagttttcaagtcttggcgtttagcagcctcacttttagcctatgcagtttttggtctaagcgcgaacttactgaccttctacatgtcggtccaaacgggaaacgctgcttcggcaacgattttgcagtatcttagcccgttgttcatcgtggtgggtagtctagtatttaaacgtgaagcaccttatcgtagtgatttgattgcgtttgcggtttccatgttaggggttttcttagccattactaaaggtaacgtgtcgcaattagcgattccgctagatgcgttagtgtggggaattggttctggaattaccgcggcgttttacgtgacgttaccgcgaccaatcgtcaaagcgggtggttcaccgattctcatcttaggatgggggacactgatttctggcctgttatttaatttacatcagccgatttgggttcacacaccacccttgacgactaatttagtgctatctatgctgactgttattattttaggtacgattttaccgttttgcctgttgttgatcagtagtaaatatgcgccatcggatgtcattagcattgtagatgccgcacagcccgtagtcacctttattttgagtgtcgtttttctcggattgcagattagctgggtggaagtcctgggttcagcactagtggtgtttgctatctatcttttgcaaagtggccgcgcacgcagtatgcagtccatttcgctagaaaatcatgatgatattgagctggattgatctgtttggttgaggagatccgttgggtaaaattacagcttgcacttttctcattatattgttaaaatactctcataaacacagaagggagtgccatattatgctagtcaatcgtttaagttcaacttcacagcgatttttcttcttctttaaccagcctggctatcaaccagtaagttagagaagatgctattagcatggcacttatcactactggtcagacagctaggcgaaaacgcttgggctgtctggctggttaaaaacaccagcggacatcgtggtccctggtgttttttgttggtctgaccaggtagtgttcacttgagagatgcaatcataaggagggatgaacagtaactattttgctgtaaaaggatgtaaatctttgtaaagtggtgcttctaaactattccgtattcttataagtcttaagtctggtaaaagatatcacaaggttaaagttaggcgttaaattttccgtattagctaatagcttatatgtagtgaattatatgaatttcattaaaaggcttttgggggtaaagccttcccgtataatatgagggacacctcaccttggtgattaaattcaataaggcggaacccctgatgttactcacctataaagtcgaaattaagccgactgaaaaacaagcctggcagattgattgtcatattggtggcagtcgttgggcctacaacctgtttttggatatcaatcggcagcgttatgaacaaggttattactacatgggcgcttatgagttcagtaagtggtttaaccatgaatatcttgaagccaatcctgatgatatgtggatcagggaattatatgccaaatcggttaaacaggcctttatcgatgccgatacagctatgaagcgatttttcaaaaaacaaagtggtttcccccattggcggtcgtttaagcgcggtcagggcagttattactttgttaagaatggtaaaacacaaatcattgcttgcgaacgtcatcgtattaagttacccaagcttggttgggtgcggttgaaagagtttggctacattcctacagactcggaacacttcgttatcaaacaaggccgaattaaattcaaagctggtcggtattacctgacctgtttagtggaacaggctgaattaccaaaactagcattaaccggtgaacctatcggcatcgaccttggtttaaaagaatttgccattttaaatgatggtactttgtatcctaatcagaataaaagtagtcgcgtaagacggatcagaaaacgtctgcgcagactgcaaagaaagttgtcccgtcagtatcacgcactgaaagctagaagacagaaagaagggaaatctgctactgattttaatctagccaaaactcagctgaaagtgcaacgcttgtatcaacgtctaactcgcattcaagctgattatcaaaataagattatcgccgctgtggtgagaaccaaaccgcagtgggtagccttagaagacttgaatgttaagggtatgatgaaaaatcggcatttagctaaagctgtgagttaccaaggtttttataactttagaattaagctagtttctaaatgccaacagttaggcatcccagtacatttaactaaccgttttgaaccaacttccaaattgtgtcaccaatgtggtcataaaaaagttgacttgcaactcaaagaccgggtgtacgaatgtcagaattgtgattataccgaagaccgtgatattaatgcggccctgaatatcagggatactgaaaactttgaattagcctactaaaacaggtttcaaaggatgtaccggtggctagccgggaattaacgcttgtggactatcatatcaactgtattagtgagttttatacgaggcaggatagggagaagcaagaataatctataactttttataagttatcagtagcaggaacaaagatggagaacacagtggtctcacgcgtattcggtcggttaaccaagaaagaatcgctcgaccgatacttagataaagacagtctgttagagaaatcgatggacgcaaaagatttgttactgttaggagttggaaccgtgattggtaccgggatttttattcttcccgggacggtagctgcgttatatagtggtcctggaatcgtcatgtcattcgttttggcagcgttagtctgtgccaccgcagccatgtgttacgcggaattttcttcggcattaccagttgcaggtagcgcttattcgtacggtaatatcgtgtttggcgagtttatcggttgggtgattggctgggcgttgatcctagaatatatgctgtcagttgccgcggtctctaccggttggtcggcttacttggtctcatttttaaagggtattggtatcaacgtccctaaggcaataacgggtagttttgatcccgcccatgggacttactttaacctctttgcaatcctaatcgtattggcgattagtttattgctgacacaaggggtaaaaacttccactcgaatcaataacgttatcgtggttgctaaaattgctattattattctattcgtcatcgtcggcatgttctacgttaagccaagtaactggtcaccatttgcaccctatggctctcacggtattatgcgtggggcgtcgttagtcttctatgcttatcttggtttcgactgtgtgtcagcttctgcagccgaagttaaaaatcctaagaagaatatgccaattgggattattggaactttaattatctgtacgttgctgtacatggctgttgctgcagtcctaacggggatggtttcatacactaaattaaacgttgctgcaccagtatcattcgcccttcagttggtcaaccaaaactgggttgctggaatcatctccattggtgcgttagcggggatgtttaccatgatgttatcaatgatctacagctcatcacggttgatctattccattggccgcgatggtttgctgcctaagggtctgggtaaaatcaatatgaaacaccaagtgccaagtcatagtttattaaccgttacgcttgtcattgcggtgatggggggcttagtatcactggaccggttaacccaattagttaatatcgggacgttgattgccttcactatgatgtcgttgggtgttctgccattacgaaaacggcaggatcttgagaatactgggtttaaagtgccactgtacccatatttgccaattatttctgccggtttgtgtatctggatgctattacagctaccgttagatacgtggatcgtttctggcatctggtttgcgattggcgttgtcatctatgtgacctatggtgtgcgacacagccagcttaatcaaaaagcttaatttgtgaaataaaatggtctacccaacaaattaattttgctgagtaggccatcttttatgctattgatttgtactattactgtcgtaaaccgtgtaagtcgggttattgcctgatttccagtcaaaaccgttcttcgtgttccgctgattttcttgggtattgaagttatctaacgtttctttagataaccccagtgaatttctcagtgaatcagaggtactttggagagtattactagccggtatctggaaggactcagcgttaatgtaagcaccgacgccctttaagctagatttcttaacgtgcttaactgaacctttattgttttcggccaagctgatcatgtcattaaaggccatgttggttttcatgttgctggaaagtaagctcagtaacttttgatacattgaaacgttaccagacttggtcacttttttaacgatttgttgaataacttgttgctgacgctgctggcgaccgtaatcaccattcggatcttcgtagcgcatacgggcaaatgctaaggcctgtttgccatttaaatgggcattaccctttttaaacgacatatgcgtgtgtgaatcgttccatgagaacggtaccttgacgtcgatcccaccgatggcattgaccactttttccagaccgcccatgttaatcaaaacgtagtagttgatgggaacatttaggaggttctcaacggtcttcatagaagttgaagccccgccaacggtgtaagcagcgttaattttttcggtatcatttgtgcccgaaattttaaccaacgtgtcccgagggatactgaccatggttgcttttttggtttttgaattaatagttacgaccatgatggtatccgttcggcccttatctgtacgtcctaaagcacccgtatcagttcccattaataaaatactaacggattttgaattggaaaccttagtcttacttgcgccatgggcagcagaataagttttatcgaggcttgctttggtttgataggccacataggtgccaccagcaccgatcatgataattaatgcgaagagtatccaagtaaagacgcggcgtttcttggaacgcttttttggcgtcaggtgtttaggttcttgatttggcataaatgactccttagttaagtataattagtaagttgagtataaggttaataactatcttttacaaacgtaattattaagaatataggataaaagcactattttgaagtaaaaacactgaaagttaataaaatttaaaagatgtgacccccagaaaatttaatgttgtgattaagtgtaattaattccaacccgctaaccattgcattatactaatcttcgaagaactcagcttagaaaggaattgatcatattgacagtttttagtgcctttagtaatgagcaaatcattgaatttttaaaatcacaagtcacggacggtgaagtttttaccgactcagagactttaaacaagcagtcatttagttcgaagatgactagtgatgatagtgggttagcattggcgtatattgaagctaagtcaaccaaggacatccaaggcgtgatgcgtgccgcccggaagtttcatattccagtcattcctcaagatcagtacacgagtaccgtggttggcgccgatggtctgacagggagtttcgtactttcgactaagcagatgaatcatatcaaggagattagtaaggctgattccttagctgtagtggaaccaggtgttatcaacggcgatttggataaagccgctcgtgagcagggaatgttttatgcgccagatccaggttctaaaccaatctctggtattggcggcaacgtggcgacgaacgctggtggaatgagcacggtgaagtatggtgctactaaggataacgtgctgggattgaaagcagtcttggcggatggccgtgagatcaaacttggcggacgtaccctgaaacaggcttttgggtatgatttaacgcaattatttgtgggttctgaagggacattaggtgttatcacagaagttacggtaaaattaatgccgattccaatcggtcagccaactatgggaattgccttctttgaagacatgaccaagctagctgaagccgttgctgaaatccggatctctggtgtttacccgacgatgcttgaagcgttggataatgcaaccattgaagccttagataaatatgaaggtacccacttcagcgataacagtggcgccatgttaattttcaaagttgataacagtgtgccagaagtggtggataaactaaaagaactgatggctgaacatggtgcgaagaatgccacggttacgacggattctacagaacaggctgctttggaaaaactacggcgtgatatgctgccggcggtctttgcgggtcagaatcacattatggaagatatggcgatgccgttgtctaagctggcaccaatgatggattacattcatgaagtcggtgagcaagaacacctgaagatttacgttgcgggtcatgcgggtgatggtaatgtgcatccaaccatcgtttggccaaaggaagaaacggaaaccccacaggccgtggttgaagcgttgcagctgatgttccataagacgttggaactgggtggcacgatttcgggtgaacacgcggttggcacgttgaagaaccagtggaataacgaagaattaggcgaagatgtggatcaaattcagcatcagatcaaggcgttgtttgatccgatggggctgttgaatccgaagaggaagattaattagagcgtgaggaaaaacgggttgcccccagagagtaaggcgtttcagctgaaaattccggttttgaattttttgctggagcgccttagtcggcagggggcagtttttttcgaacgcgtttagtcaatgtagaagagaggatgctgagaaaaattccccagtgctttccttttactttgactaaacgcgctccacaactctgattccggccatataagaagaagcggtgaatccccaaagtacaggggacccaccgcttcttcttatattctggaatcaacccgagttgttccacgctctctaatttaaatcaaaaccccgttcgtatgatccacttcatgctgaataatctgagcagtgaagtccttaaacgtctgtgtatgcgacttaaaattttgatcttgatacgtcacctcaatatttttgtaccgagttgtcttccgttgaccctccagcgaaaggcagccctcagttgcttcgtaggggtcgcttttcttggtgatttctggattgatcatggggatggataataccccaagctggatggcgatgatgcgtttgttcacgccaatcatattagcggccaagccaacagcccggttagtattggctttcagcgtgtcgactaagtcggtgaccgcttgcgcatccgcttcagtagcacgcgttgcttttctggaaagaaatgcttggttatggttgatttgcttgatcataaaaatgaaactccttcttaaaataagtcgccgataatatcatcagcaatagttggtacacctttggcgagttcagtcacaattttcttagctggacgaattttggtaacagcaccagcaatttgacccgccataaagctgccatgctcaacgtcgccaacgatagctcgttgtaaagaaccgctggataattgttggaagattgttggatcagtcgttgctaacagtttgtcggttaagggtgtttttaaactccgaacgcgatttgcgccggttccagtcacaactgtaccattatcgcttgcttgaattaccaggtgcttgtaactataggcaacgggtgtttcctctgccactaggaaggcagttccgacctgtacgccggcagcgcctaatgcgaaggccgctttgacgccagctttagtagcaattccaccagcggcaatgacgggaatatcaaccgcagcagcgacttgagggaccagtgacatggtggtttcagtcccaatgtggccaccggattctaaaccttccgcaactactgcagcagctccaagatccgccattttcttagcgatttcaacgttgggaatgactggaatcaccgttgtctgaaccttcagcaagtcttcaaaaaacggcgcagggttaccggcactggtgaacactactgggactggatcagccaggagtactggtagcaagtctttgatgttgggttgttgcagcatcaggttcacgccaaagggcttatcagtagcagcacggatagtttttaaatcttcttgaagtgactgagcggttgaatcggcagtggttaacacgcctaaaccaccagcgttgctgaccgcggcaactaaatctggcttggagatgcgtgccattgcgccctgaataatgggatattgaatgtggagtaaattagttaattgcataagttggtccccctttaactaaaaatgagattagtaatcgtcttatcacctaacagaataccatgaaatggctagcttttaattaagtaatagacaaaaaacgatgaatcctgggaatagggttcatcgttttttcattagtcaaacaattattcaaatattatctgccagcaacctgctgttcttcagcaacagtttgctttgcagcttcttcttcacgcatccgcttaagttcacgttgcttgccaagttctgccaaatgaacttcgtgagtcaagaaagcatgggttttagcattgtagttgtgcttttgtcccaacttaaccaagtagccgttgatgtagtcaacttcagttggtcggtagttatgcatatcttgatacattgaagggtagtggagtggattagcaacctttgaaacgtagttgatgctgtccaactcttgcttacgggtatttagcatctggacaccatcacgttcacaaacatcgtaagcttcgtcaatgagttgttggctcatttcatcagcgccatcataatcagcatattcgcccatggtcatttcaaacatggtgcaaagggtgttaacaactgagttgaaaaccactttggccattagcgtaccacggaagttcgtcgtcaaatttggattgaactgtgctttttcgagctgttcaactagcttgtgagtgaagtcgtcaggtttttcagtgtagttagcaaggttcattgaaccagcgccacgcttaccgataaaatcaacatcgccagggccattcaaaacggtggcaactagggcggtcccagcaaccagcttttctggcttgaagtacttcaacagcttttcaacgtggcccatcccgttcatgcaggtgaaggcgtattggttaggcttgaagaaatgttcgcaacgcttgagcatatctgatagttgcatttgcttgaggaagaagatgtagcaatctgggttgccatcatattcttcgggatagtaaacgttcactggcactagatgcttatctttatgatctcgcgaaacgtaaacgccaccttgttcgcgcatcttttctacattgggcttccagccatcaacaaagtcaacttcattaccagcatcctgtagcaaaacaccataacgtaaacccattgcacctgaaccaacaactgtgaatttcatatgtattacccctttaaataagtatttactttgaagcaaaaaagcccttcaagccatttctgacttaaagggcacgagtgcgttaccacctttatgttttctatttgtcaccaaatagaacttacaatctgcaaacacagatccaagttgatatcggagattgactccgcctttgaatactagttaccgttcatcaaagatgcatggaggtgatttgctggtacgatttgtccgcttacaccaaaccgaactcgctgaaggtgtaccaacgctgtcctcgttaacgcatttgcttatcaagttgaccttataataacacttaaatgtgagatgtcaaatctaattttaatctttgtctaatcatattggtgatgactattggtcagttgctggtgttaattctggctgctatgtgctacgcttaattgggtaagattaatttgactaatagcaactaacaaccatgatttttaagaggatgaagcttatgacaaataatgttgaaacgttaacaatcccaattattaagcatcaaaagggttataagtttgcaaaaattattgatcaaaatgaaccgtctgaagtttcttttgccaaacgattaagtgatgttcaaaatgtcgacctagacggtacttttagaatgccatacgacgacagcgagattttcgtggctcatgatagaaagcgggcgacaagtgtttccattgattttgacgctggttccggtttctctgctgactttttcccagatcaagttaatttatctacggggtcgtatgaaaacctccgtaatttcacacttcgtgatggtgatgtgcttaaaactaaagcgggtaagagcgagtatgtttttatttacagcggtgctaagtttgaagcctttcagcggacgaagagagagctttaccattttattctccgcaagaatggtgtttatgatttttccagaatgaggatcgtaaaaaacaagctcaagtttgaaacgttaaagtacaatgcgattaaagaaaagaaactgtcaacgggtctgactaaaaatgaagatgcgttacaggtattgaagaagttattcgctcaagttattgcgcttactaaagagagcgtccggggacggtttgtaaccgctggacgcgctaaactcgttaaaaaaggaatcaaggttgaactggttgataatgagactgtagaacaaaaaagtaaaagccaatcagcctagttttttatgattttgaaagatgaaataaatacgcattatcccggacaattgccccggaataatgcgtatttgtgtacttattacaaattacagtcttaaaaacttaccagtatcactcatgtttttcaaaaatgcaggcaccgtctccgttcggttccaatcccgttgcagttcacaggctaactgtgcataggaagttgggtgtgcaccggcctgttcgattcgacgtaacgctgcttcgtgagctgccaaactggtaccgccaacggcatcaaccacaggataaacgtcgtagccttcgtcaatggcgtcaattgcaggaaaggtcaggcaagcttcggtccacagcgctgccataatgatgttatgacgattcgttgacgtgatggcttcgttgaactccttgtcttcccaagcgttgatggtggttcggtcatacgatgggatgtcgcctaagatctcttttagtcctgcaatcgtatcttgattacggccggtacccacgtttaccgttgacagaataatgggcacttgaaagtcctgaagcagtttggtggtggcaataatgttttgaactagctgataacggttcattgattcaatggattgaatctgagtgggttgatagtcaataatagcaaaaacactgttttcgggtgccaacaaacggtcagtcttgggatctcttggcgcgtagcttgtcatacgtaatcattcctctcctcttaattacgcacattataatcagggaaatagttgattcaaagtatcttaacttatttcagacattttaatttgagtgtcaaaaaaacacacctagatgattgtcagccagatgtgttttggaagaagactatttaaaaagcgcatataacaaaatcggtataaacggcgccaataataagttagcaactttaatctgagttaatttcaacatgtttaaaccgatgattaaaatcaatagcgagcccacacaggtcatttcgttgatgacggtgtgggtaaacagcggtgctacccactgtgccagcaacgttaaaacagattcgtagattaccactgagattgaggagaaggcgacacccagaccaagggttgtggctaagattaagacgaagatcccatcaatcattgattttgtgtacagcactgaattattgccagacattccgctctgcaaagaaccaacgattgccatggcacccacgcagataaacagggtccccgtcacaaagccctcggagaaatgattatcaccttgtagccccatcactttttctaaccaatcaccgaagcgattaaactgatgatcaaagttaatgagttcaccaataatggcaccgatgaccatcgatagcacgacgaaaacggtattatttcccttcaatgagccgctaataccaacgtaaacgacgcagatacctaaactctgtatcactaaagttttgacgcgttctgagattccttttttaaaggccaggccgataccgccacctaaggcaacggctaggccgtttgctaacgcaccgaataacatcatgtcaatttccccttaagattaaaaaataatgaatatgtacatttttctatcataaatgttttgtaagtggctggcaagcgtcttttcaataggcaatgcagaattttaagcgcacttttctatgactgcattcgggattttgttacactcaatttatagatgttaccggtagatgccacttgatctgaaattggagggaactatatgacacagtatccgaagacccaagaccaactcaatcaactgattgctgatctcagccagctgcatactaatattcagcagacccattggtacatgcgcggttcagaattttacaagttacacccgctaatggatgattataacgatacgctggatgaacagctggatgcggtagctgagcgcctgattgctatcggcggtagcccaattgctaccacccatgaatttattgatcagactggattgccagacgagaagatcacgtttgatcaactatcgctgcctcaactgatggaacgcttggatgatcaacttaaatacctacgtgaccagtatcagaaaggcatcgagatcacggatgatgagcgggattactccactcaagatatgttgattgcaaaccatactgaaattgaaaaattgatctggatggtttcagcctatttaggtaagggacccttagattaaaacgcggagcgccgagatgatgcaaatcattgcggcgctttttaagtgctgaaacgtcagtgtaaaaatgatacgctataaacaaaaaagtagggggtgtcagtatgacgatgctcgatcaatttcagctaaatggcgattcagctttacgcgcaccgatggcacactatattgcctcacatgacttaagccgactggcaatcagcgagggcagtaagtatctgacagctaattagaaatcaggttagctaaggataatgatgactggtcaaaattctaattgaaatataaccgccatccatttaaatcagtgctatccttagttcgtggaaaggactgacttaaattgcctgaaagtgcaatcgcaacaaaggcgccagtggtaccaatggataattggcagaaactggcacgtcaatatgggttaactactcttccagacagctggagagaagcaagtgaaagccttcgtcatcaaaagaatattggttatttggagaccttcaatgatttgaaggaaatttattacacgttgattggtaatgaattcttgcaagacattgtttgctatcatccagagcaggttcatacttactggttaaaagatttagaacagtacgtttttattactgaataggccattaaaaatagcgctcagttggcaaattgccaaccgagcgcttttaatttacagactataaatgccaaagccattgtgccaatcccataaagagcgggatggtgattagtgaacaaagggtggtaagtccgaccacagtggtgctaaaaagggaatttttatgaaaggtattgctgaagattgccattaaagcggcaaccggtgtggcttggccaaggagtacgacttctttaaccatcatgaattgattgggaacgaattgcaaaatcactaggacaatcaatggtgcgatgatcagtcgagcgccaatagcctgatataatgccttgcttttgagggcaccgcgaacgtcaccttctgcaaggtagcagcccatggcaatcataaccagtggcaggttcatgttggctagatcagagaccgtagtgccaagaatgtttggtagtttgacaccggtaagagcaaataataggccaaaaatgagggctaagattgccggattgaccgcaagccgtttaagctgaatcgtgcgtttatcaccggaaatcatgtaaatgccgtacgtccacagtgcaaagttggaaacgcctacgaagatactcatgtagaagatgctgccagttcccagcacagccttagagagcggcaaaccgatgaatcctaggttggcaaaaataagtgcgaagcgaatgagcatttgctccggctttctgaaaatcagtttagcaatcacgatggtgactagcatcatgatcactagaatgattaacgtatacaagccatcaatcatttgcgaggttttcaggttaccaataaaagaattcagcaataatgctgggttagatatgtaaatcacgatgttagaaatttgctgactgcctgattcgtcgactagaccaactctaaaacagagaaagccaaccaacatcatcaggaacataattgcagtctggccaaagatgacccttactattgtcacggcagttccttctttcaattgcaaataactttcattatagaacttaatgtgaaaataagtaagtggtgatgcccgtatcaaagcgtattcattaagaattgatcagatagatggcgacaattgctaacacgacaccaatcaagtttctgagggtcaaactttcctgcagaaaaagcagaccgattggaatcaataacaaggtaagactaatgtttaccgtcattggggtggaaccgattggtgcaccagatttgtaggatagcatgtaaccaaattccacaaagatgattgagagccccattgtgatggaagtccagttcagttggtgcaaattaaagctgattgattggtgattgccactgatcaagtaaagcagcagtgaccccagtaaggcagtactataggtaataatcagcgaaaaaaacgggtcaacggtgtgagaaacaccgcgggctgatagttgatagagtagattggcaaagatggttaaaataagtggccaaaggtaggtaggcatactttttctcctttaatgaaatttcagttcttattataccttaatcaagtaacggtcaggtaaatgtcagaattgccgttcagttgagctgattgcaatagtatatatcgggataagagagataaatgacgttttgataaattaatttatcagtaaaattttagtaaaagagactgttataaaaaatcaaaatcatttatgatagtcttgtaagcgcttcatatcataaagtgttttagcattaggagggattcattgatgaaaccagaattaggctggttggatgatccacagacgtttcgggtcaaccagttgccagctcatagtgaccaccgcttttatcagagtgatactgatttagcgactggtcagagtcgattcacacagtcgcttgatgggacttggcagtttaagtttgctaaacagcccagcgaacggccagttggtttttatgagcctgattatgaccgtagcgatttcgatacgatcacggtaccagagcacattgagattgcaggctatggccgactgaagtatatcaatacgacttatccatgggaaggtaagatttaccgtcgtccggcctacgctttaggtcaagaccaaaagggtgatggtatgttcagtgatggtgaggacaattacgtcggtgcctatctgagaacctttacgctgaacccagaactgcgtaaacagcaacgagtagtcgttcagtttgacggtgtcgaacaagcgatgtatctgtggctcaacggccagttcgtgggttatgccgaagacagtttttcccagtcagagtttgacttaacaccgtatttgagagacggcgaaaacctgatcgcggttgaagtcttcaaacgcagtacagcggcttttattgaagatcaggacatgttccgcttttcgggtatctttcggagcgttcggttagttggccaaccagcgattcacgtacaagatatgcggatcattggtaatttagcagatgacatgaccaccggtgactttagcctgaagttgcaactgaatcggcatgacaacgccaatggcaatgtcaaagtagccattacggatgctgacggcaacagcctgtttgacactactgaagcagttaacgatgacgttgaaatcagtcataaaatgtttaagaacgtgcatctctggcagcatactgatccgtatttgtatcagttaaaagtgactgttttggatgaacagggtgccgtggttgaaatcgtcccttatcaattcggtttcagacgggttgaaatgaagaataagattatgctgctgaacggcaagcggatcattttgaacggtgttaaccgtcacgaatgggacgctaaatcaggtcgtgtgatctccattgacgatatgaagcaggacctgaagacttttaaggaaaacaatattaacgccgtccggacttgccactatcctaaccgcatcgagtggtactacctatgtgataaagccggtatttacatgatggcagaaaacaacttggaatcacacgggacttggcaaaagatgggcgcggttgagccgtcgtacaacgtaccgggttcgttgccagaatggcgcgaagctgttgtagaccgggctcgcagtaactacgaagtctttaagaaccacacggccattttattctggtcactaggtaacgaatcctatgccggcgatgatattgcagccatgaatgtcttttataaggaccatgatgatacgcgtctggttcactatgaaggagtttgccgcaaccggaagtatgaagatcagatttccgacatggaaagtatgatgtacgatccgccaaaggaaattgcgaagtatctagataatgatccgaagaagccattcgttgattgtgagttcatgcatgatatggggaattcgctgggcggtatgtcgtcttatgatgcgttgatcgacaaatatccaatgtatcagggtggtttcatttgggactttattgaccaagcgattgaaaccaaagacgaagtgacaggacagacggttctgcggtacggcggcgattttgacgatcgtcattccgactacgaattttctggtgacggtctcatgttcgctgaccggacgccaaaaccagctcttcaggaggtgaagtattattatggcaaacacatcaactaaacaagttcaaattatttatggtgacgcaacgttaggcctgcgtggtgaaggtttcggttacatcttcagttacgaacgcggtggcatggagtcgctggtgcagcatggaaaagaatggttgtaccggactccaaaaccaactttctggcgggcaaccactgataatgaccgcggtaacggcttctcagttaaatcagctcagtggttaggcacggatatgttcttaaagtgcacgaaggttgatgtagcagtcaacggcaatgcgattgaactgccaatttcgcctgaaaataacaagtacagcaaccatgaatttgctgacaatgtgacaattacctttacgtatgaaaccttgacggtacccgcaacgacggtgactgccgcttatacggtaaacggcaccggtgaaattaaagtgagtgtcgattatcacggaaaggctgggttacctgagttgccggcattcggtttgcgcttcatcatgccaacggctgctaaagggtttaactacgatggtttgtcgggtgaaacttatcccgatcgaatggctggcggcgagactggtcactataccgttgatggtttaccggtgaccaagtatttagtgccacaagaatgcgggatgcatatgcaaacgaagcaagtcactgtgattcgcaaccgtaccttagacaatactgaccatgacaatcatgattttaacctgacctttttgcaggcagggcaatcgtttgcgttcagttgtttgccatacaccgctgaagagttggaaaatgccactcacattgaagaattaccagctccaagacggacagttctgaccgtttttggtgctgttcgaggtgttggcggcattgacagctggggtgctgacgtcgaacagcagtaccatatttcggctgaagaggaccattcgttctcgtttgccattaagggcgtttaacttagaaaattaatttatcaaaatgtttactattttgtatacattaaccgttataatagaaagtgttgagaaggaggcattttatcaggatgaagaatgtagcattaggcaacacgaatttacaagcttctgccgttgcgttaggtattatgcggatggtcagccttaacgttgatgacgccgcaaaagtattggacactgttactgacaaaggtgttaactttattgactccgctgatatttatggtggtggcaagtccgaagagattttcgggcaagccttgaagcagtcaggtgttaagcgtgaagatctgattattcagtcaaagggtggcatcgtccttgatcctaaacggagtcatggtgacttagtctttggtcaacggtacgatttctccaaacaacatttgattgaggctgttgacggtattttgaaacggatgggaattgactatctggacttcttcttactgcaccgaccagatgcactgatggaacctgaccagattgcggctgcctttgatgagctgcaagcagcgggtaaagttcgtcattttggactgtcgaactgcaatccaatgcaggttgaactgatccaatcagccatcagtcaaaagctaatggtcaaccaactccaatttggcgtcatgcataccggtccgattgatttcggtcttcacgtgaacatgagcgatgatcgcagcgttaaccatgatggtgaaatcattgaatattcaagacttcataacatgacgattcaagcttggtcaccgtaccaatacgggatgtttgaagggccatttattgacaaccctaagttcccagagttaaacaaaaagctgcaggaactcgctgacgcaaagggcgtgacgaaaaatgccatcgccactgcttggattttacgtcatccagcaaacatgcaggtgattttaggttcaatgaaccaagatcatctcaaagagagtattgccggtgctgatgtcgaattgacgaagcaggaatggtacgacgtttactttgctgctggcaacacgttaccataagctaataaataattaaaagaaaaaggggcattagccaatctacctgcatttggaagatgactaatgcccttttattttggtattgtgtccgttgtagcttttttgacctagttaccataacaaattaagtatatttttatgataattttggaatatttaatatccgaaaaaaggcttacattgcactagcagccttaaaaattggttgttagttgcaaacagatattaaattttgtaccattaattgtaaagaacaatattttaagtaaatttactccaaatatcgtcgaattaatgatacaataacttcattaaatgcgatattcacgcgtttaattggggtcaagagttttgaaagagttgactaggattattgggcttatataatttttatgtgaagcatttatcattttaaagtaataaatctttttggttgcttattttccttagatatcattagcatatttggcatcaaatttgttaattggggggatattctaatattagattagtaagcaaaattagaatatttgaaggatggcgtaaagaaatgagcaaaagaattgacttgaccaaccagcgatttggtcggttggttgtgattaaatattacggtaataactctgcaaactccaatgcaatgtggttatgccaatgtgattgcggcaataaaacggttgttgacggtgtccgtctacgttctggaattactaagagctgcggctgcttaagacgtgacctttccagcaagcgggtctacaagaaccccaagttcgtcgactacatggggcggtctgatcaactacgcgataagaacggtgtgtcactgagttcaatctcagagtcagctcgtaataagagtggcgttattggtgtttcttatgaccgtcaaacaggcaagtggtttgcccgattaatgatcgaccacaagtacgttctgctaaaaagttttaagaccatcactgaagcaatcgaagctcgccgtgaagctgaggaaacctatctgggtattaaacggaacgataaaaccaaagaaattgaaaaagtttaacgtataaaaggataagttagcgattgactaatttgtcacaaacaccgttgatagcaatctgctgttgacggtgttttttggttgctcatcaaagcgtattaaatgacggatatttaacctgttgcttgacttataccccactctaacttctataattaaactgaactaagaaatcaatcgtgtgatggaggtaagctgatcatgaattatcgaacgttaggtaaaactggttttaatataagtgatatttctttggggacttggcaacttggtggtaaatggggcgcaccatttgatattaaggatgccactgcgacgttggaagaagcctatgagcagggcgttaacttctttgatactgctgatggttatcaagatggtaacagtgaaaaggcagtcggtgcgtttgttaagactcacccagacgttcatttcacaactaagattggacgtaaagaaatgccattatccactgagcattttaatccagaacatttaacacgttacgttgatgaatcactgaagaacatgggcttagaagcacttgatctggtattgcttcattgcccaccaatgtcgatttactatacacctgagaccttcttcaccatggacaagttgaagaaggaaggtaagatcaagaactatggcgtgagcgtggaacgtgtggaagaagccattaaagcgatggattatgacgtttcggcagttgaaattatctttaacatgttccggcttcgcccatcaagattattctttgatctcgccaagaaaaataacgtgggtattttagctcgtgtgcctttagcaagtggtttgctgacaggcaagttcacggctgacactcagtttggcaaagacgatcaccggacgacgaaccgtcatggcgaactgtttgataagggtgaaactttctccggagttgattatttgactggagttaaagcagcgcaggagttgaaacagcgtctgggtacggataacttggccgctacggcactgcggtatattctgatgtttgatgcagtgacagcagcgattcctggagccagcacaccggatcaaattgaacgcaacacggtggcttctgatctcccagcattaaagccggagcaaatgcaaatcgtacaggatgtgtatgatcaatacattaagaacccggttgattacctctggtaaacggcaaaaaaataattatgtttcaatcaaagcctgatgaacgaccaataaagtcgaagattcaggcttttttgacgtacggtacagagattaaacgaaatcggggaatagttaccacgtattatcacgttacattagtgctataatttagtcataaatagatgagaaagaaatggagaggtattaatggaatttacggagcggcagaaaactattattcaaatgctgaaggcaaaaagtccattaacgggtgaagaaatcgcaaagcaactaaagttgagtgttcccaccattcgtggggatctgcggctgcttacagcagttgaggtactgacggctcggcccaaagtgggctatgtctatcatggaaatggtcaagctggtgttgactacgcagccttatacgacaagccaatttcggcaatcatgcagccggccccgacaatcaaggatgatgctacactgcaagaagcaatcagtaaactattcttgcaagacgttggcacgttgtttgtagtggatccaaagggtcagctggttggactgatttcacgaaaagatttactgcgcgccagctttaacaactctaaaccagaatcggtacttgccagcattatcatgacaaggatgccaaatattgtgactgtgacggctgatatgaccgttaaacaagctggtcagttgctcttgaaacacaagatcgattcggcaccagtggtggataaagcagcaccgcaacgggtaactggtaaaatcactaagaaccgtatttttcagcattttattgaacaagcttaatcttatctatgccatcacaactaagtggtggtatttttttgccttttttagaaaagaaaataggcatactttttcaatttatatctaactatgacgttattaaaataatatttcataatattcttaattaaatgaagcatgatgtaaaattttcaaatgctggtatatcagtacttttagcgcttttacgattaaagtgcttgaaatttaaattagtttaatatacattataaatcgagcaaatatgacgttttattaacgagaaagagtggttatatgacaaaactgatctatgaattttcggaaggtaacatgtcaatgcgcgatttactgggcggaaaaggtgccaatttagccgaaatgactaacttggggctgccagttccccatggttttaccttgaccacggtagcctgccatgagtaccagcaaacgcagtcgctaagtgatgaagtattgcagcagcttgatcaggcactcactcagctgagtcgagtcaccggaaaacagtttaacggtactgatcaaccgctgctggtttccgttcgatcaggggcggccatttccatgccaggaatgatggatacgattttaaacattggtttaaacgaccaaacagtagttgctttagcaaacttaacgcacaatgaacgatttgctttcgacagttatcggcgattgttagcgatgtttggcaacgttgtatacggtatcgaagaagatacgtttgataacgtgttgactaaagttaaacgcgttaacggctatcaaagtgatttggaattaacggcggccgatcttaagcaaatcgttacggacttcaaagccatttatcagcaggctggtaaaggtgcatttccacagtcacctaaagatcagttattagccgctgttaacgcggtatttgaatcttggaataatcaccgggcccaagtttatcgtcagcaaaaccatattccggaatcgctaggcacggctgtaaacgttcaggaaatggttttcggcaatgccggagaccaatcagggactggggtggcttttacccgaaacccagcaactggggagaaaaaagtttttggcgaatatttgctcaatgcgcaaggagaagacgtggttgcgggcatccggacaccgcagtcgattgaggtgctacacgacgacatgccggctatctatgatcagttgatgacgattgccgaaaaactagagacccattaccgcgatatgcaggatctggaatttaccattgaaaacggtgagttgtttttactgcaagctcgtgatggtaaacggacgccatacgcagcggtgaaaattgcagtggatttggtaggtgaaggattaatcaacaaaaagcaggcggttcagcgtgttagtccagaatccgtttcagcgatgctgcatccggaatttgatggtgacgtgcttgctcagcagacaccgctgacgacgggattgcccgcatcaccaggcgctgccactggtcaggtttacttcactgccgaagacgctaaaaaggcagcagacagtggtataaaagtcgttttaattcggcaagatacctcgccagaagacatcgatggcatgattgtcagccaagccatcgtgacttctcgagggggcatgacgtctcacgctgccgtggtcgcgcggggtatgggtgccaccggggtcgttggtgcccatgagatcaacgtggattatgccgccaaagttgccaagattgggtcgcaggaaatccatgagggcgactgggtttcagttgacgggacttccggtaacttgtatttaggccaaattgggaccacttcagccggtgtgaaaggtgaactctctgttctgttagattgggcaaaggacatcgctcagatgggtgtctacactaacgcagatacgccgcaggatttccaaaaagcactggactttggtgcggacggcattggcttaaccagaactgagcacatgttttttaagccggaacgattggttcaaatgcggcggctgattttagctgaggatgctgcgggtcgggcagaccccctggaacagttgttacaaatgcagcaggaagatttctaccaactgtacaaattagcgggcgataaagaagttacgattcggttgttggatccgccactacatgaatttttaccccacgatgaagaggaaattcaggcggtttcaaagcaaattcatttggcaccagagaaattgcgggaacgaaccaattcattgaaagagttaaacccaatgcttggtcatcgtggtgatcggttggccgtgacgttcccagacatttaccagatgcaagttaaggcaattcttagcgcagtgattcgtcatcatgatgaggggcttgaagtgcacccgcatatcatgattccgctaacggattcgaagagtgaaatggcctgggttcgcgagctggtcgtcaaccaaatcgatacgatgatggctgatttaaactggcagcttgactacacggtggggacgatgatggaaatgcctcgtgcctgcgttactgctgaccaagttgctgaggagtctgatttctttagttttggaactaatgatttgacccagctgacctttggctattcccgtgatgatgtgggttctttcatgcccgaatacattaaacaggggatcttgccagcagacccatttcagaccattgatacagagggggttggtgctttaatggaaatcgccattaataagggacgtcaaacgaaacctgatttaccaatcggggtttgtggtgaggttggtggtgatccagcatcgattaacttctttaaccaaattggcattacctatgtctcatgttcaccttaccgagtgccagtagcacggctggcagcggcacaagcaacactaaaacaggacgcatagcggtgacttatcgggtgtaagcccgattgaaattatttattattactaacattgaaactgcttaccgaatgctttaaggggatttattaaaataactagcgtggtggtacaggcgttccccacgtggtattaagggagtattaacatgcaagaaaagaaagagtcagtcttaacttcgcggctgtcgtatgcctttggtgcttttggacacgacatgttttacgcaacgttatcaacttactttatcatgtttgtcacctctcacttgtttgataagagtagtggtggcatgaacgcaaaaatgatcagttacatcacactgattattttcattcttcgatttgtggaattggcgattgacccgtttatcggtaatactatcgataacaccacgactcggtggggtaattttaaaccgtggatcgtcggtggtggtttcattagtgctgtgatcatcgcacttttgtttaccaatatgggtggtctcaatacgtcaaatccatatctgtacctgattgtttttgcggttctgtacatcacgatggacatcttttattctttcaaagatgttggcttttggtcaatgattccagcgctctcatttgattcccgcgaacgtgaaaaaacagcgacgttcgcacgtgttggctcaaatattggtgccaacattgtgggtgtcatggtgatgccaattgtgttgatgttctcgcaagtctctaacaatggccagggggataaccgtggctggtttgcctttgctgcagtggtggcttcgatttcgtttctttccgcggttgttgtcggtttaggaactaaggaaaagaattctgaattacggaagaataaggaaaaaacaaccttccgtggtgtgttaaaagtgttaacccgaaacgatcagttgatgtggttatcgttaacctatggcctatatacggcgggcatgcaaattactaacgcattggaactctactactttacttacatcttaggcgatgcgtcgaaatttagtattctggcgtccattaacgcgattattggtgtgtttgctgtgattgccttcccgccaatggcgaagaagtttagccggcgtaacgttttcttcatttcaattgcagtgatgattattgcgttagtgctcttcttagttgccggaagttcattaccaatggtgattgcagccgcagtgctgttctacatcccgcaaccattgattttcttagtcgtcttgatgatcatcaccgactcggttgaatatggtcaattgaagtttggtcatcgggatgaatctctaacgttgtcagttcgcccattgttagataaaatgggcggtgccatttcaaacggggtcgttgggttaacagccgtttgggctggcatgacggctggtgcctcggcttcagacatcaccgcacacggccacatggtctttaagctcatgatgtttggcttcccagctgcactgattttgattggcacgtttatcttctttagaaaagtcactttggatgaaaaagaacacgcagaaattgttgaagaactggaaaagacttggggtaagacgctaggtgaagacgtggactttatcgatgccaatggggatgtgagctatacttatccagcaccaattgatggtgagattgaaccattgagtgctgtagcggatgaaaattttgcgtccggaaaaatggggcaaggtttcgccatcaaaccaatggatggccgaatttacgcgccgtttagtggtacggtgaaggtaaccttcccaacgagacacgcgattgggctggtatcggatcaaggcatcgcaaccttaattcatattggtattggcacggtcaatatgcgaggcactgggttcatacaatatgtcgaacaggatcagaaggtggaaaagggtgacttattgattgaattttggcaaccagcgattaaaaaggcgggctatgatgacacggtaatcgtggtagtgacggataagcaggcccaggttgagttgcaaacccaaagtggtaaagttgaacatggggatgaagtggcaaaggtaaagagtgtgaaccaaggcgcttagagaccggagtgtaagggactagggccataaaccctggtctttggggtttgtggccctagtcccttacatgcaggtctctgccttggagaacacatttaggctagagaaaaggaaagcacataaaccctggcctttggggtttgtggccctcttcccccttacatgcaggtctctgccttggagaacacatttaggctagagaaaaggaaagcacataaaccctggcctttggggtttgtggccctagtccccttacatgcaggtctctgccttggagaacacgtttagaaaaagagtgagactcagggcgcttagaaatcggagtgtaagggggcagtgacgtaaaccccggtcttgggtttatgtcattgactccttacatgcagatttctgccctgaagaacacgtttaggctagagaaaataaaaacgtctatcataaatttacttggcgctcaatcccagttgaaccaccataaattacacccgaaaggagtaaaaacattggcaattcacgttgacgaaaccaacaaaacatttcatttacaaacggatcatacgagctatattttccaagtgctgtcccacggtattttaggccaggtatactatggaaagaaaattcacgttaaaccgcagtatcctgagttgttacagcgggaaatgaaaacggatacaccggcttactcactagacgagcctactttccaaattggggatctgaaacaggaatattcggatacggggactggtgattttcgtcggccagcctaccgagtcttgcaggctaacgggagtcgcattactgattttaagtatgatcattatgaagttgttcaggggaagaaacggttaacggggatgccatcaacctttgatgacacggatgatggtgctgagacgctgatcatccacctgactgaccagttgattcaactggatcttgagttaagttataccgtttttccacatcaggatgtgattgtccgaagtgctaacttcaagaatcacggcgttgaaccagtgaccttggaagctgctctaagtgcacagctggatctgccagataaacactacgatttgattcagttctcaggtacctgggcgcgtgaacgacacttgattcggacaccattacggtctggacttcaggcgattgactcagtgcggacaacgtctagtccacagcaaaatccgtttatgatgctggctcggcctaacaccacggatgatgacggcgaggctttcggttttaatctggtttattctggtgattttctagatcaaattgaagttgatcaatgggatgttagccgagtgcttgtgggcatcaatccatcgaaatttgaatggcagctgacacctgataaggaattccaaacacccgaagctattttaagctacacggctgatgggatgaatcagctgagtcaacagttggcggacttctatggcaaacacttggttaataccaagtaccggcggatggaacggccaattttagtgaataactgggaagccacctacttcgattttaacgatgaaaaattactgaacattgctaaacaagctaagcatcttggaattgaaatgtttgtgctggatgatggctggtttggtcatcgaaatgatgatcacacgtcgttaggcgattggttcgttgatccgaagaagttgccaaatggcattggtgcttttgccgatgaagtgcacgatctgggattgaagtttggcctttggttcgaaccagaaatgatttcaattgatagtgaactctatcaaaaacatccagagtggctgatccacgtgccaaagcgccggaaaacgcccggtcgtaatcaatatgtactggattttagccgttcggaagttgtggattatatttacaatatgatgagtcaagtcattcaggataccaagctggattacattaagtgggacatgaaccgttacatcacggagatgttcagtgcagctttaccagcagatcggcagttagagatgccacaccgctatattcttggtgtttataacctctatgcgcgattaaccgaaacttatcccgatgtgctgtttgagtcctgtgcttcgggcggtggccgtttcgatttgggcatgatgtattacgcaccacaggcttggaccagcgacgatacggacgcagtggaacggatgaagattcagtttggaaccagttatggttatccgcaatctatgatgggggcacacgtttcggcggtgccaaacgagcagaccggtcggattacttccttagagacgcgagctaacgttgccttctatggtgcgtttggctacgaattagatatttcgaagatgtcggatgaagaggctgaacaagttaagaaacaggtagccttctataagcagcatcggtcgttatatcaattcggtaaactgtaccgcttagacagtccctttgaaggtgagggcaacgtgatgagctggatcgtggttgatgagcatcaggatcacgctatcgcaacccgttatcagctgttgaatcatcccaacgcaccgtatgatcgactgtatttgcgaggattaaatcctgacaagcagtatcgcatcaatgatggtaaggagacttactacggtgatgaactcatgaatgctggtatttttatcggcagtgagtttgatgattctgcgacggtcaagcagtcggcggattttagttctcgtagatttataattgatgttgttgaataataaaaaatccgtttatcaatcatttgactgataagcggatttttattgtcgtttttaactcaacactaagcccaatcaactgcaggttgtttactcaaaatatcatcaatggctgaaagttcctcgtcagagaataccaagttgtctaaggctttaacgttatcgaccaattgctgtggtcggctggcaccaactaacacgcaagccagttcaggtttacgcaggttccaggccagcgccatttcggctaaggtctggtgacgtgattcagcaacttcattgagcgccttcaccgtttttagtgtttgttccacttggctgggttcaaggaagggactggtagactttgctgcccgtgagtctttaggaatcccgttcaggtacttatcggtgagcaggccctggcatagtgaactgaatccagcggctgctttatggtacttctttaaaaccgggaagaggtcactttccacgccgcggttgaacatattataacgcggttggtgaaccacgaaaggcgtatgcatgtcttcgaaacacttaataatggcttcggtctgggcaccactatagttggaaataccaacgtacagtgccttgccttcgcggactaagctgtctagtgcttgagccgtttcatagacgttagtttccggatcagcacggtgactgtagaagatatctacgtagtctaaacccatgcgtttgaggctttgatccgcactggcaatgatgctcttacgggaaccccagttaccataagggccatcccacatttcgtaaccagctttgcttgcgataaccatttcatcacggtatggtttcatatcagtggccatgatccggccaaagttttcctcggcactgccgggttcaggaccgtaattattagccaaatcaaaatacgtgatgccaaggtcaaatgcttgctggacaatggcacgctgattttcgtatgcatctacgctgccaaagttatgccagaagcctaaaccaatggctgataatttcaaaccgctgtcacctagtcgattatagaccatgttgtcatagcggttaggatttgcttcatacattgaactacctcctaattaaataagtaaacgatttcattataacgcacttatcacgtaaaactaaaagttgaatgagaatccagttgagcccacggaagcagttattgacacaattatagtgaactcgtagaataaatacatcagtgcaaaatgaggagatgatgagattgacgggtgacttagatacgaagtcggcactgaaagaaaccttacccaccgtttttggttacataggaattgccttagcttttgggattactgcccgagctaatggattgagtgttttagaaatttttttgatgtcattaattacatatgcaggatcagcggaattcgtgattgtgagtctgcttgccttacatgcaggtattggttccattgtgatgtctgtctttttggtgaacgcgcggatgattctaatgagcacggtagtagcaccatatctgtcacatgaaagtatggcaaaaaacatttgggcgggcaccttactaacggatgaaacgtttgccttaagtatgaacaagttaaattatacgagccataagcttaattttaggtggcttgataccgcaaacctctttgcttataccgtttggggagttgcttctgcagtcggcggaatgctgggtaatttaattaataaccccgagagatatggtttcagttttgcgttagttgccatgtttatcggtcttctttatttgcaaatgatttcagatcgaaccatcaagttgatgattcagtttatagttgttcttttcgttgctgttttgatgtttttaggaatgaaatggctcccgcaaaacgggctattattaatcgtgacgttactaggttgcggatttggggtggtgttaaaacatggcactaagtagttatgtcttattcgtaattttagggagtggtttagtgacttggttatcccgggtggtgccatttattctattaaaacagtttaagttgcctaaagtggtggtcaactttctggggtttgttccaatttgtattatgacggcactctggatggagagcctgtttaatcaacatttaggtcagtttccaagtcttaatgtgcccaatgcgttagctagtattccaacgctgatcagtgccatgattagtaagaatctactgattattgtcattgtcggtgtgctgtcactagctgtcgttaatctattagtttaaaaccattaatttgcttatacttccatcatcagtaaattgacacatttctgtaatattagtatactctcgtaggagtgttcggtccgattgaacctatttggaacagttggctaatatgagaggagtattttatgatgaatgaggaaacaatggcaagtcggcgtcaacagttaaaacgtgatgctcgggggttcttagacaaaaactttaccttttatttgctcttattcttaccaatttatattcttggtttagcagttggttttggtaattttgcttttaatttaaacggtaaccttgctggtggtgactggttgagcttactgagtattgtttcatcgttgctatcaattggtgtttcctttgttatgatcgatctgcagcggggtgtcggtgagtttaccgaacccgtcagcaagtcctttacgatttttaaccgcggtagttattttcttggttcgttagcactgattattctggttggtatttttacctttctctggagtctgttattgatcgtgcccggaatcatcaagacgctttcctattcgcaggcaatctttatttatcgtgattacttggatcaaggtaagaaaattggtttcttagaagccattactttaagccgaaaaatgatggatggtcataaatgggaatatttcgtgattggcttaagctttattggttggggcttagcatgtatcattattattccaatcatctgggtttatccgtatatgaaccaaacgcttgctaacttttacgttaaattagcggctgaagatgttcagggtactgatgaagaggatgaaaagccaacgttggtcacgtccgataagaactctgaagcagcacccactgagactttttatccggactcgaaatcaaagtcagatgattcttcacataatgaccagtaagatagtattgaatgaaggtgccaattggggcgccttttttggttgacctaaatgataaaatgaattcatatcaataaatacatattgaggatggttgaatgtcaaaaatagaaaaagcgccacagtggcagcgaaatctttatgctttgtggctgggtaacttcattacgggtgccggtgcaagtatgagtttaccgtttttaccactatttattagtgaaatgggtaactttcctaaatgggaactgacgctgtatgctggtttagcgttttctggtacgtttttaagccaagcaatcgtgtcaccattttgggggaaactagctgataggactggacggaagcctatgctgatgcgagcggctcttgggatgaccattacggcaacgttaacgggattttcaccaaatgtttgggtcttgattgcattacgtgtgattcaaggtggtttctctggctacattaataacgcatacgcattgatggccagtgaagttccagctgataaaagtggtcgaactatgggcactttaacgactggtaatgtcggtggcacgctgattggtcctattataggtggctatatggcggggatatttggttatcggattccgttctttatgtttggtggcatgatgctgatcgcgtcgattacgaccttggtgttcgtgaaagaaaactttcacccggcagatgacccaaagtatgcggagcggagtgcttttacgggaattaaacacgtgagggtagtttgggcaatgattatttcttctatgcttattcaggcggctaccacgtccattaaccccattattagtctgtttgtgaaggaattgatgcataaccacggtaacattgccatggtcagtggggttatcgcagcgctaccaggaatcgctaccctgattgctgccccgcaattaggcgccttaggggaccatattgggccacggaaagtactggttgcgggtttgattttttgtgcagtgatgtttttacccatgttctttgtccaaagcgttactagtttaggtatttttcggttcctagtgggaatttcggacgctgccttattgccgataactcagaccgtgatgacgctggctacacctaaagaatcgattagtcgaatttttagttataatcaatccgctcaagcaattggttcagttatcggtccaatgctggctgcaggagtagctggggttttggattatcgatacgtctttttgatgacaactggtctagtccttattaaccttggaatcgtgatgtgggcttataaagctgattataaaacggttaaagaaacccgataacaagggctttttgcttgcttaacggtaacgaaattagtacaattcttctagaattgattgataatggcaatcaatattaagagagaattggagaattgaccatgggtaaagcacaagaaagaacccggcgccaaattttaagtgcctttttagatttgcttggtgaaaaaccatacgacatgattagcgtatcagagatttctgcagcgagtgtgattactcgtagtactttttaccgttatttttctgataaaaaaagtttgctgatggctgaaattgaagatacagttcaaagacatacaccagatcagccattgctagttcaatttgttgagtatgttgagtcctactggacagtattaagaaatctaacaccgacccgtcaaagtcgctcagaccttcacgaaatattgaatcagatcctatgggaactcattcagcgccgtgtcgttgctggttcaaaaaatgatccagtcattgagacgattcagcaatcgcacaataaagacgtcatgattagtgctattgaagggatgctaatgggaattttagagcgctacgtggttgaggggacggctaaaatcgaccataagcaattagaagcagccatacttgaaattaatagtttgtttaaacaaaaacagtcataattaaaagtaaaccgtgcagtcaaactgtacggttattttgtctcatttattaaccacaaatgagaaaatgcacaaagtttgctgtaatttagcatatttatatacagggcaattgctacatgatattatggaagcggttacagtaaactaatcgaactaataattaatgtaaaggggtatttaccatgaaattagccaagtacatcgatcacaccattttaaacgctgatgccacggagacagatgtcgataaagttatcgcagaggccattaaatatgatttcgcctcagtatgtatcaatccgtactgggtcaagcatactgccgctaaattacaagcgtcagatgtgaatacttgtaccgtcattgggttccctctgggtgcaacgtcaacacagagcaaagtctttgaagccaaacaggcgatgaaggatggtgccgatgagttagatatggtgattaatattggtgaactcaaggccaatcatgatgatgccgttttagcggatatcaaagcattggcagatgccattcatgcagaaaacaaactacttaaagtcattattgaaacagcgttactaactgacgaagaaaaggtccgtgcttgccagttagctgaaaaagcaggtgctgattttgtcaaaacctccacaggtttctcaactgctggcgccaaggtggcagacgttaaattaatgcgtgagaccgttggcgaccgtttgggtgtgaaagcttctggcggtgtgcactctaaggcagaagcggaggccatgattgaagccggagctacccgaatcggtgccagtgctagtgtcaaaattgtgacagaagagtaaggaggggtcagcaatgacttttaaacgtgtatttggtatcgtcattgattccgttgggatcggtgaagcaagtgatgccaataaatttggtgatgtgggagccgacacattgggtcacatcggtgagttttataaaggtgatttaaagcttcctaatcttgccaaaatggggttatcaaacattcgccctagcaatcctattgaaggagtacccatagtgaacaacccgattgggtattttggcaaaatgcacgaagtttcggtgggtaaagacagtatggacggtcattgggaaatgatgggtctgcctgttacggaaccgctgggcttctttcctgaagggtttccagcagaattaatcaaacaaattgaagactttagtggccgtcacgtgatcgttaacaagccttattcaggtactgatgtcatccatgattatggtgaacagcaaatgaagacgggcgatttgatcgtttacacttctggtgattccgtcttgcagattgccgctcacacggatgtgatcccgctgaaagaactctataagatctgtgaatttgctcgatccattaccatcgataaaccttaccgaatcgggcgaattattgcgcgaccatacgttggaccggataaggaccactttacccggacttctgatcggcacgactttaccttggcaccaactggtgaaaccgacttagatcggttaaaagctgctgggctggatgttttagcggttggtaaaatcaacgatattttttctggtcagggcattacggacggtgttcacaccgttagtaacgatgatggcatgaagcggacgttagaaaacgccggcaaagatttccatgggtttagctttaccaacctcgttgattttgacgcgatgtatggtcatcggcgcaatccagagggctatggcaaggcattgatggcctttgatgaacagttaggtgatttattagcctctttgagcgatagcgatttactgatgattactgctgatcatgggaatgatcccggttataaagggactgatcacacccgtgaatacgtaccgttactagtatattcaccacagtttaagcaagatggttcgctgggaattcggcgcacgtacgctgattttggtgcaaccattctggataactttaacgttagcggtaattcaacgggaacttcattcctaaagtcattgaaataggaggaaaatgcgatgagtacacacattggcgctgaaatgggcggtattgctgaaacggttttactacccggggatccattacgggcaaagtacgtggcagataactttttagatgacgttgttcagtataattcggtgagaaacgcttttggctataccgggacctataagggacataaagtttctgttcaaggcacgggtatggggattccctcgatttcaatctataccaacgagctaattcgtttctttggtgtgaaacacttgatgcggatcggcagtattggtggcttcggtgagtcagtgaaaattcgtgatattctcatcgctgaatctgccagcaccgactcggcaatcattcaaaacacctttaaagcgggtgtgatctacgcaccaaccgctgattttgatatgctgttaaaagcttatgagtcggctaaagaagccggtgtttcggtgaaagtcggtaatatcttcagtgcggatcgcttctataatgatgaaattgattatcagcagttgattgactatggcgtattaggaacagaaatggaaaccgctgcgttatacatgctggctgctaagtatggtgtgcaagcattatcgatcaacacggttagcgataacctcactactggcgaagcactatcagctgaagaccgtcagaattcattcagtgaaatgatgaccgtggcgttagagactgcgattaagttatagaataaatcactaatcacaaacaaagagggggtagcgactggaataacaacgaatttcagtcgccaccccttttatattttttagtcaggaggaatttgacgatgagaatggtagacgtaatcgatcataagcgaaatggtggggtcttgaccaacgaagagattaagttctttgttgatggggtagtggatggcagccttcccgactatcagaccagtgcgctactcatggctatctacttcaatgggatggcagatggtgaacaagctgaacttgccctacagatgttgaagtcaggggatcagcttgatttgtcagatattccgggtattaaagtcgataagcattccactggcggtgtgggtgataaaactagtctgccgctggcaccgatgattgcggctttaggaattccgattccaatgatttctggccgtggcctggggcatactggcggtacgttggataagttagaggccattccggggtttaaagtggaactttctgaagaagcgtttaagcaacaagtgaaggacatccatctggccattgttggcgcaacgggtaatattgcacctgctgataagaagatttatgctctgcgagatgtgaccgacaccgttgattcgattccgttgattgctggttcgattatgagtaaaaaaattgcctcggggacggatgcgttagttcttgacgttaaaaccggatcaggtgccttcatgaaaacggaagatcaagcccgtgcattagctaaagccttggtttcaattggtaagaatgccggcatggattgtatggcactgatttctgatatgaatcaaccgctgggacggatgattggtaatgcgttggaaattcaggagaccattgatattttgaagggtgaagggccggatgacatcactaatttggtattaacccttggcagtcagatggtggtgttagcgaagaaggctaagaccctggatgaggcgcgccagatgcttgaagaagtcatcgctgatgggaaggccttggaaagtttccgacaaatggtgattgcgcagggcggtgacgaacgcgttattgatgatccaaccatcataccacaagcgaaatataaggttgatttacctgctaagtcgagcggcgttgtggctaaaatgaccgctgatgagattggcgttgctagcatgctgcttggtggcggtcgtcaaaaggcggatgatcagctggactacgcggtgggtatcgaacttaagaagaaggttggcgactcggttagtgaaggagagcccttactgacgatttatgctgaccgtgaagatattgatgacgtgaaagaattattgtacaacaacattgagatagcggatgcggcagaaccgctcacgttgattcacgagattatcaaatgattttcttgatatgaagaccaaaaacctgattgctcatcgtggcaatcaggtttttagtacggttaaaatagctcggtttgcaattattgacaccaataagccttaagtcgtacattatgaacatcacaacttattttggaggatacttcaatggtttactggttcgatattcgtatggcaatgctaactttcccgttagtggcgttattaattacctttccaattttactatggcattatcatcgttttggggcgatctcacggtggtcaatattgatgctatacagtttcgttttttatttactttgtgcgtattttctaattatgttgccactacccagcgttgcttcggtggctaaactgacaacacccaggtataacttgcagccacttttgtttattcgggaatttgttgatcaaaatccgttacagctttctaacccgcatacttgggtggctgcagttaaagcgccaacggtgattcagccgttgtttaacgttgtgctgacgattccgtttggtttttacctacgtagttattttcataaatcgtggtggcagacaatattgctctcattttgcttatcattattctttgaactgactcagttgaccggagattatggtatctatccgcgttcgtaccgattatttgacgtggatgatctgcttttaaatacgattggtgggttagttggatttggtttgaccagatttattctacccgtgttacctacgtctcaacatattaaagaaaaactacggattcaatcccgacaggtgtcagtatttcgccatgcaaccgcgtttgtagttgattggttcagcttttccatcgtatcgatgattggtaacggcttattgggaaatgtaaaggtgttagtgcagccagtttcgttagtgagtttgatggtagtggttttactgccgcagcttgtttggcgaaaaacgttaggaatgcgcatggtacatttgaaagtggtggctagtagtgaaggaaaaacaactgctaagcatgtttgtcaacgctggattgcaggttatagtttgtttttggtaccaatcttgattggtggtggcttagcttttgtgagccctggcagtcagttttatatgtacgcaagtatcgtaatggttctaatattagcagtcattgtgattctgctgggactagatatgatgattgatgcttttcgaccacagcatgcgctgttatttgaacggtggagtaaaaccaaattaatttcagattaccgttagacatgaatagggaccggaaacaatcactcgtttccagcccctattttaatttagcgttattagtaaaatgaaggtttatcgccatccgtacccggttgatcaaccccaactgaatgaccgatttccttggttggttcattgatcagagatacaatgaagtcggcaatactcttacgagaaacttcggtgcccttaaacggttcacctttctgcgtggtttcgtaactaacaatgtccttatttgaaagccatgcaggacggacaatagtgtagtccaaaccagaagcttcgataacttttgctgctgcagcataggtttccaaataaccgccatcaagcatttgatggttccacttaccgtagttaccagggacttcatcgtaaatgcccagtgttgaaatccagatcaaacgttttagacccattgctttcatagccgcaacgactgtttttgcctggttttcaatgtcgtggttaccaaggttggcgtacacgatgtcttgaccttccatggcttttttcaggctagcttgatctgtagcatcaccttcaacaatcgtttctcgggtcgcatctgaaacgcttaatcgactagcatgacgcaggaatagtgtcagttggtgatcggtttgcgccaatagctgtgcttctgctaatttggcaattttaccgttggcacctaaaattaatacattagtcatttcacattcactcctatctgatttacgagtttattataggactactatggttaaaattgaacggacagatactagacctttgtccgccacttgtgtttgaacggttagataaggtaaaataagtgttatagtccaggtagttaatggcatgacttatattcaaaatcttaacaaaagaggtattatcatgagtggcattttaacgggtaaaaaaattgtaattatgggggtcgctaataagcgcagtttagcttatggctgttttcaagcattagaatcacaaggtgctgaaatcatcctaacttatcaaaatgaccggatgctaaaaagtctgaaccggttcatcgatgagaacgtgaccaaagttccttgtgatgtcagtgatcctgagaacgttgaaagtgcctttaagacgattcacgaacaagttggtcagattgatggtattattcacgcaattgcgtatgctgaccctgaggatctaaagggtgaaacgacggatgccagtctagagagttttaataaggcacagagtatcagtgtctactcgttgatctcagtggctaagtatggccgccaaatcatgaacgagggcggttcaatcgttacgctaacctacatgggttctgaaagagcaatccctaactataatattatggggattgctaaagctgggttggaggcttcagtgcgttaccttgccagagacttagccagccaaaatatccgggtcaacgcaatttctgctggggccgttaagacgctggcagttaccggtgtcaaggattacagcactttaatcaagctttcaaacgaacgcgcagttaacggagtcggtgtgaccattcaagaagttggaaacacggcagcctttttgatgagcgacttgagtagtggcctagtcggagacacgatttatgtggataagggcacgcatttgatttaatagatgactgcattgtagtcgagatgtatcaaaattagaggtaactatttgcaataacccctcaacttcatttccatcttggagattaagttgaagggttatttgtgtttcactaattctgtattaattttataattaaaaaaccagcgaaacggagagatttcgccggacgagtaactactcaatcttaatatgagtaggtgagttcgcgtaccaagcgggagtcactgcgcaacttttaagttgaagggtagggggagcagtactcaatacgttaactctatttaggattataatagaaaatgagaaaaatcaaagaatttacactccaaaaagccatgttttttaaaatcattttagtgacgtataatgaaattaacaaattagaggaggtttaccatgactgaaaaaaacgtttttcacgttaacgggtatctcggactcatcgttgccattttgttagtactaggtggtggctggctatttcttttacggtcagtatttagcattactttaggcgtgattttaattttcattgctctcattggaagcagttctttaacgattattgcacccaatgaagcaaaggcgatgactttcttcggtaaatatattgggactattcgaacggctggtctgttcatgaccgtgccactgactaataagcagtcaatctcgttgcgagtgcgaaactttaacagtaatttgttaaaagttaacgactctcgtggtaatccggttgaaattgcggcagtcatcgtgttcaaggttgtcgataccagcaaagctttatttgatgttgacgattatgaacaatttgttgagatccaaagtgaatctgctattcggcacgttgcttcggaatttccctatgacgcttttaatgaacaggaaacactcacgttgcgcagtaatcccactgaagtttctaataaactaactgcagaacttcaatcgcgtctccagattgccggtgttaaggtgattgaaacgcggttgacccacttggcttacgcaactgaaattgctagtgccatgttgcagcgacaacaatcgtcagctattttgtcagctcggaaaattattgtggatggtgccgtttcaatcacggaagatgccatcgcaaagttagaaaaggatacggatctaaagcttactgatgacagaaagcttcaattaattaataacgtaatggtcacgattatttctgagcgggggacgcaaccggttatcagtacaagtgatactaagtaagcaggtgtgacaaagctcggtagagtacaaaatatcatactaaaacgccattccggtgggattcttatcggaatggcgtttttgggtgttatatgaccgtgatcagacttgtgacatagccttttaattgttagagaacatctaatggtaatttttcagtaggtgctgggtaagcttcatccaaaagcttcaggtcatcagcggttagctgaatgtcgccagctaacacgttttcctttgcgtggtcaggattgctactttgcggaatggctaaaacttactggtgagagacaacccaagctaataaaatctgataagcagaagcgttgtgtcgttgggcaaccttgaggacgttcgggttgcggtctaagtgagcgttcaattgatcaggcgcaccaacgggactgtaggcgataaagggtaactcgtgcttggcttgccaatctagcaggctatattcgacaccacggctgcctaagttaaataaatcttcattagcagcagctttaggaccattttgcagctgccagagttcttcgaggtcgctaacatcaaagtttgaaatcccccaagctttggttttccccatcgttgtgagccgttgcaattcatcgattgtttcggccagtggggtggttccgcgccaatgataaaggtaaaggtcgacttcatcaacgcttaatcgctttaaactagcgtctagactgcgttccatgtgctgtttcgaagcattcgttggcagaacttttgaaatgaggtacaactggtcacggggaatatccttaatggctttaccaaccaacgtttctgcacggcccgaaccatacatttcagcggtgtcgattacctttgcaccagcagctaagccggcgtgaatggcgttaatttcctgtgtttgcagcgacgggtcgtcccccatatgccaggtacccaggccaatagctggaacttgattgccagcgatggtaactgtttgcatacaatcgtctccttaatgttttagaaatatacatataatgtctattgtagaatttttgacagtattataccaactcagatgcctctaaaatttgctgtgaaaaatcagtcatctgctcaggtaagttgtccaaatcgaaaaaggccactttatccgtctcaccggcttgtggagttagttggttatcctgagtgaaggcttgatagaccgcaatcacagcatcgatttgatcgccattggggtaactgaattgcatggatgggccacttaaaagggtcttaaatttaaagttaactgcgtgaaccccggtttcttctgtgacttcacggttagcagtttcggcgagcgattctccaatttccttcgaaccagaaggcagcccccataaatgagtgtcactgcggtgaacaaacagtagctgcgcactagcgttatagacaagaccggcggcaccggttgaaattaatggttggtgaccaacctttttccttaaatttagaatgtatcccataggatcacctcattaataataacttcttcattaatttcattatgcgtgatagacggtgataattaaagcgttttattaggttttatggttgattatacaaccggaaagccttgcactatattaaaatagttgttaaaatatactcatttatttctaatgttcttttgagaacaagatttattgtttcgaatacataagcggttagttaccgctacaggaggaatcttatgagttttaagagtacattcttacgccaggaagatccggctgtctatcaagacaaggattcgcatttggctcgtgtattaggcgtaaaggatatcttagccttaggggtcggcacgattgtttcgacttctatttttactttgcccggtgttgttgctgcacagcatgctggtccagccgtagctttatcgttcttagctgcagccgtagttgccggattagtggcctttgcctatgctgaaatggctgcggcaatgccattcgccggttcagcttattcttggattaacgtggttttcggtgaaggctttggctggattgccggctgggcactgttagccgaatactttattgcggtggctttcgttgggtctgggctttcagcgaacttccgtgggttgatacagcctttggggattacgtttccaaaggcgttagctaacccgttgggaactgatggcggtatcattgacatcacttcggttgtcgttgttttgatggttgcctttcttctgtcgcgaggcgcttctacagctgcacgtgtccaaaatacattggttgttttaaaagttttagctattttgctatttatcgtggttggtgctacggcacttcatccacaaaattacgtgccgttcattccagctcacaaagttgttaacggtaaccagtttggtggctggcaaggaatttacgctggtgtttcgatgattttcctgtcttacatcgggtttgattccgttgctgccaactctgctgaagcgaaggatccacaaaagaccatgcctcgtgggatcatggggtcattggtcattgcggttgttttgttcgttgccgtttccctggtacttgtaggaatgttccattacagtgactacgctaacaacgctgaacccgttggctgggcactgcgtcaaagtggtcataccttagttgcaacgatcgttcaggcgattgctgttgtggggatgtttaccgcgttaattgggatgatgctggctggttcacgtctcgtttactcattcggccgtgacggtttactgccaaaatggctgggtgtgttgaacgacaaacaactacctaaccatgcgctgtcaactattaccattgttggtgtggttatcggttcattgttcccatttgccttcttgtcacaactgatttctgcagggactttgattgcctttatgtttgtttctctaggaatctacaaactgcgtccacgtgaaggaaaagatattcctgatccttcgtttaagatgccgttttacccagtactgccattcgttgccttcttaggggcactcggtgttttctggggattggataaagacgcaaaaatctatgccttagtctggtttatttttggattgcttgtttacctgctatacggtgctaagcattcttcgttaaatacaagaccaaatactaaacaaaaatagtttaatgaggaccccaaagcactgtgttttggggttttcgtttaaatcaggattgatggaggaaatatcatgagtgaaaatgaacgaatcttaaaaaacgaagcgccggcactttctaatgctgcgcgagtaaagtatttcaatattgtgatcgaatcgggtaagggcgccacggttacagatgctgatggcaaaacttacattgatttgctggcaagtgcttcagcaaccaacaccggtcattcacatcctcacgtggttaaagcggttcaggatcaagcagctaaattattgcagtatacaccggcgtactttgccaacgatgcggctgctaaattagccccgcgattggcagctttggcacctatcagcggtccgacaactttaggctggggcaattctggttccgatgccaacgatgccatcattaaatttgcccgggcttataccggacgaccttacattgtgagctttacgggggcttatcatggctcaacgtatggttcaatcagtgtgtcatcggtgagcttgaatatgagcagaaagattggaccgctactgccggatatcgttaaggtgccgttcccagatccttggaaacgcctagatggtgaatccgaagccgcttttgttgaccggatgtttgacgcctttaagttgccctttgaaacttatttaccagctgaagaagtggctgctattttgattgaaccgattcaaggtgacggcgggatcgttaaaacaccggatgcttatatgcacaagatttatgattttgccaaggctaacggcattttatttgcagttgatgaagttaaccaaggcatgggtcgaaccggtaagtggtggtccattcagcactttgatttggaaccagatctcatgtcggtcggtaaatcgctggcttctggactgccattaagtgcggttatcggccgtcaggagatcatgaactcgttaggatcaccagccaacgtttacactacggcaggcaaccctgtgaccacggcagcagctatggccaccattgacgtgatcgaagacgaacacttactggaacgcagcaccaagcttggtaaaaaagctaaagccttctttgaagatgagaaaaagaagtttaactttattggcgatgttcggatgtatggattagacggtggtatcgatattattgatcctgagacgggtaaaccagacgctgacgccacaactaagattatttaccgggtgtttgaactgggtgcaatcattatcagtttgaagaccaatgtgcttaggttccagccaccgttggtcatcactgaggaacagttgcagtcggtgtttgatactcttgaccaggcctttagcgaactggcagcgggcaaactttcattgcctgataatgcggacgagattggctggtagcagttaaaatttaattgaattgattttagtgggaagaggccgcaccaaaactcagattccagccatttagcgtaaataatggaatctgccgagttttggcgcagcttcttttcgtgttttcattgtttttcatagtgtactttcaacaccagcttaaaatgtttacgagtgataaaacaccagtatgctggtagtaaacaatttttttcctttaattgactaaaaattgggtaaaattttattgaaattaaagtaagcgtttacaaagtttgcacaattgtgctagaatgttcctaggctatcgaggaagggtagcaaaatgaatattggaagcgcttgctaaaacgaatgacgattgtcgtatttgaaatttatcctgattattgattttatcgtttgctttagcgagtggctcccaaaatacgggaggcatgagtcatggcaagtaagaacagtgacaagattacactgaatcctgaatcgtttgcagaggcggtccttggtggtaatcctaagcgcgatgacgaagaagataaagtttatatcaaacgtcagttaacgctttatctggaatcattgttgttggcacaagactttaatgatcttgaggaaactcgttttgacgttgctaagtcagaacagcgtagtaagatcctttcaaagatcattgagcatcgttacgaaggttcaggaagtggcgaataatcatgaaagaaaaaacagagagtcatgttaaacagtatacatcatacgcattaggggcctttgggcatgatgcgttctacgcaacattaagtacttatttgatgttgttcattaccagtgaattatttaacggcgctgcaaaaggtgtcaagtcacatatgattttgacaatcaccacgatgatgatgattattcggttagttgaaattgtatttgacccaatcattggtggtattatcgataacaccgagactaaatatggtaagtttaagccatggttgctagttggtgccggtgtcagtgctattttcttagttttgatttttacggattttggtggcttaactaattccaatccaatgctttacgttgttttgtttggtatctgttatgtcattatggatattttctactcgtttaaagatattgcactttggtcaatgctccctgctttgagtgttgacgaaaaggttcgtaataactttggtaccactggtcgtttaggttcaaccattggtgctcaagcggttccaattatcattttccctctgattgtgttcttctcacacgtgttctcaggaacaagtggtcagactaagactcaagctgggtggattggctttgccgttgttatcgcaatattctcattcggtggtgctttatgcacggcattgggaactcatgaaaataccagtttgattcgtcaaaacactgagcgtactggtgttatcggtattttcaaagcgttaggtaagaacgaccagttaatgtggttggcagcttcatacttcctatttgctttaggttacgttgttactaactcattgttagcttactacttcacttatgtattgggtcagtcaaacaagttcacctttgccggctggatcatggccatcttgggtgtcatctcagtttctctcttcccagtgattgttgcaaaagttcaccgtaaagcgatttatgtcggtggtatttgcatgatgttagttggttatgttttgttcttgtttgcgggacacagtttactcggtgtcttggtttctgtcgctgtcttcttcttcccatacccaatgatcttcttggccgcgttgatgaccattactgatagtgttgaatatggtcaatggaagaacggtacccggaacgaatccgttaccctttctatccgaccattgatcgataagttggctggtgcggttgctaacggtgttgttggtatcgctgccgttcactctggtatgactggcaatgctgctccaagcagtatcagtgcagctcaattgtcaaactttaagatgtacatgttctatggaccaatgattttggttgcagttgccgctattgtctactacaccaaggttaagttgagtgaatctcgacacgaacaaattgttaaagaacttgaaagcaagttgaaagctgaaaaagccgaaaaagatgctaaaggtgcaactgacgcgcaataagcgttgactaaaaagccgtaatgatcactacagagatagtgacgttacggcttttttgtggtgtaagctagaaataagggccgctttccaataaaagggtacacacgttcgcttctacttggtatactattcaggtattctagagacgcaggcttgtattttcacgataagcgtgttgtaatatgataagtagattaaaatttgttaagagaagagagcgaagcagaatggaaaataaacgacatatttcaacccgagaagtggtttacttggcgatgttgatcgcagttaccgttgtcatttcaaggtttttcttaattcctgttccaatgacccatgggaacattaatctttgtgatgctgggatatttattgcagccattttactaggcagaacgcagggtgcagttgttggtgccttcagtggtttactgcttgatttaatttcaggatacacccagtacatgattttctcgtttattgtccacggcttagaaggttttgttgctggctggattggtggtaagaagactaaatctgccaagatcgttgccatgagcattggtgttttagtcatggtagctggttattgggcaactgacagtttgctctatggtttcaaagtcggtctgatcggtgtacctaccaactttattcagggaattgttggcggtgttgtggcttacgtggtttccgttccgctggaaaaccggttacccagattaattggttaagacatggtaaaaactttgcataaccagccctttttagttgcggaagatctttccgctattggaaccatgtccctgggtgttgccgtgccgatcttagcagtctttggtgttccagcagctattctgccgacgcaggtgttgtctactcaaacggagggctttggtacaccagccaaacaattttcagcaaaatggcttagtcagacgatagatcattggcaaaatgaagatattcagctttctggtggtttgatcggctatgttggtcaagtggcgctgctcaatcgtttaattcagttagcaacatctcagcagttgcatccattaatcgttgatcccgttatgggcgatgatggtgccctttatccgggattaccggcggattatgtatcggccatgcgggaactgattgctgatgcggatgtgattacgcctaattggacggaagcacatttattagctgacgtgccattgactgatcagcggcctagtaaagccgttgtgactactttatttgccaaattgtcagttgcctgtggggaacaaacacgcattgttatcactggtattccaagtgatgatgctgtgttaacggcttatcaagacaatcgtgggctgcaaatggtttctacaaaattgcgcgatggccatttttatggcagcggcgatgttttttcggcgctacttggtgctgcactgatgcgtgatgtaaactttgaaacggcggtgaaaattgcggtaaaaggggatgcaatctgtctggatcagacttcagaggctggttatcagcgtcgatttggcatgcagatgagcgagctattgaagtggctgacccaagaggtaatcccaagtcttgattcgtcccgataattggttcaaactaggcttaaaccaatactcatcggagaaggggaactggacatgattgatactaacgtaaatcggcgtcaagacaataacgtgaagtggtcagttacgaaggatgacgaccaactgttgcccatgactgtggctgacatggatattgcgacacctcagtttattagagaagcgatgcaacgcgtgctagacaaaaaagtactgggctacacaatgcctagtacggctttttataacgctattattcactggcaaaagacgtaccacaatgttagtctcaaacgagatcagctgatcatcgttcccagcgtggccgttggcttatcgttcgttattcgtcatttaacccaggtcgacgacggtattattgttatgtcgccatattatccgccgtatcggcagttagtgattgacaatcaacgtcagtttattgaatttccgttggttcaacgagaggggcaatacgtcatcgatcttgatcgcttggatcaagtgatggctgaatccaatgccaaagcaataattgtttgtaacccgcataaccctggtggctgtgtctggaccacatccgaattacagcggattcaagatatcgcaaacgcgcacaacgtcttagtgttggcagatgagattcatgatgacgttgctttttctgacaatctgccggtttcgatgatgtctgatttgatgggtgaagaggcttctgatcaaacgattttactgaagtcagcaactaaagcgtttaatttagcggggatcaaatgtgccttcttggcggttaagaaccctaaactgctgtcaatattaaagcaggcggccgctgctgaagcgattgaagaagtaaatacgttaggactagttgccactcgagtcgcttacgaacagggtgctgactggttagcggaagtgaatgcttatttggaagccaaccgtaactttgcttatgaatatctgcgtgaagaagtgccaatgattcggccaatgtatcctgaaggaacttatctcatgtggcttgatttcatggcttatgggttaacagatactgagctggatcagaaattgcgtgaacttggtcacatctgtcttaatcctggcattgattatggcaagacgggcagtggctttatgcgtcttaactttgcggtggatcgtgccgttttaacggatgctttaaagcgcttgaagacttttgatcaagcagtaagaaaaaaataatttttaacataaataaaacataataataaaagtgcctgattttttcggtttttatagccgaaatcaggcacttttttatttgtgtcttgtttgttactgaattgtaaaccgatttcaagaaatgttcatcatttggtcgtaactatttcttattgatttgataatttatacacataagaaaaaaggaggcggcgtgaatgagtgaagcaccggaaattgtggtaggtcgactagttcgatgtcaccatgcgcaaatgagtagaccgtttattgcgcgagtatgccaggtatttggaaatcggctagtcgttgaggtgatgaactttcactttcatgatcgccgaatagttgaagaaaatcgatataagttagtcgttgaggctaacgacgctaagaccatggcaattgtccaatgccaacgaaggaaaggatgatcaacatgattaaaatcaacgatatcgtaacgtgcgaacctaatggtaatctgacgtgtgcctttgtaggccgagtagaacatatttatgaacggacggtgatggtgactgtgttggatcatcaaccttgtgaccggtttaaagtagctgaattaatgggccgagtgattgttgctaaaaccaaggttaaaactcaggcggaaacggctcagctacgtaaagtagcgaaaatataataaaaaggatctgcaaaatcagttttaaaaactgatccgcagatcctttttatgatgctgagcttaactatttagcaacaaagtcggttttgttaaagaaatccactttgatatcatcgtctgtaatggtcaattttgaaatactgccattaatggtaggtacgcccacatcgagttccggcgcgtaacggtcaatgattgaacgaatcgtcataccgtgagagaccaccagaacttgatcaccatcgttggtgttatcacgcagtttattaaaaccacgatccagccgtttccaaaacatgtcgttactttctgcttcaccatagaggtcggctttatgaataaggtcccgggccttttccaaaccgtatttacctaacacggctgattcggaagttagctgcacctgttcgccaacgaactgccacatctgattagcatcgttgccttcgaagtaaccgtggcactgctcgcgaaattcagaatattgataactgatgatattgatgttttcaggattagccttcaagatgtaagaagccgtttcaattgcgcggcctgaatcactgctgtacgcggcgttgaaattaatcgccttcagctgctgtccagcacgttttgcatcagcaattcccttatcagttaacggggaatcgatccagccctgaatcttattatagtggttcagcattgtttgaccgtgccgaacgaagtatgcagtaaaagttttcacagttaagccctcctaggatgaaaagcgaatttaattcacattcattatagcaagttaccaattaatttccaaagtacaactgttttagtcacttcgtctagttatttttagttggtttatgagaggctagggaccagacaccggccatgagtgccaacagcacaccaacgatggaactccagatgccaactttgagaccaggtgtacgataagtcagtttaatgtggtgggtaccactgggaagtgtagcgccaataaagccagcgttaacgagttgtgtttgttgcggtttaccgtccacacttaattgccaacccttgctgtagggaatactggtagttaggatacgtttacgattgccaacggaagtccctttaacctgattattggtgactcgttgatgaactaaaccagttttctgtagtttggtggtttgctgacggtatttagcaccgtacgggacagcaatcactttgacgtgtttaaaatgaatcttttctgcggtagtaaacgataaattgatcgtttttcggagcttcgtggaatagcccaggttgatcagcaagtgatccttaggttcataatcagaaaggttattgataccaaattggttatagacggtttgaccgcgactggttttaatgttcatggtataggcgttaaatagcggatgattgatgatcgagcgccaattgtttttttgctgtccctttggcaacggtgtgcccgcaaattgtgatcgcgtggcatagtagtttaatcgttttgcggtatccgggaaactggttgaaatacccgagaggtctaaatagagctcagtaccctgaacttgcttgggatgttttaatttcaacacataagtttgctgctgaccaagcgcatcactggtcatttcatgcaatccattttggttagcctgtgtattattttcaattatcatttggttttgagctaacaagttgttgaccttggttgaaggcttatccaaaccggtagttgcggcgtaattagcggcatcctttggtgataggggctgtttaccaatagcggctgactgagaatgcttagtattatgttgcaggcgatagttaattagatcaggtatttttagaattggctcactagttaattgaacattgtatcctacgtgtttagtggctgttttaggttgagacgttggtatgccagcaattttctttttaacgctaacaccttccagcaaagcttcttgacgttggagggcagtgagttttttaaaaatgtttggcgtaatttgtgaatcttgcgtgtagaccaacggtaacgcatagcggttttttaaaattgtagtccccgtaccgttacctaccgagtaaaccgggtgatcttcgataacagctggtttgccacccttcgtttttaacggtttaaagccataaggaacggctttttgatttagcgtgtcgtcttcgcgagcaaacaagtatttgacgttgagtaaggacagcattgcaccgcgtgtatcagcttcactagtagggttattcatgctattttggacattcgccagttgctgattaaagtggttgacgtccccgttttgaactgaatagtacgaactgatggtatgcgtatttaacagcatgggaagattattacccacggttgtcatcgtgtagtagtcgttggtggtggatgttcggtagaaacttttatcatgtttgctcaggtactgatcagcaccgtcaaagtaccacttagaccactgactagctgtgttagcaggaagttcattttcgggtgacccactgtaattatcatcgtaaaagcttagaccagtggtaatggcattgagcatgactaaacctaataagccaacttttaacggtcggtaaaactggggccttagtagcagtaagctaaagagccagatgaacagcataaagatcaagtaggtcagcaattgaatctgacggaatttgaataggtagccgttggcaatccaaatgatgatgatcagaccagcaataacacccgtcagccagatgaagtcccgtgtcgtatagtgagttaaatgatcaaccagggtggcagctgttaaagcaaagaccagttgcgccatcatcagccaacggttggaaggggtactcatgacgttcagcgtagccgctacagctgggaacagcagaccaatggcaattaaaatcagggtcaggttgagtgccaagtagcgtttaaaacgacgtaatgtccaaaccatggcaattagtgaaagaccgctggttgcaatcaatacccaataatagatattaccgttagacgttagcagattgtcgggcagtgtgcggtaataaacctctggataccaacgcagattattcgcaaaaatcgatccacccatccgcgaactattcatcatagaaataacgttcggcaataggatgacggccgatacgagtaaagcgataatcatggccagcatcaggcgtagcagtagctgccataatttgggtaacagcacttttttttgcttcaagtcaaagtatctaatgatcaagaaaattagtgcaccaaataccatgagataagcgaaataaacgttgcagattaaaataacggcggtaatgatactcagccaccaccaagatttaccctgtagtacccgatcaatactcagacaaagcagggggaagaaaatcattggcagcaaaaagaacggatggtggtaactaacgtaaaaggcaaacccgttaaaggtataaataagggcaccaaaaacttggccagcgggtttgaaatgaaagtgttttgccagtgcgatgaacgatagaccaacaacgtatagtcgaagaattgtcaataacgtatagccaaattcaatttgatggactggaaatagtgcgattaagtaactaaagggatcaccaacgaggtagtaggcaaaagttgtcatttgatccgcacccaggcccagattccaagaccagctaaagagtgattgatggccggtaccatgaaggatgcgatagaattcttttaaaatggggtaatgctgggcgataccgtccaaattccagattgtcgagtggccagtagcacgcagggtgccaaaagtaacggctgtaataatcataaatgctagcgagtaagccaaccacacttgcatttggtaggttttacgtttcaagatgaattctccctgtttgtcgtgataattcattatcgcatatgttgggacaaataaaaaaggccacgcggatgcgcagcctttctagttagtgatttaaaattagttcttgtccattgcgtggccaccgaattcgttacgaagggcagcaacgactttaccgttaaaggtatcgtcttgtagtgaacggaaacgagtcataacagcgtcagcaataacaggagttgggacaccatgagccatggcatcttcaacagtccattgaccttcgccgttagagtgcatacgacccttgatagcatcaagcttaggatctttgctgaaggcgtcttggatcaattccatgagccagctacggataactgaaccgtggttccaaaccttagcaacggcttcgtagtcgtaatcaaagtctgaagcgtcaagaacttcaaaaccttcacccatagcagccatcataccgtattcgataccgttgtggaccatcttcaagtagtgacctgaaccggccttaccagtgtaaaggtaaccatctggtaacgaaatgtcgtcaaataatggacgaataacttcgaaagtagcggcatcgtcgccaccgatcatgaagttaccaccgttaagggcaccacgccaaccgcctgaagaaccgcagtcaaagtagtgaatccctttttcgccaagaagacggttgtgacggagtgagtctttccagaaagtgttaccaccatcaattaggatatcgccttcgtttaaagcttcagctaaagaatcaatcgtagcatcagttggcttgccagcaggaaccattacccaaacgatctttggtgatggtaattggctgaccatgtcttccaaactagttgctttggcagcaccataagtagctgcttcgtcaactaagtcagagttcaagtcgaaaccgactacttcattatcgttacgaatcatgttttgggctaagttaatacccatcttacctaatccaattaaacctaatttcattagaaaaactcctcatttcttttttcagggaatttacaacagaatcagtatataagattatctcaactttcgcaagagcaaatgtaaaaaaaattacagttttattttcagaaatgaaaatgctttaaacggtctaatgactaatagattgggctagaaaggtcagcccaatccaaaaaatgactaaaggccattttaattgtagcaatagtgctgcaatttctctcaacatggcgggaattaatgcttcagtggtggtccaggagcctgctagactgactggtagatgttgctgcagagccaacaatttactacgtaccaagtgataatcactggtaacgattaaaatagttggttttcgtgatgcttgccagtcgttttcaattacctgcttggagaatttgatgttagtcgcagttgaagtagcagcctgttctagcagtagttggtgtggttgaatttggtgtcgaactaaataaccagccatcgcagcggcttcactttgtggttcgtcgctgccttgtccgccggttaacacgagtttgggtgggacagattggtcggtgtaaattgcaattgcagtttgcaagcgcctggttaaggttttagagggcccactagaagtcactttggcacctaacacaactaaataatcaggctttgtggattgatgaggctgccgtttgtaccagttggtcagccacaagtagagtgtggcaaccgtgtaccaagtaacgaaccccatactgatagcgttagaaatgaggtgagcaggccagatagtgattggtaggatgatcagtaggctgattgcaattagtaaagcgagtaagggaatccagacaagccgttggttggtttgccctttaactagtggtgctatggcaaccaaattcagcagagtcactatgattaggacaatgagcagggtaaccacctcctacgtttcttctattatagtatagtttaaagttcattttgaccgcagcttgacttttaccggtagtatttgtagtattagtgacagctaagaagcaccgaagtaggtgatgggcaacggtatagaaacttgacggctgctgtgagtcaagcgtcccggatgaccgaattacagtgtggagcggtctagtgagcagctagcgggtcattccgatattgatgtcgagcgacgttgtcataatacaacgtaacttgggtggtaacgcggaattaaatttcgtccctattagtcattgactagtggggactttttatattttaaggaggtttctttgtgacaattttagatgagcttaaatggcgtggtgctatcaatcagcaaaccgatgaagaggggctgaccgaccttgttaaaaacaagtctgtcggattgtatgtagggattgaccctactggtgactcaatgcacgttggacatttgattccctttatgatcttgaaacggtttcagttggccggacaccggccttacattgtgattggcggtggtactggttctattggagatccaagtgggaaaaagtctgagcgagttttgcagtcaatggaacaagttcaccataatgaagcggcaattactgctcaaatggaacacttatttggtcaagatggcagctttaacattgtgaacaattacgactggttatcaaaaatgtcgctgcttgattttcttcgtgattacggcaaactgtttaacgttaacaacatgctggctaaggaagtcgttgcgtctaggctggaagttggtatttcatttactgaatttacctaccaaattttacaatcagtcgattttcttcatctataccaagccgaagatgtacaactacaggttggaggtgccgaccagtggggcaatattacggctggaattgatttgattcataaaattgagggtgcagatgctaaagcctatgggttaactattccgctaatgctgaaagcagacggcaccaagtttggtaaaactgctggcggtgctgtttggcttgatccagaaaagacaagtccgtatgagttctatcaattctggttaaaccaagatgatcgtgatgttgttaaatatctgaaatactttactttcctaagtcaagatgagatcgctgatttagaaaagaaggttgcaacacaaccagaaaagcgtgaggcccagcgtcgtttggctgaagaagtgacggctttcgttcatggtaaggaagcagtgactgaggcagaaaatatttctaaagcacttttctcgggcgatgttgctgatttatctgccaacgaaattgaacagggctttaagaacatgccttccgttgaagtttctaacgagaagcgtaatattgtggaatggttagtagatgtgacgtcgattgaaccatctcggcgtcaggcacgtgaggacgttaataatggtgcgattcggattaacggtgaaaaagtaacggacgttaatgctgaaattgatccaagcacccactttgatggtaagtttgtcatcgttcgccgtggtaagaaacgttatttcttagcaagagttaaatagttaataggtagttaaaggccggttcatcaaaaatgaatcggtttttgtgttttcatatgtagaatttggggtcgtataagttaatcaataacggtttgaaggcactgacaaagtttttacgtatttatttgaaaaagtaattgaccaactgggtaatacttggtatgatgttatttgttgtcgcgagagatttgaaacatatataccgattgaatatttcaaaagttatgtgttgacatttcaaaacgatgatggtattcttaataagttgcctcagcgaaagacgtttctacgagaaatgttgatatgaaagtttttgttgactttctcaaatcgatgagatacaatatagaagctgattcgtaaaagaatttgcttggtagacctttgaaaactgaacaaagttttgtttcacaaatgtgcagggtatatcaatttcggttgatatcaaatgtaatttgcgaagtcaatttcgctagtaatattaatgagtcacaaacaatcat
